United States Patent 6,812,339 (POLYMORPHISMS IN KNOWN GENES ASSOCIATED WITH HUMAN DISEASE, METHODS OF DETECTION AND USES THEREOF) - sequence listing, part 13

SEQ ID NO: 12141 - DNA, 57299 bp, Human
atgtggtgggggaggggtggaaaatgggtgagagggtggtggagactcagtgggatccccagctacttaattccccaacagggaaagagcctagaaactccctccacctcccgcaaagcagtggggaagttgcggccacactgttttcggtccgctcattccctctgcagtctggctgctcagggggatggaggaggatggggcttgcaggcaggcacagccggtttggaaggtgtcctggctccagcactcaacttgtggcatgacactcaggggagtcaccctttctggccctcagttttctcctctgtaaaataaggaaattcgacaaaaataagttatcaccaatttattcaccaccacgtgtccttttaattccatctgccccaggactgcagtggggagtctttctttgccgatggacttcgaaaatcatcaccccccgcattttttgtggttaaccacagctagccaggaactcagggcttctcatcagcagaggcctctgcctctccagtatccagggccgaatggattttgggtcaaggcctccctcccgcagccaggaggccctggctttatggaatatcgcttggagtccagggagtcagcatggggaccccgacagctttcccatgccccaggctcctgggcctttctgggggacccctctggaccttgggcattaacaaggttcatatttggaaggtgctttgagggggcttataggtatttggagtttactttttaaactatttgtattggaaaaataacgtgtgcacaagggaacaacccaaatacagaagaatattaaaatccccaagcccccagccccctcccatgctactctatcccaaagtcagctctgccggctcacccaaccctgggtgcctctgcccagggtgggggtggaggtttgagggttcgggatgagggctggacgaagggcctcctctcaggtccttggacacgagctgtgcccatctgctcagtgtggacccaggactactgcccacaggcctggtgctgcctgggcacccagacccacctccagggtcgccctcagccctcctgatgactctcggactcgcatctgtcccaacggatgcaccaaagattctccagtgggaaatcaaatttttgataacaagtgttttgaaataatcacgcacttggtgaaaaatcaaaagaggggaaaacccctttcccatctgagaccgctccaccctcgccagttacgagctgccgagccgcttcctaggctctctgcgaatacggacacgcatgccacccacaacaactttttaaaagaatcagacgtgtgaaggattctattcgaattacttctgctctctgcttttatcacttcactgtgggtctgggcgcgggctttctgccagctccgcggacgctgccttcgtccggccgcagaggccccgcggtcagggtcccgcgtgcggggtaccgggggcagaaccagcgcgtgaccggggtccgcggtgccgcaacgccccgggtctgcgcagaggcccctgcagtccctgcccggcccagtccgagcttcccgggcgggcccccagtccggcgatttgcaggaactttccccggcgctcccacgcgaagccgccgcagggcccccttgcaaagttccattagtttgaaggacgcgaatctcagcgagagaacctgcggaaagcgaatatgtggggcgcgcagacggggaaactgagtcccgcgagagggccggcctgtgcgctgccccgcccgcgccccgccagcaccgccgtgcccgggcgcgcccgccctgccccctccgcgggcggtcccggtccagccgcccgccctccctcccgccatccggccagcccccatcccgggcgccgtgcccgtccccaaggcggctcgtcaccgctgcgaggccaatgggctgggccgcgcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccggctgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaaggtactccgccgcgctcctgggcagctccccactctctccatcccagctcggacctgcttctgcgggactggtgggcaggttgaggggcagcgaagcgttgtggggtggccagggcaactctcggggacaggcaggtgggccccggggtggcggatttccgcgggctgcctcggaaccgagcttcgcgcccagcccggggccggttctgcgcccagacgatgccagtacgcccggcctgcactctggggctcgagacgccgggcgaccggccatggagtgccctgagggcaaccacacagcgcggggaccccaggacaaataagaggaatgggggcataaaggaaggagagaagttcaggactgggaattggcgcctcgcagagcggcttcaggaccacaagaagtcatttcggttgctttttcttctatttacgtcctccgtcccctttaaaattcactgctttgatcacgggaccgctcagtgaaaactgtatgtaactcttttggaaaggaacagtgtttgccggcccgccccggagtttctccaaaaagtctaccccgagcagggaacggtttggcaccgctctcgtttcggcggcgttgctgcctgtcttgctttcctcgttttgagccagccctacaaaaatgaaagtggctccttttgaataagctgaatcgggctttggatcacgaaatctgcagaggcggagaagggaccgggttagtgatgaggaagaagtctacccctctgttcctacagccgcacacaggacctgttctggcaggggagacggtggtgatgggggaaggagtggaatggagcaatgtctaactctctcgcgggaccttccggagagatgctcctcatcttcaggcagaggccatgtggaaaaataatatcgagttcagcagcggccagccccgcgttgtaggaaccagacagcggggcttggcagtgcgcttgggcgcagccgtgccgctgctgccggaccccagtgctgcctcctcaacacgggcagtgccaggagaggggcataggggagcacagtgcagagggactggtctagagtttactttataggaatatggttcggtgtgaccaactagggcttagcatagtttggcttacgtggacgggaagatgccagagccgaactgggtgaaattcgagattgcgtatttcaccaacacaggagcacagccctcgggaaactcagcctagtcaggcagtagagagttgtcccggagagaagtgatcctgcagactcgagaaggggcatgatgatagcacacgtctgttgagcacccagtctgtgtgccgggtgtgttacctctgtgacctcatttggtcaaacgaggaggcagttgctcctctctctctctttttttttcttaagagacagggtctccctctgtcgcccaagctggagtgtagtggtgtgatcatggctcactgcagcctccgacccctgggctcaatgattctcctgcttcagcctcccaagtggctgggactacaggcggatgccaccacacccagcttctcattcccgttttacagatagcggagctaaggttgaaaaacttgcccaaggtcattcagctggaatttaaacccagacagcctcattcagaggagtcagcccagcacttaactccaagggtgtgggagaggggtcaggtgctgtaaatttcctggtgggctggacgtgcatccccctcagagctgggaacagcatacacaaagcctaagacttgtttggaggtgaatagatcagtgtggctggggaacgttttgggagggcagcaggagtgagccaggctggtggcccagagtcccagggctgaagaggctggctgtgccccgtgccctgtgcgcagatgttcttgaactggagcaactcaaagcctagtgtagtgtagggctgacctagcagtggagtgcggaatgcatccagggtggagagtttagactactgcaataatctgggtgtgaggcgacaacattgaaaaagcatgtttttgtccaaaacaagccagctgttactggtctcgctgtttgtggtctcatcgcacggggtcctgagttgctggcaccatgcgagccgcctaatttattgctagtgaggcaagttgcttaacaagttttggagttggctgagtccctgtgtggaggaaaacaggtcccccattggccatcgggctcacagcgggcccccggtgtaccagtgaggggacagccacagagggataagcatggtggctttgaaaggagggagagacagagtgggtacaatgcttttcttatccctccctccttcttttgcaaatatttattgagctctgtagggtgtctgacaccgtttgcatgtttgtctgtctggcacatcggaggtacttggtacgagtggattagtgaatgaataaatgaatgaatgaagacaaacgggaggtgcttgcgatacacagccattctgtttttccttagtggaaggcactgctttgctgcgccccctctctggatctcacactccacccttgacttttcggaggtgtttccgaggacaggcgcctgggagccagcagacttcattcagtccaagccaggctccaggactcaacagctggtgcccacgggcaggtcacttgacgtcactgttaaatgaggtgaattggctgcctgctctggctggaagattggcgggagagtcactttagctgccatggacatgagccttttctaggggtgccacttgactagaggcctggagttggagcaagtcatacacggatctggagacagagctctcgaggcaggagcgggtgctgcgatttcaaatattataaggtggctttgtctggggcagagcatgccaggggatgagaggtagaaatgtcatcagatcaggggtccccagggaggtgactagcactttgggtcacagtagatctttggatagaggaacatgtcaccattcaaaggaaagcactttcatctgtaagctgtttattgaatagacctcagagaacatctctgctcaccgctctggaaatgaaggcaaatcatctatttcagaagtcaatgcactggcagggtttggatgggaaagtatacaattcagctagagaacaaagatctgtcatctccagctgtactggtcagatgattacaaaaaagaaaggaattgaaatactaatagggtactaataatgagggctaacatatatgttgtgcttattctatgccgggtgcatactaattcatttgatcctccggacagtcctatgagtgagtgctgtagtcttccctgggttacagctgggcagctaagtcacagagaagtaccttgctcaggactggtggtcccacacaactggatggagagcctcgttcataaccaccatgctgtgctgttgacagagcaacagagattttaaaccaaccccagctaagccccagctaatagctgaaataaacagggctccagatggctgtggcttagagatggaacaggacagatcacagccttcactctgcaggctcaggagcctgaagacaaggttgcctccagttgccgtcagtgcagccctcactaaagaaaagcaaaaagagccgagggactgtaggaaggctgtttccaagccagagatccagacaaactgctcttgaagagagaaagcccttccagattcccccatgtcccaaaagaccagccgggattccggacctctgctaaaacatggacaagaagccaggaacgagacctgaaacagacttcccaaacagcagaagcctcatccatttctcctgctagtacatcctccaggaaagcccaccctactccatgcagcagcccagacaagcttggaggtctgcaagctgcaggggtgcccagaaactccacccctggaggtttttaggatcgcctgctcctggtctcaccccagagcctctaaaggcagaggctgtatgtacatacctggtgaagaaccaagggcttagatggttgctttacttcttggagccctggaatgtttgtaaaatttacttttttttttgagacagtgtctcgttctgtcgcctacgctggagtgcagtggcgcgatctcggctcactgcaagctccacctcccgggttcatgccattctcctgccttagcctccagagtagctgggactacaggcacccgccaccacgcccagctaatttttttgtattttttggtagagacggggtttcaccgtgttagccaggatggtctccatctcctgaccttgtgatccgcccgctttggcctcccaaagtgctgggattacaggagtgagccactgcacccgtgccaaaatgtactttatttaggtgactctttcgtgggaacctcaaacaagcaatcattgctagctgagtgctgaccctgtactgagctctggggagacagggttgaataaaacaaagtcactgcccacaggtaacttatattcaatacaatgggggaaaatacaatcactgcttccctggggttgtatttttccattgttaaagtgggcagtttgctcgagagtcattttcactattggcaattcaaatacaccttttgtcagttaaaaaacaagtgtgccagggacctgagcttcatcttagggcagggtgggtggaaacatttgtgagtctccagcttttagtcacctgaaacttggaaacttggaggtcttttgagcagtttatgagtctctgcctgctctggtcggctgccttcttttattgctctgttggttttgctaaagagttaaaatattaaggcttcataaaattaggaagttaacaagctcaaaaaccaagtgtttgagttacttcattccactgagagagctgtaaatgggttgcattggaacttaaaataactgcattgagtaagtgatggtggcgggcaccatgagctaactgtggtcagaagcctgatggcctccgctttggggctggattctccgtttggagctgtgtgatcctggatgagtttcatgccttggattcagaaatcagactttccatgagcttatatttcaagtgaataaatagctctggtcaggcttaatttgaagaagaagtaagcttggcagtgggtgagggttccttggaaggccaactggggcggaggggctgagggcaagcggctctggcccttcctggggtgttacctgaccaggtaacagctccctcgacctctcggagcctcggcagtgaggggattgggccagttgatctctgaggctccttttaactagaatggtctgggatttttctaagaaaacaagtctttgaggaggttgtggtcacctcattcctaatttaaagcctggggaggcttccttatgagctacttctttttcctaaattattgatggttaaagccaaggctggcatcgaatagatgtgatccatcttgagcctggttgctttgtgtttcagctttgtactggctgctgaagtccccgggagaccacaggggtgacatgttcatctccaagagatgagcttccacgagactcataccccttgctccttccctggggctccaaggcctttgggtcatctgaagtgagatacccttgtgtcatttcatcttttccttctccaccttctctgccgttaaaaaaaaaagaagaaagagaaaaatcctattaatagagaaaccgagaagtgtagccattctgaatgtgtttccaaaaggctcctggaagtggcatggaagttacagtgattcagcactacttggtgacgtgtgcctagaaccacagggggacattagccaggacaacacgcctcaggacagaagtaagtggctgcgaagaggcatgtccatcactgccggaaagatgcagagttcagtttttggagtcagtgctgagagttccatttctaaattcattcagagcatttatttaacacctactgtgtgctcagaagtgtatcaggtatggggactcagaggtaagggctggtggcccctgatctcaaggtactcgtggtagatagtatgatgctcagcttaagggctgggcttctgaagtcggattgccattttctggatgtgtggtgtttcttgggtgacttcatctctaagtctcagtttccccatcagtaagataagagaagtaatagcagatacatacgtagctcttagggcattgcagaatggaaggacctccttatatgaaacgcaaagcactgtgcctgatgcattgctagaactcaggcaatattagcgtgttgtcattgtcatcatcatcatcatcatcatcatcatcatcatcatcatcttcaaggcactgacaaaggagtcagctgtgtgggaggagtgctgggacactcttgtctccctggggatgaggtgggtgggtgggttaggaaatcttcacagagaaggagggtgatgtgagacttctgtccgggagctgactcggaatttgccatctaatatgttggaaaaggttctctgggcagaggtatccaaagtcactttgcctgtcaccctttgaggtcccagttgttgcctatatcatgtgaccagtgtgtggcttctcttgaattaagagctgcatgtctggactgcctgggattttacagatgtcatctcgttaactctccctggagcttgtgacacccaggagatggcagtttatagaagccctggcaccttcttgaatgatgcttggtttggtttctatgcactgggaattcctcacaaggaaagatttgtcacatcttaaggaaggaaaaaaaggcaaatttgggagtccatggataccctattattttagattccaggacaaattgtcgaataagcacgtttcataaaaacaatcctccgcagcatcccgtgacagcagctggtccctcgccacaggataattatgtctccttgtgcacacaaaagtctccgagggcatattgttgtggctggagtttctgataatttccaaattgaacaacctcagtcctaatgagtcagaggcttgtgcaatattttcaaacctcaggaacatctttttcattagttgtgcaataaagatggtaggcctatctctgtgatgagctgtttttttttctcaaagtttgatgagattcgccgtagaattccttctcacatagtcttgggcaagattttacccgatcttccaacacatgagtcatctcatatcctgtgactaagaagagctgtctctttggtgccagttttctaagtgcagtcaccacttgatggagacggatggacacagttgggattgcccaggcagatgggcaatcttgccagctagacataggggagggaagcctcaatgttcagcggtcacatctgcttttctgtggcacagagtgagctatacaggaatattgtattctccaggacagttagggcagtgggaaatgtcatcaaacagaacagtgacccaaagagccactgccactgggtgctctgtgggagctgggcactgtgctcattgtgttatgggccttgctttgttcttaccttgtagccacccagagaggcagggcattatccttgcttcctagctgaggccacagaagaggctcctagaggttagctgtaacttgtccaaggccagccagtgcaaggaggcagagccaggatttgagcccatgtctgtttcactcccaaactattcttcagatttctttaagtcaagtgttatttagaaatgttttgtttattcatcaaatatttggtgggtgtttccagctatctttctgttattaatttctagtttaattctattgtgggctgagaatatattttgtatgatttctattctattacgtttgttagggtgtattttctggtctagaatgtggtctgtcttggtgagtgttccctgtgtgcttgagaggaatgtgtgttctgtcattgttgaatggagtgttctataaatgtcacttaggtctagtggattgatagtgcggttcaggtcaactgtatccttcctgattttctgcctactgatctatcaattcctgaaagagaagtgttgacgtctcctgagtctattctgaaacactgaattgcggtctccatgatgaaccactagagttagaaaacctgggtcctagccccatttgggcctttgggatgactcccttctgcctcagtttcctcatctacaacagggggacaatgatgctgcctaggagacatcagcaggatactgtgaaagtccagtggcataaggggtatggaggagcttcgtcaactcctaaagcttcagtgctaggaatcctaaagcattgaaatccaaagatataaggaatatgaaggagttttgtcaattcctaatgcttcagtgctaggaatcctaaagcattaaagtccaatgatataaggaatatgaaggagctttgtcaactcctaaagcttcaatgctaggaatcctaaagcattgaagtccaatgatataaggaatatgaaggagttttatcaactcccaatgcttcagtgctaggaatcctaaagcactgaagtccaatgatacaaggaatatgaaggagctttgtcaactcctaaagcttcagtgctttaggagtcctaaagcattgaagctgtaagagattaggacctctagttggcaattccagactcttccaggactcctgatagagccaacaccaagaatagtgaagccagaaggatggaaatagtaaaatgcctcctgggtgtcaaagcatgggtctcctctgggcatgttctcttgtcctactgagacatgatagctcttggccaaagtgactgaacttgaccctctgtttcaggaaggccaaatgcagggttcactaccatcatgtccaagggcagatgcgttggtccagaacatcagcatcccaatcattataccaagcaaacagccgtctctgcctgcaccgtggagagcacacgctcctcctggggtggcctgcatcctgtgttcttctcaggccgactttctgtttaatgtttgctggtcaggaaatggcctgagctgaggttcttcagatcccagtctgacctttctccaccagcatttgtggctctgaaaaatatagcccagtgtggtttagccccactggatgaaacccagtaggaaaagtctgataatagcagaagacgcacaggaggaagagtgaggatttgagagcatctgggaaggaccatgtgcctggatatcgttctgtctgtgggattctgtgacacttgtcatttacagtctgttcccatggaattctcatcattggccaaacatatagtccttctgtcctctgaaaaatatcattctgctccgacctttcacacccatctctgaccacatcaactccctgtttgcatgcatcttgtggatgaaggacaccactttacctgtaaagacactggtggcttcccaaagccaccaactgacttgtagagaagacagaatcccagagtatgaaacctgagggtgaagggtcctggcaggtcctagagctcaacccttcacttcacaggtggggaaactgagggagccaatgggaacatgactctcacaagctgcacagctcatctgtaggggccagtgtggagtctgtttgtcctgagacccagggctgagcctttgagccctccgcatctcagccgcatcctcctgttggagcagttaggtgtttgggagaggccacggtccatgctcatggttttcctgtaaggctggagaaacaggccttgttcccttagtctctctaatcaaaatgaggttgcagaaaacccttctccctacttctccctaaaataatttccttgggttagaagatgactaaaagactattcatccgatgactgatgtctcccttcaagagttataagcacatataaatgcctttgaatggtaattataataattttgctgaagggaaaatatcagtataaatatcatggtggacacatggaatgaggactgagatgctttcatgtcttttcagctgtggttagattttctttaagcagaatatacaagtttttcctctcctagcataaggactctttttttttgtatcttttctctctactttttagacatgatggaaaatgcatttatacatttgatgacatattgtactatctcagttgtttaaaattataaatgtaatttaatcatatgaaaaattaagaaaagaagattcatatttcaccatcatctccccagaaatatcatttctttattactattattattattattattattattattattattattattttgagacagggtcttgctccatcacccaggctggagtaaggggcacgatcttgactccctgcaacctccacctcccaggttcaagcagttctcatgcctcagcctcctcagtagctgggattacaggcctgcaccaccacacccagctaccttttatatttttaagtagagacagtttcgccatgttggccagactggtctcgaactcctggcctcaagtgattggcctgcttcagcctcccaaagtgtggggattacaggcatgagctaccatgcctggcctaattccatcatttctgtcccaagtgttgccaccgtttggttaactgttcccctgttcacatccatttgggccaaggttgcaatgttaaacaatcctgagatggacattttcatgtttatggctatttctgtatctagggtcattctcttaggagaggtactaaggagtacaaaaactgggaagaaggatatggaatttttatggatctggtataaattgccaaattattttccagaagggttgtagccatatttgttgccatcagctctagaatttcaacctcgtaagtcactgaaagaaattctcccaaaatcaatccttcaggaataatggaagaagatggtgccaaaccccagccattctgctcactgttagattccttttttggtcttacaggttacttttattctcaggttgatggctcttagagttgagcaatgtttggggtagaataacgagcacttttaaaacttggttctacctggggagggggtgagttgtgatcacagacagtctcacctgggaggggcttgggtgtttgtcggcttgtccttctaacactcgtgtctcaggcgagcagcctgggaccagtgaggtgacctgaaggctggaggtcacaagctaagaggcgacagagaacccaggtctcaggaagcccagcccagagctcgctgcactgagcctctcggatgccagctctgtccaggatgcgggaggaggccagactgatttggtctgttttgaaaagtgatgaaaatatttattcaaatgttttgtactcataggcagaagtataacaggagctgcatatacaaaattattttctagtagtcacattaaaaaagtaaaaagaaagaacacgattatttttctttttaaaacagctttattgagagataatttacatactataaaatttacccctttaaagtgtacaatttgctgttcttatatattcacaatcatgcacgtatcactaccagctccaggacactttcatcaccgtaaaaagaaaccccgtatccattagtagccaccccatacttctcctctgcccagccctaggaaaccaccggttcattttctatttctatgaatttgcttattctggacatttcatataaatggaatcaaagaatacgtaacgggcttctgtctcttagcataatgttttcaaggttgtccacattgtagcatggatcattatttcattccattttatgattaaaaatatgccttttaagggatacagggagaccagacgtctattttatctcccctccctgatggggaatcctaatttcagcctggaaagtcactgcgaaagtctaaactgcagaggtgatactgtttccactggaagaaactgtagcacctgactcaggaagccagcattaaaaccaagaatattctatatggatggggattacgcactgaaaggaaaacatgaggaaatgcacttttcagatttattagatcatagaacttttttggagctggaaaggatgtcggaaaccgtctagcctaccccctcatcttaccactgaggtaactgaggcccaggaaggggaagtggcttgttttgggtccgggaccactcttcatttcttatttgagccaaagcttccttctggcgtctgtctctgtttcacaagttcccctcgcatgggggctgggtactgcttggaagaactggcttcttccttgatacaggggctcgttcaccatcacctccctccctcacgtctcttctgcctctctgcagcctcaggccctcctcctgcaccaggggggcagactcaacccgggtgggcactgcctcccagtccgtggccagaggctggagggctagggagactgaacagccccggcagctccagacataacaacctatgttgaggagtcagggcaggaagcgaacccagctgagaaatctgcgaaggtcaggaccagagccagacgcttatcaagagcaaagttaatggtttttgtgaaccgagcagtcagctgtttccccgaagataataatagacacatcatgttgggcattcaggaggcatctgaaaaaaaaaatgtgcagtggaattgattggaagcttttccctaatgcataaaataggccagaaaagactatcaaatgtaacagcaccgatcaaacccaatagatcaagcaaggactgaaaaacacaattttttttttctttgccagtgagtctgaaaagtgattttcaatgacaggcgcctttaaacatagacaacataaacaacaacatagttgttctggaagaggcatcttttcccagtaaagccaaagatgcagatctaggctgtgcttgtgactgacagcacagtgaggggttcacagccagctggccaggtgccccccgaaagcacatttcgaatctactctatttgagagagactgccttagccttgtttgggtaagtcttcctccttcacttcacctgccacagacttttccaggcaccatctgctgcagtcttggcccagcccctgcaacagttactgctcaaggcacccgggacatgcaggacgggggagcagcctgaggtctggcgtccggcgagcttttcccacttggagccgtctgggagactgtcccggaaagagaggggctgccaacacttggaagtgccaatgtgtgctgcaagtcgaggccaggctcccggctcccccgcctcttcctccttgattcattaaaaggaaagaaagaggccacacgaaactctcctgaatttcatttctttgtttctatgcaaaagacagagcgtggtcattcatcattcaaattttagcctttttaaacaaataataattcctgcttgtgaattcagtgtattttaacaagagtaggtctgagggccgttggccgtgtctttccttagatttgcagacagcggccctgatggtgcatagggtttcaggtttcctttagacctcagctggctgcctgggccaccacttagcaatgccattgtccttcctgtgcattttctttgcagaattcgaggaaatccagtcgcacaggcccctctgtgcccatgtccccggcgccctggaatgtgcagtaccagcagcagcgattagaatgggggtctggtttcccggaatgtgcaaggtctcgcttctgtttctgctgcctccatgccccagaccagtgctgggccgggctctgggctggagccgtggctgacaagtttccttggaatttaatggagcgggccagacagcatgcagccactcaaactgaaaacctgggaaagaaatgagtgttgtggggcagctttgctgcattcactgggtcatatatgcttctttttcttttcctcaggcaacccctcttgcagacaggaggccccctcccctttcgcttcatgcctcactggccattaggaaccttttaaaactgatttctctcctgaccctcagagagaacatagtccaagttccctggaggaggaggaagcgctctgtgtttctctgcagttcacggctcagttaaatgcagcctacgtgctgtctttccccactcctctgcctgctcccgttgtgcttctcatgatcattctcaaattcagcgagaaacctcacaaagggagcttttcttagggaagagtcatccttggcctcccgaatgtggaccagcccctctccccagctgcacagcatcaggttagttaaccacctgcctccatctgggtcctgtctggacaggcctactcacacctgctgcaggcatccaacttgccctcaggtgcctgtggctcgtccagaggggtggagcccacattccagtcctgacaggtaaagttcagtggcggggaccctgcatttagtgtaaagatcaatattccaggtcctctcttcctgccacccagcgactggccgtttgcaggcactcggtcccagttgtcctgggcctgcagcccttgcattctctctgctttgtctctgctattgcacccctgccccatcagaaatgcaggtgggggggccttccgctgggacagtgagagactgggtagtaaggggagcgctagagggatggttgcgcttgcatccagccctgactgcattcgctctcccccgcctctctgtaaaggtgctgagctgtgagtggaaccaagtggatgagagtggccttgggcacctgccgataaatttcccggtgtgtcttctcctcctgggagtcccatctggatttgggtctggatttatttattcagcaagtagcctctttatagttactttttttttttttttttttttgagatggagtttcactttgtcacccaggctggagtgcactggcgcaatcttggctcactgcaagctccgccttccaggttcacgccattctcctgcctcagcctcccgagtagctgggaccacaggtgcctgccaccatgcctggctaattttttgtatttttagtagagactgggtttcactgtgttagccaggacggtctcgatctcctgacctcatgatctgcccaccttggcctcccaaagcgctgggattacaggtgtgagccaccatgcccggcctgtagttacttttaatttagccatgctcggggctgaaggggatgccaaagaaatataagatgagcccctcagacggctaaagatgaagatgaggcctccagtatgtacctcccacatacaccccaggaaattctgggtgtcactggattctggacctcccaaaagctgctggcacctggaggatggggccccgaggctggacctcactcctgctgggttgctggactgggaaagtactgatggcagctgaggagtgtgtcccagacttcactgagccattcccaaagattattccaagttctcctgacactgcactggaggcctgctgtgctggccttctttatttacagtttctgactggtgtctagcagccctgccagagagagcggcagtgtgtctgcaggcgaccaggagaaatgtctcaggctttagagcaggactttgagcacatagctgtgggggcccagcaggctgtctcctgcacggttacttctccttgtcctttcatggtcgagaggttgctgcctggcccttcaagtgaggatgggacatgctatccattggccttaatttccaacctctgcatgatgcattttatgctcctgcctttgaaagaacttttattttcttgtcatttatgcccagacccacatggcagaaggaagggaggctgggacaggggaggcggataagctgccgctgacagacctgcccagtttcttagctcatcccggcctccatcctggtgagcagacactggcccaatccagccatatttttggctgagtttctgtcttcacatctcatccttaaccctgaatcctggccatagttggtactgggttgtattcttatttgtaatctttaaagtaggaatacctttgctggtatttaaagtggaagaaatcaggtgaagaatcacaagtgatttgcaaactggaagagacattagaatgtaaatgtgaggaagcgtcagcatgaggggcttgcctgggctgcacagcttgccttggctggagtatgcactgttctggcattgcagagaggatgggtaccttgcctccctgcaggtgggggactgtatcagcccccgcagactgctcctgggctcctgagtttgacagatttttttttttttttttttttttgagacggactctcactctgttgcccaggctggagtgcagtggtgcgatctcggctcactgcaagctccacctcctgggttcacgccattctcctgcctcagcctcccgagtagctgggactacaggcgcctgccaccacgcctggctaattttttgtatttttagtagagacagggtttcaccgtgttagccaggatggtctcgatttcctgacctcatgatctgcctgccttggcctcccaaagtgctgggattacaggcttgagccactgcgcccggctgagtttgaccagattaaggcagcatctccagtggcacctgagcagctcctgagatgcttttctgtgctaaatctggatttggggtattaaatcaaatgaatttgaaatgcaggcacagctggccccatgggcatggacctgtgcagtcacaccttgccccgtgttcagaagggtgctgtgcctgttttaatgctctgctgttgctctcttgagattcttaataatttttgaacaaagggccccacatactcattttgtactgggtactgcatattatgtagctagtcttgaatctaggacagtgcattaaaatgccattgattggatcaatctgctcttgcaactgatttgaattttgggaacatgctgtttcctgtgaataaaggaggattcatttcttttccctcgaatacactgcgttctgttttccaaattagctctacgtatcaactcagctgagaaattggaagcggggattgttctggctggaagggaaggttagattgttaatcctgcatcctggccctgatctcaccgagtgtgaagcatgttcccacaatggtgtgggctgcggggggctggaggctggctgagaaggtggggaccaaggagggaggctagcctgggagccagacagatggggttaggctcttgcttttgccactcgccagctctgaggcttagggcaacatgatttaattctctgatccttgtttttttcatctttctgtagactggtgatgagatgcaccctgcaggcttgcaggcttgcaggagtaattaaaggtaatatttgtgcctattattgggcttgacatatagtagatgctctacaataaatagatcctattattcttattgataatattattttattgctaacattgaaggttgggtgggatttgactagctggaggcgaggagaatgagatcatccaggccggaaggaaaagagacatgaatgcagggggatggggtggagcactttggaggtgtggggagaggtctgcagggtgggagttgtgcattaaggagtcgtggggagagtggaggaatcagtgccacatggtgaatgagaggggatcgtgggcccgaggagatggacgatggctgcggggatcctgcaggaagtttatgtgccccaaagtggcattatcagttagggggagacactgaagacagaggtgaggcctgcctgaattagcgtagagtgggattcttggaagcttcagaagcttgagaagagccacttggaggtgttgaaatgcacctgggagggacgtggggacccagctctgggctgagagctgggagacggaaacgcaggtgaccttggccttgaagatggggcatgatatttagtgctttatgtgcaatctcacctaggactcccaagccctttggagtaggtgatattagctccgtgttacagaaagggagactgaggctgaagcagggacattcatgatctgaagtcacacagctgtacggggcagaagtgggcatggaggcattaacttagagccgaaaggtgtgacctttcttagtgtggctggccccacggggaacgtgtgtgggttggagtacaacttggtgttcctacccatcccagatgctctgcgtttgtgaaccccagttgccacatcagggcgggcgagggcaggaagctctgcagggagaagggacaagggacagagccaagaacaggggcagtgccccagggtcctgcaggggcaatgaagggggttggcacacctgggttagttgctggccagtgtggggagagagctggcctgggagtctaatgggaatgccagggaaagctgccttggtcccctaaagtgaagcccccatgctggccatggagtgttggtgattgagggtccctgctagttgtctggccgaggcagcatgtcctataggcatagctctggtgtcctgctggcgtggcgtgagtgcccctcatgctgggagccagccctgtgctctggagggaggtggtgggaggacaagggacagtgggacctgccacctgagcaggaattggcaccttctcccactggcaggtccaggttttatggaatctgaaacttgtacaattcagtataccctcttcaagaaaaacacccctcaaaattatgaatataacattaggtatgaaactattattgatatagattgaaaaaagaaaatgcccaaaatgacaaacttcagaaaatagacaaatactgcaaacatcacaaaatcagaaaaataagattaaaaaaagctaactgctgaacactccgtcatcttgaaaatgcccctctctcctcctctattttttggctgtgaactctttgctcaccttttcatgtgacaatgcttttgtaatatttcctacagagaaaatagaataatttattattacttttattgtttttggattattattatgatcaattcaatatttttctgctacccacacactcactgtcttctgtccaacctctggcctgcaccaggggaaccagcagtttcccctgccatagggtgtccctggagaccacacatatagcaggatagatatagcaatttaactagacacagaagggacttcaaagccacaaatatatctcatttaacctgaacaaaatgattatccagttttacttttcccttagcctcttcccccaaatgctggcagccaccctgatgggatagatgtgtgacagagggcaagagaccgtggccccaaccagctgcagcttcactctttcatttctgtatactctctacaagctgtgatgatagcactttgctagggcccctcacagggcagatggagggctccacgctgaagctttgtggatgtttgctgtctatccacctctgctccttgtgcctatgcagggattcaggcccaaccactgcagagagcccaagagcatcaggcagaggttcccaaactgtcatgattggtggcacctttagtagttgatacggtttggttgtgtcctcacccaaatctcatcttgaattcccacatgttgtgggagggacccggttggtggtaattgaatcatgggggcagatctttcccgcactgttctcatgatagtgaataagtctcccaagatctgttggctttataaaggggagtttccctgcacaagctctctctctgactgctgccatccatgtaagacatgacatgctcctccttgcctcccaccatgattgtgaggcttccccagccacgtggaactggaagtccaataaaacctccttcttttgtaaatcacccagtctcaggtatgtctttatcagcagtgtgaaaatggactaatacagtagtgcagtcattttttcatggtccccagtaaggccaaaaaatacccaacagttccatttatcaattagtggaggccaaacaatttgataagtatttgtgtccctataacacagtggtcattaaaaaaagacattttaatttcattattcaataagcatgattacttatgaatgggatatgtgcacctgttgggtgtcacatgacctttcaaatcttggagtcagattggacaccaccatgcccatttccagttcaactctgatttttgtgtggtacatgctttttatcacagtgactgccagaaatccaacttcatatggaatcatgaaaagggatgtagtgtgatctgatttcaaaactatgatcaatctagagctagtttacaaggtgtctaacagtgatcaagtatcactgtatttccctagaaaacctgaaatatcgatgaattttctgtggcactctggggtcccttggggcacactatgggaaccatgggattaggaccataaggatatgattttggcttcttcctgcctcagatctaatctttacctggcatttttgccttaaagatgaaagaagcatacattttgatgtatttaaagcacatattcggccaggtgcggtggctcacacctgtagtcccagcactttgggtggctgaggcaggcagatcacaaggttggaagtttgagaccagcctgaccaacatggtgaaaccccatctctactaaaaatacaaaaaatagctgggtgtggtggcatgtgcctgtaatcccagctactcaggaggctgaggcaggagaatcacttgaacccaggaggcagaggttgcagtgaaccaagattgcaccactgcactccagcctgggctacagagcaagactctgtctcaaaaaaaaaaaaaaaaaaaaaaagcacatattcattttgtgcttattcttttgagagaaacacagataaaagcctatcctttaattcatactccccatactgtgattttcatttttactgcaacaaattttgttcagtgtgataatgaatgtcaaacacttaatgccttgctcttttcagtaacatgacatattggagaataatgactgaagcttatctacactgcctacgtctgttttcttccaccttgaaagaagttgttgaaagtaattaagaagtattatgtgtaaaactccagggatgatgtgcttcaaggaagcaacatttatgaagttgtgtgcttgactagtagtttataaagaggaaagacgaatcatttattgtcttgggattgaatcttggcaatttttaaactataaagttacaggaaatgttggctgctcttaatgggccatttgttgtgttaaaaatcagtaatgagaaatatttactaggtaagtggaaagatccatctctataaattgttgtaacttaccattttacaaatcttagttactcagtttttctgcttaaaaatgaaatcatgtagcactgtataagtcattcagttttttattttggagaattactctggattgtctaggctctgtgctctccacatatatttttgaaatagtttgtgaatttctacaaaaactcctgctcagaattttcactgagagtatgcttaatctatgggttaatttgtgagaaattgatagcttaacaatagtgaatcttctgatctacaagtgtggtatttctctccatttatttaggtcttctttattttgatagcgttttgtagctttcaatgtacagatcttgcaaatatcttgttaaatatttccctaattacttgatatttatttttgatgctgttatagttatattttaaaaattttgattccaattgttgctaatacatagaaatgaaattatttattgacctcttatcctgtgacattgataaacgcagtcatatattcgtagatttctagaatttttctatatagactatcatatatatcatctgcaaataaagacggttttacattttcctttccaatctctatgccttttgtttctttctcatgcctcattgtgtggtccattactgaacggcagccagttccagctttctgttcaattaaggagcaggtaaaatggccaggccttgacctttcagggggcttcccgtcctcattgccttctgctgcctcagttctggcttaacagaacagtgtggggaggaggcatggtccttacctactagggcgttacttggccttcttcaggttggttgcttcgtcaggtttaagagctcacctgggctgcagttcaggctaggttatctgctgacctggccctgtctcccttctgtagtgtctgtggggtacccttgtaagctagggagaagagacacacgtgaaggccagaaaaaacagcctgccacacagcttccctggatcataccttcgcagtgacatgacgacgtcgttaggaggcgccgaggtggctgagtgggtctccagacacctccctttacctctctgctgtgccactgatgtgtgacttgcttacacctatgcagagctgccactgagcagcactgtggccagtcctttggattttcttctttctaaattgtatgccgtggcttgatcaagcatttcatatacagtagatcatgaaatcagcatagaaaacacattgaggtaggtggtgttaccacattttatggatgagaggctaacacttggaggagtcaggtaacatgtccaaggccacacagctagtgagtaccctgctgagggtcacactctggtccatctgaggccagagcctgtgccagccttctcctcatgctgatagacgaggaaacagaaagaaggagcagtggacgcccccaccctctgtcccctgaaccccttggagagtaggcagtggcagagccagcctgggcccatctatgggaattctccatcgggattgactcctctggaaggaagacagttgacccacagttgagatcacagcagatgggccagccagggtgtctgtagaccatcaggcagtggccactccatgtagtttaatggacaagcccttttaatggaacaggaatctaacactgaaccaagctgcttttagacacacttttattcctcactctgaaatggcgtttggacaagccaaatatttcttcttctttcagttgacattttgtccatctttgaactgttagttgatgcttcttctgtttagttattcctgttctattttcctgttgccactagtccacccagggatggtaagaatggaagtcaatggttgctttttcatctgagatgcaccacgaaggcttgtcagtcagccttgtcatatggtctgtgctcccactgctccttctttctgtttcctcatctgcagaatttggagagtcctggacctgatctcaaatttcacatgttatttatcttcctgcagcacgctggggagaggaagagacagggacatagaaggttggagctggaacagacttcacatctcattccagaggcatttggtccatcttacagatgaggaaatggaggctgctcagtggactgaggctggaactgggccttccagtggccaggccagatcctccttgatctcccttgttgctttcctggtgggaagaccctggaaccactttatgtgactgtgtgagaagggaactgcctctcattttacccagcaaaatccaccttcaatccatcttcatttttgcccctggtgtgggcaaattctcccatacctaattcaggaagccagaaagaggaagtgagttaatgatccttagtgggaaggcgctggtaatggtccttcttgtgagagtttctgaaacaccacgctgtctctgtgttctggcctggctggagttaaacctcttcttggcctttccccaggaagctggtctgaggaagcccagatgcgtttgtttacagctgtctggtgacattcgccaggctctgttttcagaaggaacatttccattcccttatttacacctcccattggagtgctcggggggacacaccaattatttgcaactacctggaaacctaggagggtagcagatctgtaggaggccagtgttgaagtgagaagctgtagatctggtgacactgtgggcttgggagggcttgcccagatctgttacttatactctctattaagaaacttcagtgtccatggagaagttatttaaagtctgcgagcctcagtttccccatatataatatgggaaggatacctgattttcctattccacatgaaggtagaaaaaattaaattaaggcagccaatgaaagggttttgaaagcaaaaataataatatgatactgttctgaatttgttaaattattcttccaagtagttgcagatctttttctgtaccttagaaaaaaaccatgctatgtaaaaggagatgattccaatctttaaataaagcaactcagaggtcaggggctaggacagaaaacggccctttgttcacagaagcgctctcacttccaagaaagcaagcgtgggagaggcaggtggtcctcccgatgtccctgtgccccatggtgtcaagctgggttactatggcccttcgtgacccagtgcagcagggatgtgggaaccagtgggtgtgaagctgtgacgggtcacaagagggctgggacgtctcacagcttttacttatagcctagagcctggggaagggttgccactctagtgatgagagaggcgtgtgtgtgtgtgtgtgtatgcgtctgtatgtatgtgtgcatttgcatgtatatatgtgtgactgtatgtatgtgcacatctgtgagtatatgaatgtgtgtggaagtgtgtataggtgtttatgtgacagtttgtgtgtaaatgtgggtgtatgtgtgggtgtgtttatgcatgtacatctgtgggtgtgtatgcatagtgtgtatgtgtgagtttgtgtgtgtgtgtgcatttgcatctctgtgtatatatgcatgtgtgttaggggcaggcacacaggcctgttggtaaatgagacacaaaatacctacaaaatacaaaatgtgagacaggaaatacaagccccagttactcatttttcagtgcaacagacataagattaccatgtgaaattgctatgaaagtttccgaaagcttcctgtcaattcgtagtgagcagctagcagaggagtgcgggtccctggagcctgcttgtgcaacgctgagctagtccaagggggaagaatggggtgcatggctctcagctgcagaccagcctggaacctctccagcctgctttagcagagacttgttaagaggtagcagcaggtggcaagattaggagccggagtagtaggctaaggctgcacttccagggacacactgcctctgccaccacccgtgccacgaaaatgggagcccaggaccctgaatctctagcagtccgtttctgaatcagttaccttgggtatgtgcctctggttgatggaaactaacttgtagccctgctgggtgagagcctcacatcgggacatgtgacagctttgttgaaagtagctttggaaacgcccaccacgtggggccactcactgtaatataaacggtcatgcatcactgagcaacagggatacgttctgagaaatgcgtcgttaggcgatttcatcactgtgggaatgttacagagtgtgcctacgcaaacctagatggcagagcccactccacacctaggccagatggcagagcctgttgtttctaggatgcacgcccgtacagtaggttactgtactgaatactgtaggcagttgtaacaatggtgagtatttgtgtattcaaacatagaaaaggtatagtaaaaacaatggtgttatggtccgcggctggctgaaacgttatgtggtgcatgactgtaggtataaagcattacagttgtttgatttttctctttttctcacccacagtcttaaggcacctcttatgccttttgtctgggatgtcccgggcagggttggaacgtgtggttaaggcatggcggaaactgctttggggacagacgatggcctcagcttgccttggggtgtcagtgggaaagataggagctgcccctttgccttcgtgtttcttcgtaataatctcagatgtacccgtctggtgggcctctcctagaaaaagccccggtgctctttgctcctgcggtgtttctcaggagggttgttgcttctttgtaatggtggggactcagggaagggacgcaggcagagggtgatgccacatcaaaaagggacccttggctgggtgtggtggcttacgcctgtaatcctagcactttgggaggccgaggcaggtggatcacctgaggtcaggagttcgagaccagcctggccaacgtggtgaaacccggtccctagtaaaaatacaaaaatacaaaggtggtgggtgcctgtaatcccagttactcagtaggctgaggcagaagaatcgcttgaaccggagaggtggaggttgtgatgagccaagattgcgccattgcactccagcctgggtgacagagtgcgactccatctaaaaataaactgaaaaaaaacaaaaaacaaacttgggccatcagcttcttggaaaggctggtgtgaggttgaagcatttgctggtgcctctgctcaacgtttttgtggtgaacctgagcaaagaggttatcattagtggattttactgccttacctgggtgggcactcccttgggaggtggatggacatttgcagctgagcccaggtgggggaattgcgctcactccgccttcagaattccaaaggctgggcatgcatcttggcttcctctaacccatgtctttctctaggtggccacagcagagtgtcattaagtatctattctttgcttttgttctcagggcaggaagatcccaacagtttgcgccataaatataactttatcgcggacgtggtggagaagatcgcccctgccgtggttcatatcgaattgtttcgcaagtaaagagagccttcctttttcctataacctccgaagctttcaccgccactagcaaaacatgagagctatttttgagatacattaaagtgtcaaagtgtcactgaatatcttcctacttaagataagtgtgtctcccttagaacattttccctattcgactatataaatctacattcttgacccttctgaatgtttaaagaacctcgggctctgaagagattctctaagaatattttgtaagtggaagtttttgatgcatgcaaaaaattggcaggatgtttagtgtttaaatgctaagcccgatatataaaggagcgatggctaggtgtgtgtggctgttgcacaacccattaatcaatgcgttgaagcgttcattttaaggtgctacaggcttaagtgtgtactcctttggattttaggcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccaggtaagggtgttctcgcctgcagaggtgagttctcagatgccccggaacacccttggcaaaggcaccagagctctctgattgcagctgattctcggggggcactgaagccagtctgagccagtcacaggagggccttgaggagatgctgagtatggcctgggggtgtgggagaggaaggggctcaggaaaacttctgtaaggagccagataaaagtttttaaaataatgttttaaatgtttgtcaaagaaagcaatagatttgtaaagaaattagtaggtaagtagtgaaaattgattctccttcccattcccaatcctgtggcaactcttgttacagattttatttatcctccacagatacatcatgcgttcacaatgaacatagaatttactgggttttagactgagccatccttaacttgtcaacagttactttgaaaacaaaccagctctcccaaattggggttttgcggggttatgagatgtgtttcaaaagaatgtttcgtactttaaacatcttggaaaacttgaattaaaacagagctaatggatttcttctttccagaccttctcagagcttttagtatgctagtgtgcacgtggcttgcctacaaaagggtgttgactgaactatttgcccaaattataatcatttgagtatacagctttttgtgggggcaggcagaactgagacataccaaaatcagtttgggaaatgctgtatttgaaaatgctttctatttaaatattctctttgcaatcatttttgctctgttgatttgcttagcaaagtcttcatgtctgggacaatatccatttcttactgactcatcaaaaacccccactcgacacgtcgatgagagaggttttgtttgctgtgtggcatgttcagtgaaagcgtggtttccagtttcttcacatccttataattttctagacttcagatggagggaacaatcagaggaggctggaatcctgcctctgaccaaggaaaagaccagaggctgagccaggtggggtctcttgtccagccctctgcttgcctcgctttacctgggtgtgggctgagtaattccagacaagcgtggaattaatctggctgtttgtgctgttcagtggcacgctggttacacctccttctggaaacaactctgcgtgtgctgtttgggtggtaggattccgggtctccttctccgtctttttataacatcaagttgctgcccagctcaggctcctttacggccagtcttcagaaaaccaccagctaacacatttactaccctccttccccgatgttcctgtagcttctctatggctgggtggccaggcatggccgaagaggctctgggtagatataggctctgtgcccggtgtgtgtaactggccttgagtgaggctgcagttgtgtgttatttctattaggtcactgtggaatttctagcgacaactaatctttcaaagtgtgtttattggtcacaggattattgggccagcctctgccttcattctttttcacctaatctgcataatagctgtgttatccccattttagagaagaagaaacaggggctcagagaagtctagtaacctgtgtgaggccacacagcaaacacctcatgaccctgccctcctaaggcagcccatggctattgctggagggatagaggccggccccgtggtttgatgggacagcttgaccttaaacagcccatgggaaggcgggtgcatctggtttaggaacaggctgctagaaaggtatccaggatgtggtagtctcaccggaaggagccagtcagaatagcacagcctgtggccacgcgtgggacctgttcagcctcatggagctttgggaggcagccagcagcagggcatgggctgtgtgcaggcgaggcgctggcctggacgccgcccccactgcgtaacttcgtgtttggaatgcgtgggcacataccgtgcggctgcttctggccgggggatattcttttccaattttgagccaaggtggagactgtctcctcgtgccatccctggcatgtcctggcaagacgtgaacgatctcaatagacgagctttgcagagtgtgtctgacctgactcctgctgtcttgggagtttagctcttcagccagcagcatgctgtttgacatgtgtttcaagccccccaagaaagggtgcttgaaatttaaaattgaactgatgtggcttttcaaaatggaattggaaatgaaaggatattaaattgcagacacccacacaaaagactggtttccactgactaaactgcttttttttgctgatagtagttgaaagtagggagagtaacagcatctcttccagctttttctcttttgttcccttgttttgatgatgggttatttcgggggaagctctggctggccttgctttgtgtcatcttagggataacaaagaggatgaaagagatcaggaaaaccgagaaggcagaacagaaccagcagaaactgtgcttgaggaatgaaaatcacctacacggctccttgtcatatgagactgtggcccagcctcctgcaaagccatttaagagtaacccagtgaagctggtgagactgcctgccgcgtccgtgggcccagtgactaactcggtggcttatcatctgggcccagctcctcccctggcatcctgatttcacttggaggggcccccgttgtccttcataaacatgtttatttcattttatttttatgttttgagacagagttttactgttgcccaggctggagtgcagtggcgccatctccgctcactgcaacctccacctccaggactcaagtgattctcctgcctcagcctcctgagtggctgggactacaggcgtgcaccaccatgcctggctactttttgtatttttagtagagaccgggttttgccatgttggccaggctggtctcaaactcctgacctcaggtgatccacctgcctcagcctcccaaagtgctgggattacaggtgtgagccattgcgcgtggctgtaaacgtgatattcttgagactttcagtgaaataagaattgccacggacatctgtggtcattgtccacttgccactcacctacccccttttctggcagcaacagccggcatttcacatgtccatcatcggacagcgtaggtgggaccatcagtcatggtgtcctaccctctgtggccaaggagtggacacaggacccagttagggcaagcagaggctccccttggaatcgcaaagtgaagctggatgccacccacagagactaacatggtgaagctgctgtagcccctgctgttgagcccccagcactgcctgagttcttgcactttgtgagtccagtttaatatctgcttttcctcccattcttggagctcccctcacatctccagtggcttgaagttgccagagatgtttctgggcttgtgaccaaatgactccttttctgcttctcactgctgagcagacacatgtgcgctcactttgcctgctgagtcttgggacccggaagagcttttgggagacaatcacggaccagccccctcttgcctgccctgctgtctccctccaagcaggaggtgagaaggtgtccacctgcagccccggccaggcatccctttctgtgcttctgcccaaatctgaaattcccctctccttgggacccacgactggggccagcctgcctggggagggaatcccagctgcagaaagtcgggacagtgtgcgtgtaaacatgttaatagaaagcagctttgagggcagactagttcagcttcagttacaaactctttccaaatgcgtttaacatgagccactggctgtgcgcagcatatgtcaagctttcatccaatggtggcattttgtccctgcggggtttttttttcctgagcagtttggggcaggggtggggacagggagagagaaaagtaaaaagagagcagtttggtttcttcaggctggagtacaaggcagaggtaatgggatgtattgaagaaggtaggagggaaagttactttagctacagctatttgtccagctgtgctgattaagaaacttggagaaaagcatctttggaatcatgtccttcccatcttatatacagcctttgcagatttcctgctgttctgagagagatctgaactccttaccaggaccttgagggccccacctgattgggcacccctcactctctctgcccctcctccccttcccctcctcccctcctttctccacccccacctgctctgctcagacaccccttccttggttgcttcccacaggccagggctgtcccctggggccttggctgttcccctcccaggagcgcccctctccagctcctcatgcagccaaccttcctgtccttcaggcctctgattaaattctgccttagacatctctccccaccccgctgtgtgaggtagcgccccatgccccagtcccctcaactccactgcctcactttggggacacatcaccccagggacaactgcattccactcttggtttttccctcctcgtctatttatcacaatttagagtcgcctcactcatttgtcaaatgaagttcatctctgcagctggactgcggggttgggggcacatccggctgtcggtcctcaggtaggaggtgcttggcaaccttgttcagagtaggacgttcacagctgtctgccccggaggaagcaagggcacccgccacatggatggaattgaggggaaggcacccggggctcctgcatcgagcttccctcctatattcaatgaggaaatgaccctgcagaaggctggctgcagatgcccctgcctcccggctttgcctgcttggagtttgatggacacgtggtcctgtcagggctacagcaggtctatggtctttggtaacggaaagcgctggtgaaacagtgagctttcccgtgggtgcttttccctgacgccaacaaccaggtaaatatttggaaacggccttgttgaggcttgtgaggtggttttcctccctcccctgtaggcctgcgccacccccccaaccccacgaccacctttgggccagatggcacccacagacctgtttgaagtggccacagagggagccctctgggcgctggggccgctgtgtttgcagagggtcctcttactgctgagctggctggtgcagtgagaaggaaggccgacacccctgatcctcatcaagttcagacgggggtcactgcgggttaggggcctggggccttttacatgtcccgggagctgctgagcaggccactcttctccaggccaccagaacttggccctgcgcatggtgaatcttccctgagtcagctgagtgagggggttcaggcagccccccgggacatggcagtggcggggagtggactggggtggtgcttgccatgactcacgccggttctcctcaggcaaccggatggtcagatgcgctgactcagtggcctgagctcgtccaaaagcgaatcagagaacacagggcctgggctcacccgctgccctcttctggagtcatctgtcactcatcctcatgaaggaagcgcctgggagcctggaatgcacatcgcactgccccagctcccctcttgtttctgtgtttttccattttggattctttcccccaacgccttctgtactgggcattttgtggtctcttctttttctccgagaactctgagggctaccattgcatttgctaatgatgccacagacggtgttgacgttatgaggcttctattactgtattgatttttaccatttttagggggacgggaatcaatatttcatgagggaatgtgaagccagacagtgaagtagaagctggcttttattttgtgccaggctttgtccagaggcgggtggggacgtggctcctaagctcttgattgcagctccttctggcttgggaaacgtttcagttccccaaactctcagaactggatcccctgtgtgttctctggcccggattcaagaacttagttgattgtcaaggaaattctttggctatatttttctcttaatatggtaatgccttttttcactctggcactctcttttcagggaattggattaagactattatttatgggtctgacaaagcagttcccaagttgttgggactggatttgtttaggaatgtctcctgtcctcttcattgaggggggaatacaaattgcttccatttgacagtttatcaagtgtgtgacagagtatcagagtccagggttggccaactacagccagtagtccaaagctggccctctgttgttgtaaataaagttttattgggacatggtcatgctcacttatttaggtagagtgtatggctgcattcagtctacaccagcagagttaaatagttgtgatgaagaccacgtggcccgtgaagccaaaaatatttgcttcctggccctttacaggaaaaaaattcccagccccagtggcaggcaattaacaccttgtcctcgaggagctgaaagtggctggaggcaggaatgcttataagaaccaagcgaggtgaagcactaggtggccgcggcgagcaggaagagaagctgattttgtttgccctttcgtttgccagagattgtgggttttttttttttttttttttgcagagatgaagctttgatcttgtcacaatagcagagggaggccttatttttgtctatttctctgtgacattggtagaaaggactttgtcagaattccaagctatttggcaattatccaattttgagatcctaatggatctttcgaggtctagtttgttcattcttttagtgattccttgttaattccctgattttataaatgtgtgttgaacatctgtcttggccaaatacttcttaggtgctgaggatgcagcaatagtgggcaaagccatggggcttaagatctagtgtgggaaatgggtgatgtaaagtaaatatggcgataagtacagtgcacgaagcaaacaagtgaaggggtagaaggtatcaggctgcaaagacagcagatagtgtaggcagggaatcttatctgagggggtgacatctaagctgagatggaaaggacagtgagagccagccaaggaaacaagttgggtgacaagagttgcaggtggagttgcttaatttcccacttctgctcagcctgcagatcctggatcttggactaattgcaaactgtcatttcctcgtgagtttattagaaccctccagaacaagtttctggttagctagtttctctgtgtgttgtctcatttcttgttggttctggttctttggggttcctactcatactctggaaagctccagtgtcttaagtagtcagtctcccaagagtctgaaagcacaaagattcacaatgatacgatcacctctcaatcatagcagcattgatgcagttccgtagctggtttcctaaagccatccagatctctttctgtggcaagagagaaataagaccttctggtgaattgaggactaattatcctaataaacatgcgaattaacagttcctttggttaaacaaagcaccagaatctgataatgggaacatgtgactcatggtatttccttctttgctttatctaccaggcagctcacagaaaccactggccttccctgtgttcccattttatgtcataaatatatatttaattaacttattataaaaggccctttgttcattgaccatatcaaattattcttatatagaagaggttatacatgttttaaacattttaaaataaatctgaaaagaatgctacatcctgggcaacttccctgcatttggggctcaaagaagctctatgtggttatgggtaatgaggagccagagtgccttcagggcagttcagcagatgctgaaaggctgctgtgtgctgttcgctgggcccaccaaatagagtaggactgagcccctgtccaccatgacagccgggagatacaagctgttccctttgcctccctgagccctgagctttatagcctatagacagctgaaaagcaggctgcatccgttacccagtcagttacccagacccaaatgccaggccttggctaaccccagttattacctaattttaatatcccaatggatgttttaagacctggctggttcattctttcatttatttacttattcattgattttgtaaatatttctggagcatctgccatggccacatgctgttgtagcagcatcagccactctgaagttggtggatgaaaggggatgcatcaaaggcgctgatgtatggaggagacgcaagttagacttgaccaagacaatattattcctcctctggatgccccgaatatatacagtcattagctgtcgggcccccatgtggcactgttgacattttgtggtttaaacactgaagagtaagggaatattggaaatggcaaacatctgatatagtgtaaaggagactaaatattttgatggtgttcataaacaccgaggaggaaagtcttttcatttttttcatttgtgtgctctctctttctctgtttttgcacactgtcctctgttctccttctccttctctttttccttttttctcccttcatctccccatttatctgatctctcccacctgaaccccttctaccctgctgccctcctgtccatcctaccttctctactcccctccctagacagtagtaatcacatgtcagttggagaaacatgatggcaacttggtcacaccgttcttctcagtctgtatatgtcggtgatctcagtgcccatctggcagatccttcctgccctggctcttctgctcactgcgaccacccttgactttgtgatcactgataaccttcaccttctctaatctaaatcccaagcttctcactcttggtccaccacctcccagccttgtccgttctgaaccctgaacggaagctgaatggaaccctgaacggaagggttctgaagctgttcagaaccctgaatggaagctgaaatatcaatgggtcattgcttttcacagtcctctgtgaaagattactggccaagccagcatctggagaattcctggtccaccacctccctgtctggagaagctggaacagccagctgcatgagcatgtgacccgtgtactcacaggccctgtgccctgagctcgctgttttaattttatctttgaatttgtatttttgtgaataagtccctatgagctaatggagcatgctcagggaacttggggctttagcttaggctggattcctcctgctgcctccccagtccctggtcccctgagaactccagccccatctgaccttcccttccctgtctctatgcaggggtcattgctaccctctatccctggaaaggatgtaggcacagggcagttctaggttccagcttgggcaccgcttaacatcttggtggtgcagggatcaggctgatgataccgtggttgttctgtgggctactgggcagggtcaagccactcccaccctgatccaggtacctaatgcacccgacacagaagcggcagtgtccttggggtcatccattatccatgtgttggaggagtgggaccctagggaagatgcttggctcgacttccccacccctagccagggcacaatctgaggtccaggggctggtgggcacaatgccaagtcgtgaggcctccagtgtctgcgctcactgtcccataaataaccacagtaataactagcaaatcaaaaacattgtgataggtcgagagagacagcatgtggaagaaaggaaaaagctttctattttagtacctttaacagtgctttctgtatgctttatgaacaaggagcctgcatttttattttgcactgggctctgctaattttgtagctggtcctgccccctagtagctcaagtcagcaaatctttggttcatctgagtccacagtccactgacccgccctttttcacagttcctcccctgcccatgtgctcacttccctccttacccagcttggcgcactccctcaagcaagtctttggatgctgacatcccccgtaaacaacccttctgcggcctggtttgattttccttaggagacatgcaagttctatagcactgtttcttgctgggtatggaggatgtgctattttgtccattgcatattttttaaagaaaatgaaaggttagcataactgtttccagaaggcacattgaatcactcagttgagtcccagccagttgctgcaatgttagcctttgaagcaaacttgaaccaacacaggaccagcctagaagtcccagcctccagaaatgatgcagtggattctgcagattcagcaacaacaatatttttgtaactcaagagcacttagtaattttcaaaggagagaaagaagtaattgacttggcttattaggttgaaaaagagttgccaactttttctttggttttgatgttattggtttttttttatttttcttttctccaagcttcagggaatgagattgaatgagcactcaagtgctactaggcagaaccctgaatggaaggaagctgaaataccgatgggtcattgcttttcacagtcctctatgaaagattactggccaagccagcatctggagaattctaggaatgccccctcctcttgcagcagtataagtttgcggggatcatctgaccccattggggagttgtatgaaaaaggggatttattagggaccctgttgcctgtttggatcttacttacatttaactattgtctgctaatggattttttggaaagcaaccaggttttccgtaaagaatagctaattgtcagagctgagatgaccattggagatcactgggctcaactccctaattttagaggtgctaaaaccgcaatccagagaagctaatcaagtggttcaaggttgtagactgagttcatataggaccaagacccagcccagatgtcctactgtctgggacagtgttctctcagcatacgtggagcctgagggggtaatgtgtgtgcgtgtgtgtgcatgtatgcatatacacataggtgttttgcctaagttttcacttctgccccaccttggttgatcttggagaatgagcctgaggcgcgctgtcaacctgggggcctcattcagcacaggcccaacttttctgccctgggggagttccagcagttatggttcatctgtggttcagttatggaactcacaccacacatagtgcccccaaaaccgaggctgcgtgcacagacctcccctcccttcccgtggtgggcccctgcttgggttcttcctaaacttcccctttgccctgctctgtgttataccctctctggtcccctgtccctgtggagtgatccggggcacaagggcagctgtttccccgctgacctctgtgtgccctgaacatctgggaggtggggagcaggctggtgagaagaacacctggagtggaggttggggtcagggagggtcccagtcccggtaccacccccacctgctgtgggacctgcagtcccctcatcagcagaacggctatgaagccatcctgcccatccacagggtggtgggtcgtgaaggctgcatacctggcagagcgggagaagctctgggaagatgctggacacgcgccgtgggagtgatttccctgccttgcccagattctgctcccatcacctgaacctgcctgtcaccaccatggaactgctgtgaccattgctttccttttaagcagattagcagacatctcctgctccaccccgccaaacaaacaaacaaacaagcaaacaaacaaacaaaaatgtgcatgagggagtatggacttgtagagtcttttctaaacattgttaggtgcttgtattgggatcctctcttaaaatgaaccatattccccaggctttggatgacactcatggttgcccaccctccaacttccttccctgctggcagagccctgggtttgttttagttccaaccctgaccccaccgcattcctgactcaggcaaattcgcagggtccaatgcagtcaggggagccacgttccctcctccaacgagtgctgaggtcgctgcttgattggatactgccgatgacctacgaggaggagggtgccagggcgcttttgggactttgcttttctggagagatgcttccacagcatggtcatggacacagtcacgtcttgatgtgatgtctggaatggtggtggccgtcttgtggctgtgagaataggctgaggttgattggatggagggaaggaaggagccttgttcttgatgctgtctgtgagccttcgagttatcagcctggtaccacccagcccttggacagatatctactctacatactccatttggagttttttttttttttttttttttttttgtcacttgcagttgaaaacaccctaattgatacacacaaactatttttagtgctggtctgtgtttggcccttatggaagactctgggctgagctgcccatggtgagggaggtggactttgtgttttcttactgctctgtgtcctggtggcttgtttgtgtctctgcccatgagacaaaagccgagagggcaagggcagattttcttaatcatatgttccctgcaccaagctcataggagacactcactgaatggttgttgagagagttctctttcacggaggcaatgttttgtgaaacgatgctgcttgttgttgtctgttggttgtaatatgcatgaacactaagagccatctttaatcatgctgtgggccgcctcttccaaggtgttagcattactcccactacctggtcagcatcctgcctatggctaggactttgcaatttacatagatatggtggggagacctggagcccatggccaggactctgacaccctcactggatctgtttctacatctacctggatggccgtctaggacattagaggatttgtgtcttcctaaagtccctctgttgagagacttctggctctgttaagaggacactatttagcattgtgagtccctgcaggctgggggccagtgggcgtttttcttctagatgccccctctcttcttctggcctcccaggcttcctgctcctgagattgtgagaactggcctgtgctgggctcactgcagaaagactgtcgtccccaaaggttttgcaccaaacttgagctacaagatcttttagggggacctgagatctccgcctgggctctatgagagcaggcatgggttgtttttgccccgtcactgcagtcatgcccacacttgcattttcttttccccccagcagtgtgagggtctggcatgaggagtgggactcgcgtgccctctttcttctcctcttccctctggccttttcatccgtcagtgggggacagatgtttgccctgtttacttctaggcttactgtggggctccagggagatggtgaagtggccaaggagaggagctgccaccttcaagacggcctgtggccggtgccgctttaaagggagactcagaggtgctttgctgtgggtggcgcgggaaccagcctggggacagcagtgcagaggccttggactcagagtgcgtgggccccgcggggcttcacggcgcctgtggctgtgcacttccagccatatctgtgctgcatctcttccacattcccccatggagctgatgtctagacagctatggaattaaatgctcaattaccgagtaggaatttggccagcagaggtatagctgctgagtagacagactcgaggtgaggctcacggctgagaacaggccccatctggctttggaatgagctgaggtgcccgatgctcctgcagccagtggctcctgtggggagctggggccgtgacccccaaaaggcagcttgacctcatggaccaccataaatctggcctggtcaacatctctgccagacatcattcccttgcaaagatttctgcctgtgattggaattctggatgaacatgtactgggcgtgtgggtctgacagctgggaagcttgttctcttgtttagccaggctgcccatcatctgtaagcctcagtatccacatctttaaaatggggggaaaatatagctcaactcctaatggtgccatgagaatactttgtcacctgccaggcaaaagcttattcctttcacagaaatccagggtttacaatgtgagacccctccccactccgccgcatgtgtctgcttgcttttttctgtcttagggttgcccttcatgagctaggaaatgtctgagtggatgaaaacctaaacgagatgatcactggtggtgcccattggtgcagcctttgcctaaatggctacttacgtagccacatttcctcgtctgtgttcaggtgaggactggttcctgggcagactgcctgggtttgcatcacgggtgtccatcttgtcgaagctcatgtggtcacccaagtgtgactgagccaggcttgcccacggggtgctctgggccccattttcggcagcaggcagcgtcccctggaggcctggccctccccgggagcatggggagtagcgcctatgggcaagcagcctgcagcctccatccctgcccgggggctcccccgccccagcctcacagcttctccaaaagtgtttgtctccttgccgcatcctctaggcctgagctcagacggtggaaaagaagagctggaaggagagttgcctttcagtctctctgccttctgaggtctcctgagacatagagcctgggcctgcctccctttctaggaggcgccgaggggtggtaagaataggggatgagtgagatgtgaattaggatccccacagcaagccctgcctcgtaactttctgatgggttttcaatgtgtggtgaagcagacgcctgctgggcccccttcctgagttgagtttgacctcctgcctcctgtctgtctccttgggcagccaggccaccccgctccattaacctgtgccaccccatccctttacctgtcgcaagcccagccctgaaggcctcaaaggcctggtcttccagccagtccagggcctgaagggatggcagtgtccctggtggacctcccctggtgtggcctagtgcacatcccagccctgcctcctgccccgcctgcacgccatgagtgctgaagtcatgcctggcaggggctgctggcccaggcccagagtaaacacactgcgctgagctcgctggtgtgctgctggatgctgatgagcttgaggagtgtgggaagtgagcatggggctgagtagagatgctgcaggcctgcacctccccgcagctgccctgcatgctccagcctcaggcagccacacagggaaagggtcacccactgtcagggcagacctttaccatggctgggtgacacgggctggctgtggaaaggtgtttggtggttcccgctgttggatttgcacaggcccagatgctcacagcaaaaccaacacctagatggtgcttacaggagccagcgggtattcaaagagctgttcagatcttaagttgcttcattctcacagtggaccattgaggtagctgtacgttagtcccattttccagatgagaaaactgaggacctgagtggtcataagctcaggccctcatctaaatcacgcagcctggccccaggtgtgtgctcttgaccatggacagtgctctcctggtcctcttggtatctgtgatctgagggaccttcctcttcctcagtctcgtatagtcagttttaggtcttggactctgtcttcatatccctttctcccttcgtgagctttctcacccagcaccttccttatttggtgtgtgttgggggatatttgtggtgtggcgtggcactgtgtagtggatgagagagtctgtttttccgatcccagtcccaggtttcaaaccctgctctgtctcgagtcacccagaatcttggaccctcagtttcctcatctgttaaatgggcatggtggtcaccccacctcatcagctagtgtctgctccatccctggtggaggagatgactcaagtaacccctgggttccacctgccccaccccactggtcccctggctctttctttgttgagatagacaaatgtgaggctctggagttgcagttcccacgagggctggggtggctgtctgatttctgggcctggtccatgttgttcagggcagctgctcgttctaagtgaataaaggctgaaggaactcgggaggtctgcttggctccgaggaaggcagagagggaaagggccccgatgccttccctgatagagctagggaggcccttctgtggttccccccagctccttggcctgggtgaccctggagctggcttctgttccattttgttgtgcagagttgtttgagactcctggctttgcctggcctttgtgggacgctggagatcagggcttctggagttggccaattagcctgcccagaccaggaagcacaggtggctgacagagggccgtttcaggagaggagagacagcctacctattcggtcttgctgtcttgggtcctggaggccttgctgtccccatgctccatccctgcccctgaccagtgtggccctgtactcagcataggcgtgcacctgagtcagtacagttccctgcccgcagagcaccccaaatattccaggcctcaggacggatgtgcacatgatgagtcggggcaggtttcactgcctgtagcttgggatccttccctggggcttggttctctagggccatccccagcagtctcaccccaaaccctaaattcatgttgtcttcctctgtctcttggcctcaaggtttcagagtgagtctgtgctgatagcttcaagatgtgatgagaccccgacttggcctccagttacctccccacggtttccttggtgtgtgtgtggcttcagtgttcactggctcccgcacggcttgcaatgtgtggattacgggtgggagggaaatccagtcctgcccgcagcaaagggatgttagttgtgagctcagttccccaccgggcctggtgtttccaaatagcccgtcactgtccctgcttggttttccatgatatctgtgcctttacctatttggttaaattaaaccaactcagcaacgccagccattgtggtttcagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaacgtgagcctctgtccctctgcgggtggggattggggcagagttttgccagggggagaggagtcagcataggtcttagcccctgactttgttgtagtctgcgtgaagggatggaactagaccaagccatgtggattctagtgccagcagcatggcaggggtcacatggcggggacggtgacaccggagcaggtggacagccagcctcctcccaggaggaagaagttgtattgggtgctttagggtgattgcagttggcttctgggcttcagagagaaaatctccctgtttacggcacctctaaaactttctgaaaattgttaaggtcatttttttccggcaaaatattaggttaatgggaatgaatctcagagaagaatcgtgccccccactctaggcaccgtgctcaggaaacgaccaggcagggacatagattgaaccatgttatgacacgatttgtaaccttttcatttctgtttaattgcagtatggaaactcgggaggcccgttagtaaacctggtaaggtcttttaaacctatgttaggtcatttgtttttatctatgtatacgctgttttttgtttgtttgtttgttgttgtttgtttttgaggcagggggtcttttcaaacataaggttgccaaagtgtattataaattcctttaaaatggctctgtaaatgtactgcgtgcttgcaaatgaccctacggatcttttctggaaagagtaaggcaggccggaggtgagggttggaaatgttatgccagagaacacacttgtgtctcagagttacaggtaaacaccgtgaaattcagggccaatgcaggagtaaggtgaaggtcactaaaaatgctggccagtcaccgaaagcacctcctccaaattaaatctcctgggctgctgaaggagctggctgggctcatacacattttctcttggccaggaatcctcccttaaggcctggctggaatgaggaggagttacccacccacaaagatatcacttaagtcttcccttaaatacttgagcagaaaaagtgaagccttagaacacagaccagcagagctagagggcagctctggggccatttatagagggcagctctggggccatttatagagggcagctctggggccatttataggggctgtctttagcaaggcccagtgtgatggcacctcctagatggtgccttggcatcaggtactgacatctcagcactcctgggaagtgtgcacttggcagctttctcttcccagcagaggggcagctgtgctcccagctctgtcctctgcctccccgcgcagcacttggggatggagtggagatggctttgctggtaatgaagcatgacagccctaagctctagggttgtttccccctgaagtcagcagagtcatcttaagatcattagacatgggagaagcaggaaggtgtgggcagccacctaaaggagtttgagcctttggaaacgtattccttgtgaaacaggagcaaatcatatcgtgcattttgaaactatctgtgcttaccgtgaggtgagcacccagtgccgacctggagtatgtgcgattcttccacagctgcgcgtggctcgcgctgcctgggtgtcctgatgcctctctccctgctgccacggggatcccctccttgcatctccccacttcgatctctgaaatagctcagggacttctttcaggcatattctctctgggtgtgtacctgccggtaaagcttcacgattcagtaagccgtgtccttcttgcttttcaggacggtgaagtgattggaattaacactttgaaagtgacagctggaatctcctttgcaatcccatctgataagattaaaaagttcctcacggagtcccatgaccgacaggccaaaggtaggcaaggcccacacagccctggggactccggagatggggcctgaagctcagctgccctttgggacttggggaagggaaaagcggcagcccctaggactagccaagccgtctctgatccagaagtgaacgggaatgcacattactaaatccctcgcagaaggtcacagacatttcaccatttttgtcctctgatcatggcaatgtcacttgagtcagtctaatatgtaccaggcatgatcctaggtgacttctgtacattatttcactttctttatgtatgtcacttaattcttttgccctatcagttaggaattactagtcccattttgctgatgagaaaacggttcagggagatcattctgcaaacgtttattgccccatctgctctaagtcaagcagggagcttggcagtggacagctcaactggggcctggggctcaacaggggcctttgccggtgtgacttttatgttctgttgggggatgggaaggctgacagtaaataatcaaacacataagatactattagtgctcccaagaaaacggatcagggtggccgtcaagggagcgactggaggggcagctggtggagatggtgtggccaggaaatgccttccaagctgaggtctgagtgaggaggaaccagcgggcagggatgtggggggaacactccagaaggaaagacagaggactcagcatagttgagtgagcacaaggcccctgaagtggcctgagggccggagcacagtgacagcatggagttccccggggtggaaagaggccaaggccgggcgagcaggctcacagcaggccgtggtgagggacctgggttgcatcctaacgacatttaagaacagggaagtttatgatctgattgatgtcactgaaaggacactctgatggctgcggggagtctgctggaggggttgctggaagttggggaccggttaaggggctctcccagccatctggatgagacatgctggggtctcagacaagggtggtggcagtggaggtgggacagaggggtcacattccagatatatatggggggtagagcaagcttggggaagggccagctgtcaggatgaggccatgaggaattaagggtcatgcccaggtacctgaccattaattgaaacaatgggactttcccaaggtcccccagaggggaggggtccagaccaggatttgagccgcaacctcagtgtacccttctgtggcccttcctgcaacctgggggattgggcccccggcccctggtgtccccagcacccccaccaactgggctgaccttctgctgtccctttgttgtctcaccaggaaaagccatcaccaagaagaagtatattggtatccgaatgatgtcactcacgtccaggtgggtaaacaggatgcgtgtctgtgtcttaaattttaataaacctgaacttcagaaggtgctcacgggcacccctgaaagagaaaccttatgctgccttaagacgtctcagtttctgcttataatgaagtagcatcgggaaagaggacaggtcattagccttggcccctttgtttggttttaacctgtgtttttgcattctgagctggttttcttcactggcagcaggccctccggtgtagaaggttctgccctcctctttgaaggcaggcctgaacagtgtgtgcgtggtggggctgttgattcactctggctcacgtcttccttaccccacattctgttgaaacccacattccaggagggccccaagcccctcccgcagctctaggcactctgctttcgttgctctgcagctcgtgggccgcggctccaggaatgccagggcaggtccagcgcagggaagtgaatgactgatgtgcttgttttccccgagctggtggaattgcggcctgtggttggcaggctcatggcatcctggtgttctaaactggatgaaaaattctggtgtaatctcatgagtcctggtagtagactcacctggcatggctaaaactgtcagaggtaaagtaggtaaagactagaatatagtaacagatagattaatgtgttcattactatgatgaattaatgattcactcactgtgaaagtattaatatattttgatacatgttatgaatggtggtccctttcttagcactccagaagatggagccatttgtcaaggttaaagtgtcccctcagttgtttgcctttggaactacgaggtgtagggaaagatggtaagcccttggtgcccagcttcctgggttcctgtccctgctctgatatgtcctgccttgtgaccttgggaacgatatgacccctgagtgcctcagtttcctcctcttcaggatagggatgacagcgcaggtgcttctggtgtgtggccaggctcagatcagggagtggtggcaggggtcaccagccacagtgatgccagccactatgtatcacacgtactgggccaggtgccttactgggatgatctcatctgatcctcacaactcatgttgtagggtactgttattatccccattttgcaggtgaggaaatgaaggcacagagaagttaagcaactgtcggaggtcacacagctagcaaatggccgagctagggctgcaaaccaggccaaccactgtactttactgactccttagtaatagctactattaattaagaaataataacaatgatgatggctgggtgcggtggctcacatctgtaatcccagcactttgggaggccaaggcgggcagatcacttgaggccaggagttcgagaccagcctggccaatttgtgaaaccctgtttctactaaaaatataaaaaattagccgggcttggtggcaggcacctgtaatcccagctactcgggtggctgaggcaggagaattgcttgaacccgggatatgtaggttgcagtgaactgagatcgtaccactgcactccagcctgggcgacagagcaagactctgtctcaaaaaaaaaaataaataaaaaaaataaataaataataaagcactttccttgctgttaccaagtaaatctttgactctggtagacaggcaattttaattttaaaataggatcagaattcctggaggaattttaccttagacctaaggagaagacgggaactggtgagagctgagttttgcgtgaggaaggcctggtgtttcttcacactaacacgggtgctttttctctggagcagcaaagccaaagagctgaaggaccggcaccgggacttcccagacgtgatctcaggagcgtatataattgaagtaattcctgataccccagcagaagcgtgagttagagtcattttctcttttcccaatattcttgttgttcctgtgggggtagcaggaagagggagcgctgttccttttctactggctcagatgattatgttgatccttgacagacgtggtcggacgttgcttgtcattcctgctggccaggccttccgacctggctcggctcgggactcatccataggagggtgccttctgtcttcaaaagtccttgctccacgaggaccctccagatggacagagcaatagcagactcgtaatgagtctctgagatggcccggctggccagagagagggtttcaggaacagtgtccccaagccctcacttggtggtccttttctaggcttcaggacccttctcttcctggagtcttccagaatgtctctgacaattaggcccatacctgtcaacacctccagaaaaataacccaagtgatatcaaagtaacatgacaagaagtagctcaaccatccatcagggtttgttacctgtattggcggaatatccagagaaaagtgctagaccagggaccagcaaatgtgccctgggggctggatctggcccactgcctgcttttatatggagctgtgggctaagaatagtttttgcattttatttttatttttacttattttttattttcataggtttttgggggaacaggtggtatttggttacatgagtaagttctttggtggtgatttgtgaggttttggtgcacccatcacccaagcagtgtacactgaacccaatttgtagtcttttatccctcatccctgtcccagcctttccccttgagtccccagagtccattgtatcattcttatgcctttgtgtcctcgtagcttagttcccacttatgagaacatttaaatggttgaaaaaatcctgaaataagaatagtattttgtgacatgttaaatttgtatgaaattcaaatttcagtgtccactgtaatttggtttatgacatctatggtggcttttgtgctggaacagcagagttgagtagcttcaacagagaccatatgtactgcaaagcctaaaatatttcctatggagccctttacagaaaaagtttgcagacccttgtgctagcccatgaaggaccatgacagcgttttgacgctgagctatataagagctacagttatagtggcaaccacacaaaggaagtgcctcttaacagaaacattccgcccacccctataggaactgcattctgagttgcaatacccattataagcaagttggccagatagtggccaactatctggcagatatctggccaactacgtggcagatagtacctggtacatccttccccactttggggtcaatcttgacctttgatctccttggggtcataaagccacacaagtgttagtaggcatttctacagtggacacaatggatgatttagcctaaaaatctcaaaaggagcccagcatcctggcacatgcatgtaatcccagctactcaggaggctgaagcagaaggatcccttgagcccaggagttcgagactagcttgggcaacaattgagaccccatctcaaaaaaaaaaaaaaaaaaaaaaagagtggggaaaaaagaacattattaaaaaaaaaaaccttaaaaagtaatccaatctaccgatggtttattttttattttattttattttttttgagatggaatcccactctgtcacccaggctggagtgcagtggcacaatcttggctcactgcaacctccacctcctgggttcaagtgaatctcttgcctcagcctctgagtagctgggattacaggtgcccaccaccaaacctggctcttttttttttttttttgtaattttagtagagacggggcttcaccatgttggccaggctggtcttgaactcctgacctcaggtgatccacctgcctcagcctcccaaagtgctgggattacaggcatgagccaccgtgcctgacccactgatggtttgaattattctaagttcgccaccgtccaatcctgtttgctctgggcttttaggttctaagctgtgcctctgtccatgtaaagtcagaccaggaggaatggaaacacgaaacattgccattgtgtttccctttgtgttgcagtggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgctttctgtagtgcttattttcctttcccaagagcagctcgttgcagtctttttggaatgattctaatgtcagtgggcccctcattagactgcattgtccacgcaggtttgagctcttagtcttatgagttatttcaaaatcatcccatgggatttaccagggttatgaacaactctgcttggacaccctggctttatgaagcaggacttgaggacagttgcactcgcatccggagcttgtcaaatgaaagagagtctgttgacctcatacagcatgcaattagtcaacaaagattttctgggtctctgctctgtgccaggcattgtaagtgcgtggtcagtgagagcaggaaagacgcaggctctccctctgtagagcttcagttcagaagccaagtctctttctgaaagggagacagctcaggagaccaggatgcaaccccagaatgggcccagaatgcacacggctgcagctgacctcatttgtcctgggttgtgaaataagaactaggccttaagccttggtgagtttagaggaggactccccttgaagtgccctcaaacaggtacagctagaagcagctgtaggcacctttatctccatgaaagctttccgaaagtttgggaagctgacccaagaggacttgcacagctttagcttggaagtttgcacagacctatgtccctgtggggagcacacaccagagagtatgctgtttacgccaagagcagcgggtcaaagctttccaactgtcagcagttaaaaggagggccttggaccggatggaggttctgttctcccaattgagagctgaatccttcctccatccacagaggcataaggtccaactcataactggggaggctgcggaaggccgaagggccaacttaaatgcaggggcggtccagttgagcacagccctcatcagtgttggtgctcggcggctgagcagcttgtggcccgttgcaacactggcacgtctcttcgctctctggttgaatgacctagtagagtcaggaaggaaccagcgagtcctttggctgtgggagtgtgttttgcattccctcccttctccattaaaggtgatgactcagaatggcttgtggcttcaggggttcattctcagatgttttgtatgtgggcctgctttcctgtgtggtccccggagctgaggtgctgccacaggtggggaggatgccgtgggtggcattgaggtcagacccagccccggcccgagcctgtctgtcttcagcctgttaggcatccgggagatcactgatggttcttctggaagaaactagcctggtgatggaccagcctgaggcctctgtaaacactctgcaacatctctgcaggacactggatggggttggagttttgcctgcatatatggtcacatacaggacagaaatggcagcttgccacattgttgcatatgacatgtttggttacatggttgcacttacccatgagaccctgtgtcccatgggggctgcttgtcctggaacccccacctcacatttgaagacctccagaatagttgtttcttctgcttgctttaggctgtgatgcagggttttgcaacataaattagtcttaaagcctggaggcagagcactgagtcgaaagagcatggcttttggagttatagatggatttgggtttaaatccagtgtctatatatcttactggctgtgtgaccttgagcaagtcccttaacctctctgtctgtttttcatctgtagaatgccctcagttgggtccatctctgcttccatggagctcagtttctaattcttcttggccacttctggtccctccaaggtcactttaacagccctctggctggtgggcccgcacctgccccctgttctggctcctggagaacttcctgcttaccaaatgtgggctcagcagtgcctcttccaatcccagcaccctcagctctagtcctctgcttccagcttctgcaaaactgtgagccaaccacatggctg

SEQ ID NO: 12142 - DNA, 11093 bp, Human
ggaaccggcagatgccctgaccacgtggtcaaggttattaccatcagcacgagacaggccgaagccatgggcttcgacgtggggggcctgagacagacacacgccacgcccgggactccctccattgagtcctgaggccacccaggaccatccccacggagggacgctctgcagagtgaccaccagctctcctcaatggtcccaagggctgagggagggcagagggactgcgcccgctggaggagaccctgacatctgaagatgggtggcttgtgtacccaggacccagcaaagggtggctggtgatactcagggggctggggcagagggggccatttggaatcaactttcgcgccctggcttcgatcacagcctggagggttgagcaagaggacagaatttagggaagctgggggagggaggccgggggagggagtttggggagcggggagggagtttggaccctttggacttctgtaagcgtgaaatcctttccaaatgaaacgttaaaaagctttttttctttttggcctccaagttcattcagtgcttctctccatttcactgtaggtttaaaccgttcagttataaataaataattttatcctctgtcctcggctttcccccgtttccggcactgcagacatgggggctggatttgtctctgcggcggggccatcctgggcactgcagggccctgccaggagctccctccaagtcgtgacaaccacggatgtctccaggcctcacacagggacccctgggggcagaatcaccccagggttagaggattccacagaccccaagagactctgagtcccatgatcctctgccctgctgaggtcccaggaggctgcacacattgaaatccacaccctgagtgggagggagagaggaggcgagtcccgggagctggggtcccccgggtttatgccgtacgccccatcgggagtttattctggtgtccggtgtgagcagggggcagactggattttttattttttatttttatttatttatgttttgagatggagtcttgctctgttgcccaggctggagtgcagtggcacgatcttggctccctgcaaccttcgcctcccaggctcaagtgattctcctgcctcagcctcccgagtagctgggactacaggcgcccgccaacacgcgcggctaatttttgtatttttagtagagatggggtttcactatgttggccaggctggtcttgaactcctgacctcaggcgatccacccgcctcggcctcccaaagtgctgggattacaggtgtgaggcaccgcacctggccatttttttccccaaataatgaacactggtctctcccctgggccctgtggacatcggggctggatccttctctggggcaggcccgtcctgggcactgcagggtgctaggcatcatccttggcctccacccactccatgccaggagctcccctttcgtgacagccacaggtgtcctcagacctcgcccagggtcccctgggggcagaatcacctcttgattgagaatcctggccttaaagggggaagaaaacccccagacaaaactggcaggaggatgttcgctggggcctcaggtgaggcactgagggcactcgtggtggggccctgccttcccgagctctgcatcctgtcccctgctacgtcctgctgtctgtccgtttccagctcacccacccacgggacacacctgccacggccggctttgctggggccacagggacctcgtcagggaggcgtctccttgtgggtggcacgtgggcatgtgttgctctgagggctgtggccatgttgcccacctggccagggacccccgacttgggtgggtgacagccagcctccccgcccccacaaaggttgggaccttgagcccaaagcccccacctcctccccggagtccgttctgactcccaggctcccaaggcaaaaggaggaagtggggacccagcctgggcattgggcaactcaacggcctctggcattgggctataagaggagcttgaccgtgggtgcaccctggaccccaccatggctcaccggccccccagccctgccctggcgtccgtgctgctggccttgctgctgagcggtgagtgagccacgtgcccatccatccagcctccaggccccggtggattgtggggaaatatccaccacgaggtccatccaaagcccttctggcacagctggggaaactgaggcagggtcaggggagactccactcactgctcgggaccaacgcttgcaggggtggggaggacaagggcaagggggagccctggccatttgactcagttgcctatctgtaaaacgggcaaaacccagcccttccctcctgaggagctgttttgggaattagctagtaacaggcgaattcctggacagcacccagccttcagcaaatgctcagtgaatatgcatgaatgaatgaatgagtgaatgaatgagtgagtgagtgaatgagtgaacaaatgaatgagtgaatgaatcaatgagtgagtgaatgaatgagtgaatgagtgaatgagtgaacgaatgaatgagtgaatgaatcaatgagtgagtgaatgaatgagtgaatgagtgaatgaatgagtgaatgagtgaatgagtgaacgaatgaatgagtgaatgaatgaatgagtgagtgagtgaaagggtcgaggagttagtgatgctggaatcaggggaagaagagagcatgggccccctcaggtccctatcctgagggtgattttctttttctttttcttttttttttttttgagacggagtctcgccctgtcgcccaggctggagtgcagtggcgcgatctcggctcactgcaagctcagcctcccgggttcacgcctttctcctgcctcagcctcccgagtagctgggactacaggcgcccaccaccatgcctggataattttttgtaatttttgtagagacggggtttcaaggtgttagccaggatggtctcgatctcctgacttcgtgatccgcctgcctcagcctcccaaagtgctgggattacaggcgtgagccaccgcgcctggccctttttttttcttttttgaaacggaatcttgctctgtcgcccaggctggagtgcagtggtgcaatctcagtttactgcagcctcagcctcctggggtcaaatgattctcctgcctccgcctcttgagtagctgggattacaagcacacaccaccacacctggctagtttttgtatttttagtagagatggggtttcaccacgttggtcaggctggtctcgaactcctgacctgagggggattttcaatgcctcagtttgttcatctgcaaaatgggtctctttgttggctgatttttttttttttttttgcttctttttttttattttgttttgttttgtttttttgagatggggtctcactcaggcatgagccactgcgcccaggattttttttttttttttttttttttgagacagaatctcactctgttgcccaggctggagtgcagtggtgtgatctcggctcactgcaacctgtgcctcctgggttcaagcgattctcctgcctcagcctcccaggcagctgagattacaggtgcgaaccaccacacctggctaattttttttttttttttttttgagacggagtgtcattctgttgccaggctggagtgcagtggggcgatcttggctcaccacaacctccgcttcctgggttcaagcgattctcctgcgtcaacctccggagtagctgggactacaggcacgtgccaccacgcccagctaatgtttgtatttttagtagagacagggtttcaccatgttggccaggatggtctccatctcttgacctcaggtgatccacccacctcggcctcccaaagtattgggattacaggcgtgggccaaccgcacccgaccaatttttctgcttctttaaaaacatttttttaaattttgttttagagacagggtcttgctctgttgcccaggctggagtgcagtggtgtgatctcagttcactgcagccttgacctcctgggctcaagcgatcctccctcctcagcctcccaagtagctgggacgacaggtgcacaccaccatgcctggctaattttaaaattttttgtagagatggggtcctcacaattttgcccaggctggtcttgaactcctgagctcaagggagcctcctgcctcggcctcccaaagtgttgggattacaggcgtgagccactgcacccagccacctggtctgcgtcttaaaagccttcctgactctcaggactgaaagctgccaccagggcgcctttggaaatcgtcgtaattataacccccccggcctgggcgctgagtccttcccaccagccagcaggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacatgtgagcggccgcctccacacccctgtccgcccgccccgccctcttcctccagccctggcccggccactgtccctctgcccggggaggacccagctaagccccgtctgcagaccccaggccccgcgcgcgtgggcagttctggggggaggcccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacattctcctcatccaggtgggcgggcagggccgcgagggctcggaggggcacggccagcgggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggctgggcactgtggctcacgcctgtactcccagtactttgggaggctgggatgggaggatcacttgaggccaggagtttgggagcagcctgaccaacctagtgagaccccatctctataaaagacattttttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatgggaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggaggcgcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggtgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctatgaaagacctcagcccctccctgctcacactttttgtttgtttttgagacggagtgtcgctctgttgtccaggctggagtgcagtggtgagatctcagctcactgcaacctccgcctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctggctcctgtctgtccttcccatatagggaggggagggggaactgcccaccgtgacctcaataaacgttgaaactccccctggctcctgtctgtccttcccatatagggagggaaccagggagaggtcccctgggttcaagtccccgagccccaaactcaggatggggggagtcggagcgggggatgggggcccaggttgcagggggtctctctcctggatgctcgtggctgtgggttctaacccggccccatcagggtggccctgggcaggttgttattcatctccgtgcctcagtttcctcatctggaaaatggactcgccccagacgtttcctagaactgtccctgctggctcagggactccttgaggaaggggatggggatggggaagcagcctggggggcttcctggaggaggtggcagtgccagagctgcatatcaaggtgtgaacagaaacatccgaagggctgccaggcagggggcacagtccaggcagagacctgagggctagaggccaggggacggggaggagggcaggcaggggagggatgtgggtgcaggggaggggtaatggggttggagcgctatttctcgtaggaggggtaggcagggcaggagttccctggtagaagcatgagcaatgaactgggtgggggggtggccagaggggaggtccgaggcggggaagaggtgggactcacagtccagctcaaagacgggcaagtggccactagaaggaggcattagccacagagaggggacgacctgctccaggacacgtgtagagaagaaatgaagctcattgctggtgttttttttttctttttaatatttttttgagacagagtctcgctctgtcacccaggctggagtgcagtggtgtgatctcggctcactgcaagctccgccacccgggttgaagcgattctcctgcctcagcctccggagtagctgggactacaggcacagaccaccacgcccagttaatttttatatttttagtacagacagggtttcaccacgttgtccaggctggtctcgaactcctgacctcaggtggtccacccgcctcagcttcccaaagtgctgggtttacaggcgtgagcctacttacttatttacagctggcctacttatttatttttgagacagggtctcactctgtcgcccagtctgtagtgcagtggtgcaatcttggcttaccgcagcctcaacctcctgggctcaagtgatcctcccacctcagcctcccgagtagctgggactacaggtgccaccacacccagctattttcttagtttttgtagagacggggtctggctgtgttgcccaggtgggtcctcagtgactctttacatatgaacacctccaggtcactgtaatcttagcaatctcctggcctcccagaagaccccacgtccccctcggagtctacacccgctgtgaccataacacccctaccttccctgccacagttaatggtgaaccagctctcaaagcaacactttctttttttttttttttttttttttttttttgagacggagtctcgctctgtcgcccaggctggagtgcagtggcatgatctcggctcactgcaacctccgcctcctaggttcaagcaattctcctgcctcagtctcccgagtagccgggattacaggcaggtaccaccacgccaggctaattttgtatttttggtagagacggggtttgtccatgttggtcaggctggaattcccaacctcaggtgatacacccgcctcagcctcccaaagtgttgggattacaggcctgagccaccgcgcccggccagacaacactttcttagctaagaactttatgaacgtgaatttatttcatcctcttgac

SEQ ID NO: 12143 - DNA, 38961 bp, Human
gggggatttgtcctagagccccagctcccttgcttttttttttttttttttttttgagacggagtctcactctcgcccaggctggagtgcagtggcacgatctcggctcactgcaagctccgcctcccgggttcacgccattctcctgcctcagcctcccgagtagctgggactacaggcgcccgccacatcgtgcggctaattttttgtatttttagtagagacggggtttcaccctgttagccaggatggtctcgatctcctgacctcgtgatctgcctgcctcggcctcccaaagtgctgggattacaggcgtgagccaccgcgcccggctagctcccttgcttttaaccagttgttgtgtggtctgccccacgcttctgcctggccttgggaagcccaaaggtggagcagccacgaagtctccatctggccactgaggccgacctgtgaggcgtccagttgagaccacatcttgtcccaactcactcagctgcctcacatggcccactgtggtgcatggggcacacttccccatctggctccccagaggaagtcagagctgtggtgggggctgggggcacttagggagattgcaggggagcagaactgaaggttctgaggccttagtccctggggttgttctccagagcggattgcagattggaggaagttggaggaactgtaggtttgcccttcctgggtcaggaaacctggcttcgggccaggttctatctctacctgttgtgtgaccttggataaacgtcttgccctctcctaggctcaatgtccctacaggtaaatgacctctaagtgcctgccctaaggggctaagattcccctcctttccctgccttgcggttggcaggttcttatccttctggagagggtcatcatcattctctgttcaggtcctggcaggggcagccacaggcagagggtctttgggtcttaatttctgaaggcttccatgtcacataaaacgttgattacataaatttgttatgcttttctcttaagctgtctcgttacaggagtgttggttgtgactcttatgatctcttatgatgggtgaggaatggtattacatctttaacggtaccacaatgtgaggcttaaaagttttttgtttttttttttttggtgatgggaatctctctcgctctgtggtccaggctgcagtgcagtagtgcgatcttgactcacggcaacctccacctcccgggtttaagcaattttcctgcctctgcctcctgaaatagctggaaccacaggcgagcgccaccacgcctgactaatttttgtatttttagtagagacagggtttcaccatattggccaggctggtcttgaactcctgacctcatgatccgcccgcctcggcctcccaaagtgttaggattacaggagtgagccagcatgcccagcccagacttgcctttgaccaggtgccaccacctgcccccacgtgcccctggccaggactgagccctgtaccctgttacacgactacttattctatgtgaaaccccaagctattctatgtgaaacccgctactacaatgggctaatttttttgtatttttttttttgtagagatggggtttcaccacgttgcccaggctagtcttgaaccctccgcccgcctcggcctcccaagtgttgggattacaggcgtcagccaccgcggccggccaacaatgtggagatttaaaaggtattttacatatataatctctgacctattcaattagtagggcttttcttttatgacctttcccttccctttctccaagttcttcctcactcctccccatagcccttcctttcgcccctcccattgccccctcctattggcctccccttcgcgcaggcgccctcagaggcgctgagtcagggcgctgttgagctcgggcaggcccggatggggcggggttagcgcctgcgctctggacggctttggggcagggcagatttatatctgcgggggatcagctgacgctccgcattgcagactgcggagtcagacggtgctatgtacgccctcttcctcctggccagcctcctgggcgcgggtaagccctgggaccctcatcctggggaggaggtgcctcgcagcgtccatctgccccagaatgggctgtgccgggcctggcccctctgctccccctgccctagttggcaagggggcgcgcgcactgcgcaggcgcgttcgctggctttctctggctttctctgggcggctgggggctgcggggggcgggctgcgaaaatgcccccgggaggacggcccaggccctgggcagcatctccttcggggctcgagtgggttcctgcgcggctggggccccgaggccttccctcaggctgcgcttcccactgtgggggtgggtgagtcttgtagggtgaccccttgggcagctgtgttgtgcctgtgctgggcgcacgtgatcgaggtgggctggagccccgtcccgcaggacactttggccgttggcttcagttgcctgtttgtaagggtagcgaagctgcaggaagcacatgtgtatcatctatattgacgtttgcatatgtatttactctggattctaggtgttgacaaaacgagtcaaactctgtaaaaatattttgagatttattctgaggcaaatatgagtgaccatggcccgtgacacagccctcaggaggtcctgagaacatgtgcctaaggtggttgggatacagctgggttttacatattttcgggaggcacgagacatcaatcaaatacatttaagaaatacgttggtttggttcagaagggcgaaacaactcaaagcggcggggggcttccaggccataggtaaatttaaacattttctagttgataattggttgagtttatctgaaaacctagaatcaatagaaagaaagtattcaagttaagataaaggattgtggagaccaagttttattgtgcagaggaagctctcaggtagccgactaagagagcgagcacgttgtaaaatatttctatggaaatgaaagggtgactggctcttagttgattatctcctggatctggagaggaaggaaggaaaacataggggaaaggggattctctatagaatgtggatttttcccacaagagactttgcagggcaatttcaaggtatggcaaggaaatatattttggggttagatattttgatttttttttccttgtcttataaaatgttatgccagagtcagattggaaagtaagtcacgatatatggggtcaaataaaacccatctgatgagagtttatggtttgtagggtatgattcctacaccccttagataggaatttgggcaagctaaaaaaaatcggagcttaattctcataggtattgaaggcgatatagggttttctggtccagttattttgccatggggtcctcatttcacttgctttgaaatgtcttgcatccgggtgcggtggcttatgcctgtaatcccagcacattgggacaccgaggtgggaggatcgcttgagcctaggagttggagaccagcctgggcaacatagcaagaccccacctgtgaaaaaaagaaaaagagaaaagaaagtcttgcacgctattggccgttttttttttgtttgtttgttttgtttgtttgtttgttttttgagacggagtttcgctgttgttgcccaggccggagtggtgcaatggcgtagtctcggctaactgcaacctccgccttccgggttcaagccattctcccgcctcagcctcccaaagttctgggattacaggcgtgagacaccgcacccagcccccaccacaatgtctgttttttagtaactatatgtagtttaagggctggctgccatttttaacctagctacccaaattttaataaaaagtaacaaagtggatgacagggttgatgcaaaaccgaagaaatgagttagctttcagcagctctcaagaatgtatcttgaccctatacgaagctcttaaatttgttttacttgtacacaatgaaagatgatctgcttataaaaaaatcattttgattttatactcaagcttatactgcagttattccatggtctgtataataaactaatgctggtctctaaattttttatactgattcagggcaattttttttctttctttttacattatccattgttcttgttgacgttgagtcactcctcacaagacccttaagagttctgattcattcacatcacccaaaagggactcaatcgtgtctcgggaaatataaaatccacctctggtatatatgggcttacggttaaccacaatatttagttaaccaagggaccctcttccgtgaacactcgggtaaatgggaggtattgtaatggccttggtttaactttgctgtcctacctttaggattaggccaaagtcagtgctgataacagtgtttgaatgctccctggccttcacagctctggcccctttgtgatattgtgaaaatgttactcctaaaatttctagacatgataatgagttttgttagtgaaagtgcctggtgactgcagccattgtctgctgcccgagaggcacttagaactttcttcgtgacactgtcgtagtacagaatgccaccctgaatcgggatgggctttgtattttgtgtttcagtgatgtcctggtggtagagacacttgcttttgagttacttttctgcccatccagctgcccctcctttttccccacctaaaagcgaaagcaaagccatggcaccatgagagaattggagagcatgtaatctgacccctttgtaaggaatgaagacctggaggtgcccagaggtgactctcccaaatcatagaccatttactggggatgccaggaccagaacccaagactccacagtgctcgctttttccatatccctctgtccacatggacctcttaacttttaaaaacttagtgtaagttacatacgtggacgattaagtagacaacttgatgaattaccacaaagtgagcagcccccgaggttggggagcagtgcagtagcatccagaggcccctgttcacccattcactgccctgtcccacttgccccgaaggaaacattgttaacctttgaacaccatagatgtgaaggctgcagtttcgatcttttacaaatgggatcatggagggtattgctgttaggtgagtcctctggtggaaaaaggagcgtgttcatcagctaggtgtaaggcatgagggatggtgcctgggatgtggcaggtgctccctgaagcttagatgccctgatagctgtcagctgtgtggtggctagcctgctgaatgttgtctacaccacgctaagacagttatgttttctggggatgctagaaggtgttatatatattctttcaataacatgtgaatttatagcctggcctgctgaatatcagtaggaacttcaggtcttggcctgtcagggattttggataaatctcctgtttattaatagtaaatcagttttattctgtgaaaataagagtataattcctgaagaaagaagggtttgttttaacaaatcagtgatttgtcaagtccttgaagtacatttgacaggttgttttgtttcttttttttttttttggagcagaaagtttaataggcagaagaaaggagaaaggagagcagctctctcttgtgagagagaggcatccgaaagggagaagcctgacaggttgttattgagatgggagtcttgctctgtccccaggctggtgtgcagtggcgcgatctcggctcactgccacttccgccttccgggttcaagcgattttcccacctctgcctcccgagtagctaggattataggtgcccaccaccatgcctataaaatccacctctggtatatatgggcttatggttaaccacaatatttagttgaccaaaggaccctcttccctgaacactcgggtaaatgggaggtaattttttgtattttagtagagatggggtttcaccatgttggccaggctggtcttgaactcctgacctcaagtaatccgcctgcctcggcctcccaaagtgctgggattacaggtgtgagccaccgcacccggccctgacaggttgttttgagaacaaactatgagagttgaagtgtgttggattgattggtgtggcattttgtagatgagggaaaggagaacttggtcttccattttcttggtgagtgagaccatgggatgtccaggcagctgtggggaagtggaagggtagggcggggtgttgctggctgggaacagcacctaatgaggcatgcttaggaagttctcaaggccaagaccaaagccacttagacaggtgtgcatggcagctttggaggcagcttctagcagagattctaggttactggctaccaggctgtaagccttgctttctggctcctttttggttctgccaccaggaaggagggtctggatattcttcagatcaatgaaagagagtactaattagaattacattgccctgcttgcctttttttttttttttttttttttttgagacagggtcttactctgttgcccaggctggagtgcagtggcaccatctcagctcactgcaacctccacctcccgggtttaagtgattctcatacctcagcctcccaggtagctgatagctgggattgcaggcacctgccaccatgcctggctaatttttgtatttttagtagagaaagggttttgccatgttagccaggctggtctcaaactcctgacctcaagttatctgtctgcctcggcctcccaaagtgttgggattacaggcgtgagtcgccgcacctggcttttttttttttttttttaagggctttaaaacaatgatgataaatacagtgattgggatgaagattttggctgttgcaaaagtactaattgctttattttttattacatgaagttccaaaaaaataactttgtggcatttgtaattttgtatgttgggacaagatgataatgtggagtggaagtttcacattatctcattgctgacagtagccgtacgaccttgggcaagttgcttaaactctcccgtatttcatcatttgtaaagtggcattaatcatctatttcactgggttgctgtttagctttaataaattaggttaatacagaaaagggcttagttagtattgtttgttgctgtaccactaataaaagtaatgtattgtcaatatctttgtccccaacagcacagcggcctattttctgcccttgattttgtgatttcctttggcgtctttaatttcaaaggacgttgtgactttaacaaaattaaattgacttattaaaaacatacatgctgggtataattagtgagtcaggaaaacaagccagggtaggtagacagcagttaggagggagttggcaggcagttcatagtctaggtagccaaactaggtttagctgccaggggatcttgacatcagagcagcccagcagatcagagctggttcctggtaacccgaatgcttgggtctagatctgttgtcactaatcctggacctgaggttgtctgttccagccccctagttcggtttccccattcgtaaatggaggcgagctgtttagagtagataatagatggacgtgggaagccaggtcagtcagtagaatggagtatagagtacaaggtttgtccctgccactgctgtccccaggccctccccaaacagcctggtagcagctcccttagaagcttgcagaggtacatcccatgtgtgagttccttctgccttttttctttttaacacaaatagtagtatattctactgactgttttgcttgttgctccttaaattgtgaaacatttgaaaagtggaaaagtgattatcataaacatgtgtatgcaacacccaggttaagaaatggaacctgataacccagctgcccccgtagagagccaccttcctggacttgtttttcctccccgttaggtctttttccttccatacatgtgactggaagcttcagcagtgtgtatagagtattgttttggatattttaaacattttgcaaatattgtatccaataaatagtctttctctttatccttgggggttatgttccaagaccctcaggggttgccagaagctgtgggtgggaccaaatcttatttatatatgtatgttttatcttatgcatacatacctgtgataaagtttagtttataaattaggcacagtaagggattaacaacaactagtaatacagaacaattaaaacaatatataataaaaattatgtgaatgtggtctttctcaggatacattttcagaccacatttgactgtgggaatacattttcaaaccacatttgaccgtgggtaactgcaacggtagaaaaggaagctatggttaaggagggaccactgtatattgttaggttagttttttgttttgctagggaggtttttctatgttgaaaatgtatagattactgttatgtcttttagaatttgtctagaaggctttctggtttttactggaaagccccctacaaaaatatgtaggtctatttcattttcactacaatatagtattccatttatataatttctttttttgacacagagtcttgctctgttgcccaggctggagtgcagtggtgtgatcttggctcactgcaacctccacctcctgagttcaagtgattctcctgtctcagcctcccgagtagctgggattatgggtgcacgccaccatgcctggctaacgtttgtatttttagtacacacagggtttcaccatgttggccaggctggtctcaaactcctgacctcaggtgttctgcccacctcagccccccaaagtgctgggattagaggcataagccactgagcctggcctgtatcatttctgttctagtgatagacatttagataatttctagttttttctattacagcctgcttctgtaaaaattctcgtacatgtctccttgtgtacatggaaaacatttatctagggcatatgtctaagagcagaattgctgagttgtggagtaactaacaattgtagaagtgctctcaaatgatcttggcagttgccattccataacgtattcagtttccagttactgcatgcccttgttaacatttgatattgttaaaactttcaattttgctaatttgataggagtaaaatgacttagtggtttcatttgcatttcttcttgttttcttaaacaatatatcctagaggtaatttcatgctaacacagatagatgtacttaaattttaaaatttgagataatgttagatttacagaaaagttacaaaggtagtatactgagttcctgtatacccttcccccagcttcccctactgttaacgtgttgtataaccatggtacatttgccaaaagcaagtaattaatatcaggacactgtcagtatctagattgcaaactttatttggatttttaccagtttttccactaatctcattttttggttcctgggtccaacccagtatgccacattgcccttggctgtcaggtctccttaatctcttcccacttcccagctgagtatttcattgtatggatgtgtctttttaatccctattgatggacatcgacgtctaataaactgctaggtgaattctaatgagacttgcaaatgtaaaaattgtaaattctggccacatttggacagatactgcctttaaaaaattatttacatgagtggaaacgtcatgactaagattgaagaagacgcagagaaagttcttttggccagtatttgtcacgttacttatgactctctcagtagctgtgatgggatgctgttctgtacgagtaagtctctttttcaggcattgataccagagggccatgtggcttcctatagcactaggaataaaactcaagtgtgtccgcaaggtcgcccgtcacctggtgattggccacctctcagctcctccccctctcttctgtctggcctgctgtccagccttctggccccttccttcttggtgctcagagattttccattttgaattccacctctctggaacatcttcctccctgggtaacccatggggcttcctctctgtgcattcgggtccctgcttgatgttgccttatcagagttccccactgatctgcctgaaatagctgccccaccccaccttgctttatttgtagcactcaccgctacctggcgttgtgatgtgtgtgttgtcttgatcgcttgctgtgtctgcagcatgtgcggcagttttggcacataacaggtgcttagcattgatgagtgccaggaggtgtagccaggtagacttcagctgtggaagtgtaggctagtgtgcctgaaacttcattgcttcatagtgccgagtctttgtcatgattagatagaatattatcttttatttttctgaaattaattttaagaaattgtttttaggagttatgaaattaagagtgactttgggcgcaaatgaagtgttgacttttataatagttgatgatagtttgggacctgcccctcccacaccttttggggagggttctatgtaggtgataggtacagggaagtctaatataatttagatgttcatggtggctctgatttgaggtaaatctgaaaagggaagcagctataagttgaggaaattatccctcccacttttggtttcagaagttggttgttctccagatgtttagcttggaggctctcaaacttttggttgcaggatccctatatactaattagttattgaggaccccaaagagcttgtgtttacgtgggctgtatctatcaatatttaacatcttataagttaaactgtcagtgtttaaaaattaatgctttgaaatattgataaaccattacatgttaacatatatatatttattgtatgtattatatttttaatgaaaaaatattttccaaaacacaaatatttagtgagcagcctgttttacatttttgcaatccttttaacacctggctggattattagctgcttgggcattcagtctgttgcaatgtcatgtcacatgcctccgcagaaactcaactggacttttgtgaatgagcaaaatggcaactgatgtcttggttttatcatgaggattttgccctcaccccctgaaagagtccctgggatgctcggcgttttggaccacactttgagaaccactggtttagatgatttgcagaaactacagaaattataatagctaacccatgcggagatgttctgcttttttttttttttttaagacggagtctcactctgtcacccaggttggagtgcagtggcttgatctcggctcactgcaacctctgccttgcaggttcaagtgattctcctgcctcagcctcttgagtagctgggaccacaggtgtgtgccaccatgcctggctaatatatatatatgtagtagagaccaggtttcactgtgttggccaggctggtctcgaactcctgacctcaagtaatccactcgcctcggcctcccaaagtgctggaattacaggcgtgagccactgcacctggccattttttgtatttttagtagaaatggggtttcactatgttgcccaggctggtcttgaactccagggcttaggtgatctgcctgcctctgcctcccacggtgcttggattacagatgggagccactgtgcctggcccgttttgctttttattgaacattaattcatttaattctcataacagccctctgtggtgaaagcaactgaatcggaattctgggccagtctgatatcctcccgtgacccatgctgtggtctgaacattttagatttcaagtgaaggcagtattcctataaagtactaactgaaggaagccaaaagtgacatttatagtagactcacatatatctggaacttttaagttagtaaacagtagatgagacaagttcagaatactgaatttctttaatgaggtttgcatgaaacctttttcagcatatgattatcttctgcaaatgtgcagagaccacgcagctggtcagcaatgctcagtgtgggagccagcaccagtttgtgtgggtgcctgtgccaactgcggtgcagcatgctggatctgcagtggagctttctcgaggatggggagccatgcagagcccgcctctgacccctgcctccacttgctcacttggctggaatctggatagtcctgccaagggctagtttttcagtcatggattaccatgtaatcttatctaaggtgatctaagttcttctttgatcatcacctgatatgttgatgctttggaagaaaagctttgttaggagtttttattggactacagtacccttgaatgaactagttaggaattgtccccaaattaattaagcctccattgcatacaatctgagaagattgcattcttgtccccagcctcagtcattactgcacaaggtaatttccctgaggactctgttgccttctccgtgtagataatgtcctgccctggaatcatctggcttgtaaggaaaattaagaagcgaggctgtagcagcagaggagaagcagggaagaaaggacctttgtcttaacactttgaggccagaggtgatgggatgtcagcctagtgagcttaagagctttattgccactgatttcttatgtgatatgaggactcttggaccttaactcctccaaatcaagggagactacctctgagcgtatactattctgaatgattcagtgagctgtgtttttattctgctctgcagactgttttccaaaggcaggattatctatgaggaagagacaagtgctctttgccatagaagatatttgtggcaatagctgtttgagtagctagtgttgagtgcattgcattatctcctgttcttaggggatggaagtgcatgaattcctctgagaaatgccctgcggtagaagccgctcctccaggggttatcctctcttggtttcctagcaacctgcctgttgccatggtgccgccttacccaggcagcagatctgctgccctgtggaatgtaggctctgattgtcagcactgggaggctgcatgcattttctgttacctcttttttttttttctggtagctagattcaaattgtacttagcatgttactaaaatatttaaaaggaaaagcatatgttgtatggctaaaataatgagactgattgttttatcacattctaggaaatgttgtcctgtcattttaagattgcttcagaaaatctttggtgattatgttgtgtactgggcttttcggtatcctcactggggtaagccaggaaacacttgttgggagacctttctgtaagcgaggtcgttgattaagtatgtatattagttgggcttaggtttgactgtaaacaacaaatacatagaataataatggcttatttgtttttcttatttttgatggagtctcgctctgtcgcccaggcaggagtgcagtggcgtgatctcggcttactacaacctctgcctcctgagttcaagcgattctcctgcctcagcctcctgagtagctgggattacaggcacctgccaccacacccagctaatttttgtattttttgtagaaatggggttttgtcgtgttgccaggctggtcttgatttgtgagctcaaaatgattctcctgcctcagcttcccaaagtactggggttacaggcatgagccaccgcacatggccctgaaatctatgtctttaaaaaagtcccattgtggggccaagcatggtggctcacgcttgtaatcctagcactttgggaggccgaggcgggtggatcacgaggtcaggagttcgaaaccagcctggccaacacggcaaaaccccgtctctactaaaaatacaaaaattagctgggcatggtggcaggcgcctataatctcagctagttgggaggctgaggcaggagaatcgcttgaacccgggaagtggaggctgcagtaagccgagatcgtgccactgcactccagcctgggcgacaagagcaagactctgtctcaaaagaaaaaaaaaagagcccgttgttccaagctgtcttgccaggcccttgaactaagaagtgaagtgctcaatttgccccgagtgctgttcatgtctttatgacacatctaattggaaatcttcaggaggtcaaacattctaagaacttttttggagttcagcatactgcctcagagaaggaagctggtatttgggggtagggtgtgggaggatgagaatagagattaaaggctttgctggccacatgttttgagaaataactcacgagaaagtgtttttgggtagtgtttatttattagttataaatgctgaaaatgttatctgccttgttagagtgaagacttggagctcctcggagctcttttagttcagcccaccactgaaaggatccctcttatatagaattgctcataagttatgcattttgtttctgcttgtttgcttccactgttggtgaggtcatcacctaatgatgccactcattctctcttttttttctgagacaggctctggctttattgcccaggctggagtgcagtggtgctggggcactggagtgcaacctccgcctcctgggctcaatcgatcctcccacctcagcctccttggtagctgggactactgaggcgtgcaccaccacgtccagctaatccgttctctttttatgcccctgggtggatgttaaatgcattctttacctggagctgtggtctgcttccttgcacccattgttcagagatctgtggtctggagccactcataccagctccacaccctggtggaaggtgtacgggattctccccctccttggagatgaccgcgtgtctctgaaacattccttctcccgtcactcatccccagtcctccaggggactctctgggtggggccccaggccctcccctccctggcctctgctgagcagctcacgttgctcatgggcgtgtctctcctggtgctattggcccttgctgttctgttttccctttgagtctgcacaacttctcatggaaccctgttagtgccatttgcccatcttgttctcttggactctgtgttagcctctcttggctcttgctgcttccatttctcatgtggacgtttttgaattcgccttccagttaggtgcctgacattggtatctcccacctcctcttcagttctgccaccttgtgcctgggtggttgagacccacacatgagcttgcctgtcctgtccctcccagaaatccctgaagcttcctgcagtatcgcccacggggttgagccctcaccttagggtgtgtggggcaggtgagaccattcccccaagcacctgagatctgtctgcctttgcagcctggctgccgctacttcccttggcttcgctcctgaaaagacaggacagtttcttcccttccccacagagaactggactcctttggaatgttctggaattccccactccctctccacgtagccagccttttctgtcaccatcttgcaggtgccaattccaatttcgttttgaggaaggctccgttagcattgccttgccgctcccattcccaccgatgcgtgggatcacacaccattacttagatgtctgttcctcctgctctttggggtaaagaaaatcgtgactgttcatttgttctttggcctgagggcctcgggctctgcgcagtcagtggagctggtagccatgccttcagctgggttgtttacctgcttgtgtggagaaaaaccacccttgcctgtagagctttatgattaatccacagctgggacctgagaagttcctcaagtgctaggagaaatgtgtgtgtaataaagtttctgggaaagggatccatgtccccaaaaggttctgacccactgtttgatcccctcttaggagatctgctctgggagtgggctttgcacctcttggcggctgggagctccccagcaccacccagtggtgcctgccctgaggacacgcagtctatgaacgtatgtcatcatgtcgttcatcctgggagatggaatccgttgcataccacaggctgtttttgtaacatgcacctttatgtttggcttgtggttggaggtagaagggggtgtcttgctaagaaggcactttctaggagttggaatttacgtgttacttcctgtgtccacggaaatctgttttacgctggaacttgactttataggcgtaccgaattctccaccatgcgtatctttttgcctccagatctgaggaagaggcctgctgccattcagtaggtcatggattgggaagtgacagtcagtttgtattagctgggccagtttcagatacaaggggctgcccaagattattttcagtccaggttggccggaccaaaacaagtaacaaagtcatcatggaaaacgattattgtttcacattcctagaggaagtaggcagcctacaaagtattctcacatgggcctgtgagagtgtgttgtgttccggaaacactctagattttggtcagctgtagctagttccctgctgagagggctggagaaagtagctgggtggacattacactggatgagcatttttaagaatcgggggtgctggtcacttgcccctgcttttggtggtgactcctctgtcttggctctggtctcctgaggtctgagcccatcctcttctggcctccctgtgtatcactctgccttcctctgcctagagactcatttggtagcctcctgttcatcttgatttggaggtagggctaggcagtgtatcatggtgtcatcatgggtccttttcagagtcctaggggcccagggcctgctagggtgtggtgggagtcatcaggtctggggttcctatttgtgctgtctctgtgaccgcacagtccccagagcccttaccctcatgactcaattctgcctcccctccaccgctcccctgagatttataactgaggctggcgccagccatgcttggctacactgcgggctaactaagcttttgtgagccatctggggagcttggtactgatttgcatctggcacatgttttcccctggaaactagagtccaaaccagcagcctctggaatgtggccagcttggttgaggttgcgaactggacgtgtttgtgattttgctcccaggggacagggaaggctataatctgggcagcagatgaataattcatttgcttgtgtctgaaggggtgaaggtgatctgactcgagctttgtgggactcagtctttgtgtgagtagcttgtggaggtagtaatgaaagaaagcagttcattccttaccctctcctggaggaagaacacgtactgacctatacaacacgtgtttcctatgtgtgttacacacgtatgtagaattggcttacagagggaagcagcatacagcaagattcctgaggttctaagtgtgtttctcaggtgattgtgttttttttttttttttttttttctgtctcagacttgggtcaagtatctattgcagcaaaagtttgttcaaccctactgagatgcctgttggagtttgaccctcatgccaccatcctctatgtgtagtccgatgtaatctcttgtttcctagctaaataattgggctagaagtgagatgtgaatctgaggatttttttccccatttttttggttctaaaatcaaggacctgttttaagaaacataggcactctcaaggcagtttataaaatatttttagggctaggtatggtagctcaccgctggagtgcagtggtgagatctcggctcactacaacctctgcctcctgggctcaagctatcctcccacctcagtctctcgagtagctgggatcacaggtgcgtgctaccatgcccggctaattttttgtagagatgaggttttgccatgttgcccaggctggtctcgaactcctggactcaactgaccccacctcggcctctcaaagtgctgagattataggcatgagccaccggcagctggccattgttttatgttataagggtatgaattttttttaattttaatttttattttatttatttatttatttatttatttatttattttttgaaacggagtctcgctctgtcacccaggctcactgccagctccgcctcccggattcacgccattctcctgcctcagcctcccgagtagctggaactacaggcgcccgccaccacacctggctaattgtttttttttgtatttttagtagagatggggtttcactgtgttagccaggatggtcttgatctcctgacgtcgtgatccacccaccttggcctcccaaagtgctgggattataggcgtgagccaccgtgcccagcctgtttttcttttttaaaaaaacccttcattctacagttgttatccattttacagaagtcaaaatcttccctgtatttgaatttgttagtcttttctcctatggtttcttttgttacttatggaaacattttaaggttatgatgataccttattacttatggaaacattttaaggttaaagttctgatactccctgatactgtttaaaggtagctagagaggatgaacgtgaaccagatacatgagtcccttctagccctgtgacagacaagccagcttcttgaccgggacaggcgtgtatctgtgtggctggtgtcccatacagcttggtgaggggctgagtagcagagtccagctcaaggacagtcgccctcagccctggggaaataagtcaggtcgacctggtttgctacaaaatgggccacctcctcacgttggttttcattttagctctagccggcccggtccttggactgaaagaatgcaccaggggctcggcagtgtggtgccagaatgtgaagacggcgtccgactgcggggcagtgaagcactgcctgcagaccgtttggaacaagccaacagtggtgagtgccgctgccctccagtcccagccgcagcactcctcttgggtccccttagaacagctgtaactcactgccatattgacagagcactttttcttgccttgttttgtttacttctcactgtgactctgtgtgggaggcaggacctattggtgaatgtacccattttacagcagaggagatggaggctcagagaggttaaggtttcactctcctgaggctacctggtttcttgtggcagacaggatgaggtcccccatgcctgcggctccaggtgcctgccccatgctgcctctgggcctctgtgcagatcccacttctcaccttagataagaggccagtgggttggcagtgcccattcccaccactgggcacatgggcgcggctctatccttggtcactcactccaaaaagtaaatgctgagcttttcaggtactttctgcctgtttcatattttgttctctcctcactcctctcaaacaggcaaactgctgattgagatcctggagtgcagttgccatttaaaattggtttccagctgtaaccacactgaggaagctagcactgatttttcatctaaataatgctaaatgtagcgtattaatgtggggcatggtctaaggcgacaagccatgggtgtgttcctcacggtcccaagccctctcaggagatgctctgctgaccatgccagctcaacacagagctgctgccctgggctcacttggggctgtgccggccatcatgtggtacgggctgtgtttgactgagtggactttgggttctaaaaaacttgtcagtggccactactgctccttcagtaagagaagaaagcttagcaccattcttttagaaacagtttgtgaattattcactggaaaactgccttctgtggccatacttgcccttttttttggaggcagggtctggctctgtcacctaggctggagtgcagtggcacaatcatggctcactgcagcctcaacctcctaggctcaagcaatcctcccacctcagcctcctgagtactggaaccacagatgtggaccagtatgcctggctaatttttgtattttttgtagagatagtgtttttaccatgttgcccaggctggtcttgaactcctgggctaaggtcatcctcctgcctcccatagtgctgtgattacaggcgtgggctaccacgactggcctgaaactactttcagatttggtttctaatttgccttcaatcttgtttttaatactacttcctgtttccaggtttaatgtgtgtcccgtaaggactttaaaacttgattggctggtcttgtcatggcccggccttctgtttttgttttttgtttttttttttttttgagatggactctcactctgttgcctaggctggagtgcagtggcacgatcttggctcactgcaacctccgcctcccgggttcaagcaattcttctgcctcagcctgccaagtagctgggattataggtgtacgccaccatgcccggctaatttttgtatttttagtagagatggggttttcaacatgctggtcaggctggtctcgaactcctgacctcgtgatctgcccgcctcggcctcccaagtgagccaccacgcccggcccggccctctcttgatatggttccatgcacagtacccttgaccctctgtttccacaaatgttgagggctgtctgtggaacttgagcatcctggggtttgggtgtccatgggggtcctggaattgataccccctcagataccaaaggatgactgtattagcctgactaggttcaagttggtttctctaaatgcagctaagttcataggtgttcctcagtctcacccagacatgtttcttctccatggatggaaagtcagttgacatcaagaagggagcctgggcattcttccccaagggccgcaggaaccaattagaatttccatggcctctggtccaggtgggggccttggtgccaatcagaagattggctttggtgtggtcttgccttgttaacatgcctgggaggcaggggatgcgcaggtgaacggttcagtgtgggtgtgccttcagaggtgggtggggcgtttgtttctctgtcccacccacctctctgccatactgatgtgactctgatttcacctgagcctcagtttcctcagaggtgttgtgagcattgatgtgaaattgacctgtgccacatggggtgctgtgtgggtatgagcaaaggttctgtgtcctgtaactcacagtgtgttctggtgagtcacacctcttccctccctgccgtgccccagcgctgctcatgcagggtggagaaccaggatgtgacaggagcgcggtcatgatcatatccctggttagagagaatagcgaaaaggccatggggagttccagctgtgtggggtgtgaatttgtgtcctgcaaatacaaatttctcgtattctttctcttagaaatcccttccctgcgacatatgcaaagacgttgtcaccgcagctggtgatatgctgaaggacaatgccactgaggtgagcggcggtgagtggggatggtgcttgagccacgggcacgtgcactggttcctaagagagctgtgattccgggtgtctaaagaggaatggtgtaggcctgagggtggcaaatgtcttccacaaaggatcaaggagaaaagattttagggtatatgagccgtatactgtccctgtcacacagtctctttttaaaaatgtaaaaagaatgtaaacaccattccttgagttctgggttgtacagaaataagctgaagggcctactttgctgaccccgggactaaatgcccaaagttaattgagatgttgtattgcatgccactaatacctaggtccattttggccatctctgcttagaattccctgtgcctgcgagactgcaggtccagggattttcattttgaatgctcatgtctgcttttgcctgattgacctaatagagccataggtaacatggccaagtccttttccctgagggctggctgttttccaggcttggtttttctgggagctattgagggcctcttgccttcagcccatttatttccagggaggaaagcctatcgtgattctgaccctggtgtcctctcgtaggaggagatccttgtttacttggagaagacctgtgactggcttccgaaaccgaacatgtctgcttcatgcaaggagatagtggactcctacctccctgtcatcctggacatcattaaaggagaaatggtaagtgatggggaataggcttttccttgaaggtgcttctggggcccaggagaggcagtggcccagagtagattgattaaaatggaaagtctgttcttagctctggaattcctcaacagcattttgctacaatttgacatccagaatagctcctttggcacagcaggccactctgtatgtaacttgccctggggttagcgagggtgcggctgctggggactggtcggactgctgaaggaatgtaaaccggcataaccttcagagatgtgagttggatacatcatgtccaatctttaactgacccctttgagcaggcacaaaacctcacttctgtgaatttatttctgtgaacttataatcaaggaataattcagggaatgtattggggtctttcattcatcaagtatgtattgtacacagacacaaaccctgtgtcacagactgggtttttagcaaagaacacggagctagctttgtggaatttggaaaggccttgacaaagaagaggtgtttaagtaactgaagagggccagtggggcaggactttcccaagacaggaccaaggttctggtgaggaaggcaggggttgtgtcatacacagcctcctaggccatcttcaaggattgcaagtgcagccttggagtgtcatgattgtaagggcatttgtcaaagggtttggtctaggtctaggtcccattgagggaagctgcaagtccggaagctgacaggaccctcaggaggtcattgctttgtgagtgagatgtgatgtggacagtggaaatggcagatgcagattctcttttggaggattaaatggactggacttgctcatgagggggatgtataggagaggaagagctataaatgtctccctggtttctgagaagataaaggtggagttatttgctaaaatggagctagttgggcaggatagaatgaggggtaagtttgagatgtctgcagggtgggcatgattacagaagttaaacacttgggagccatcagcatatggaaggtgttgaaagccatcgtgttagctcattttgtggggaagtgacttagaattgctgactcttctcctccagcaagaagctcctattcctttatttatttatttatttatttttttgagactgagtctcactctgtcgcccagcctggagtgcaatggcgcgatcttgactgacagcacctctgccttccgggttcaagtgattctcccatctcagcctcccaagtagctgggatcacaggcacccaccatcatgcccggctaatttttgtatttttgtagagatggggttttaccacattggccagggtggtcttgaactcctgacctcaggcgatccgcccgcctcggcctcacaaagtgctgggattacaggtgtgagccactgcgcctggcctcctgttcctttaaagaagagctgaggggaaagaggtaacatttaggaagcctgtgttagtccgttttcatgctactaataaagacatacccgagactgggtaatttataaaaaaagaaaaaaaggtttaatggactcacagttccacgtggctgggggggcctcaaaatcatggtggaaggtgaaggaggagcaaagccacatcttacatggcagcaggcaagagagcatgtgcaggggaactgccctttataaaaccatcagatcatgagacttactatcactaaacagcatgggaaaacccgcccccgtgattcagttacctcccactaggtccctcacatgacacgtggggactatggcagctacagttcaagatgagatttgggtggggacacagccaaactgcatcattgcctaataggagaattgaggaagcttaggggccactgtgtggttaggcactcggattgggtaattttgtcattcttggtatgctgagcagtttgaatttagacaacaggtttgtgtttcttttaagggatttaaagagagggactaattcagaggcactagatggcctgtcttattttcccctggggagaggattttcagcaggacttctttccatcccaccagagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggtaagacaacgggctggccactgaggacccatttttggttgcactggagatgagagaccaaagggacagagagggcacgtgtggttcttaaactggggcttatccctgtgcgtgactctgcagtcacatgagccagcctttaaatggttgtaccatgaagtttctaaagaatgggatatttaaaatatgcaaagattaatcccctttaaaaaaatttacttcttttatttttgagacagggtctcgttctgtcacccaagctggagtgcagtggtgtgatcatggttcactgcagcctcaacctctgaggcttaagtgatcctcccaccttagcctcctaagtagctgggagtacaaatgcacaccaccacacctggctaatttttgtattttttgttttgccatgttgctcagactggtctcaaactcctgggttcaagcgatctgcctgcctcggcttcccaaagtgctgggattacaggtgtgagccactgtgcctggccaacctttttatttatactaaaccccctttttataccatactgttactataatgaacacttaatcgattttaagcctatcagtaatttgagagcctgtaaagcatcttaggaactggtcagcaagtgccccctaatgctgcagccctgagtatataaggacgttttcctaggaatttgagtcctcttaagttgcaaacctaactgcctcttctgtaggataatggggacgtttgccaggactgcattcagatggtgactgacatccagactgctgtacggaccaactccacctttgtccaggccttggtggaacatgtcaaggaggagtgtgaccgcctgggccctggcatggccgacatagtgagccttgtgtccttgtgcattggggatgttctgggcctgggagttgggctgtggaggctggagtagggcgttcagacaacatccttctcttttttcccagaaagcagcttgaataggtagtgcagacttgaatctattttggttaatggcatctggatatgtaacaaaactgggaacaaaaagtaggagactgtttctgggaagattttgtttcctgccaggcaccctgtgtattaggaacactgtagaaatactttttgcccccattttttttttttttttttgagactgagtgttgctctgttgcccaggctggagtgcagtggcgtgatctcagctcactgcaacctctacctcatgggttccagggattctcctgccttagcctcccgagtagctgggattacaggtgtgtgcaatcacgcccagctaatttttgtatttttagtagagatggggtttcaccgtgtttgtcaggctggtctcaaactcctgatctcaagtgatctgcccgcttcagcctcccaaagtgctaggattacaggcgtgagtctctgcgcccggcctttaccccatttttttcttttcttttctttttttttttttcttttttgagacggagtctcgctctgtcgcccaggctgaaatgcagtggcgcgatctcggctcactgcaagctccgcctcccgggttcacgccattctcctgcctcagcctcctgagtagctgggactacaagtgcccgccaccatgcccggctaattatttttgtattttttagtggagacggggtttcactgtgttagccaggatggtctcgatctcctgacctcatgatccgcctgcctcggcctcccaaagtgctgggattacaggcgtgagccaccgcgcccggccatttaccccatttttgaaagcttggctaatgtatgtgacactgagaattccagctgtgctcctgcagcaagcatggtcactgaccatggttcacctggaagcctcccttagtcctgtgggctcagaaactcattttcttggccccttacttagatcgtttcattctgggaccctattccaagattattaatcacactcaggtggatgtgtaaaaccaaaatgccatttttagtacctgacaactgaagaaacctgctagactggcagctgagaagctggttgtaatcactctgtcctttgggatctagcgaggctttttgggtggagtggccggctctaggagatgaggccttctccattttttttttttttcttgagacagggtttagctctgtcacccaggctggagtgcggtggcacaatcatagctcactgcagcctttacctcctgggctcaaacaatcctcttctcagcctcccaagtagctgggattacaggagtgagccaccacgcccagctgagggtttctctctgactttccgttaggaatgttaatcaggtgaacattcattcattttgaaagcctaggaatcctgtagcctcattttaagtgtctttgcataacaccatttaaacaggtttcccagttgaaccctctctgagaggctgtatcatgttacctttggtcctctctctgtagaagctccccaaatacaaggagcaattctgtggagtctactggaagtatctagattgtctgaaaataagcagttaaaaatcattataacttgactctactggatttaagctttataatgccatctgagattgtgtaaatggctttgaaaggtaagctccagttcctaagcagtgtatctcctagctgccttctctccaaattgccactgaatagttgctgtgtgatcctggggcaggtgaggttataagataaaggagacaggagggtggaatctttaaggtcccttaagaaacattttcaaaacgtcttttgcacacatttcctataaatgatagagtaaccaaattgtcattttcatcttattaaagctggcccagagcagacattcataaaattctactttagaaacttgcttgatagtcaccagttgacactgttggaaatgctggggggtttttgttggttgggttttggtgcattgttgcagtgatttgtttagcaatctgtttctctctcctcagtgcaagaactatatcagccagtattctgaaattgctatccagatgatgatgcacatggtaggtggcacggaggccccttgttagcatttttctttgtttttcaggtttcgtcatttctaggaattttgaaaattatatggtttagtttcccttttttaccttagagtgctgaattgggctaaatcgacccctctggctaggagactctccacttgcaatctcagtacctcccctgttacgggagaggcaggctgaagcatcttgatcccaggactgccctggtggcttcctggcaatttgtttgcctctgcccgttcaggccagccatcaggtttctaggtctggctttaaccctgggatctgtagaagtcaagtgctctctaactaagccaggcctgagaatggctgtgttgccacctgagtcgggggaatactgcctcccggagtttgtcccgtgcatggcagcagcgtccgctgaagctgctgcttgagctggtaactcctgagctggctttggatgcattcaggtggcagggggcattccttcattagaatcaagaatacccattcaggaaatgagctcgctagtccacgcagagcagggcggcctgctcacgttgggaacaggcactgcctccttagatctgattggcagggctgagtgggtggggggcaccttttccctgtctgtcatgctttctgactacttgagattgacataccagcgtttgagtttgttctctgatccaggggtcagcaaactggcccatcatgttttgtacttaaagggtatttttttggaacacagcgacgcctgttttgtgctacagcagcacagttgagtagttgcagccagatcttatggccaaggagcctgaaagattgactctctgacctgctgtaaccactcaagcaagctgaggaggagtagtttatttgggattattactcacaccctaccatgttctaaaaacagttaaaaggcagcttacagagacatgcacctgaagtaggtaaagataagcattgacgggatttaatctcgtgaagtacttcctcatagctaacttaaaatatttttctcattataaaagttatactgtgtagaaatgtgttgaaaatatggacaatacttcccacacaaaaatcatttggagtttcagaatatatcaacggggtcatatatactaccttgtactttgtagtttgcattttttgcctaaaaatatgttggccattgaatattcttgtacaaatgactaaatgcttgcagaataatcacctgtgtacatagaagagaatttacataattggtccccggtggccggatgtatctaggttgttttcaggtttgcctttgggaagatgaatatccttatagccaaatgcatacatatatgcatatgcctgcctttccccttattatagagaactaaagctggaactgctgaatggaagcatgaggctttggatacattgttaaattggccttccaggctgccatttggccacctgcagtagattgccctaggatcccttacccctcagggatcccttaccccccttacttgggcagccctgtgtcttgttctgtggtgctgctggtcactaacctgtgggaaagccttgtgggcccggggccagtgtgggctcctgagtatggagacccttcatcaagcattttctggggctcttgctacaagtgttttgagtgtgatttagtgtgtaagacctggagatggtgcacacagagcaggacagcccccaaatggtctatccctgcagggccaggaaagctttcagggcccccttgtccgcaagatagcaggaacaaggtaggttgctaagatctgattgcaagagcatttcccctgaacctcttgggacatccttacacctggttaactgcttgattgttgttttaatttttcttaactgttgtgtcctttcctttctcttattttcacctccgatttcctgtttttttgttcaacagcaggatcaggtatgtgtcggggaatctgcttgcagtagtggtctgctgcttcctctagttactttgctttttttttttttgggtatggcatgattagctctgacagatacaaggaatggttacgagaggcagggtccctctctgttaataggctggggagggcttctgcatctctcccctgtaattcagcccttgaggttttgggggtctcatctccccttcggggtccagtaaaatgaagccagcagagccttgtgctctggtcacagtccacatacagcatacgtacatgcaggccaccagtgtgacaatggggaaccatgggtggcccaggaggtgcctcagcctccttcaacgtaggccagttaggaagtccagtgtaggtctggcttccccagggcaccttgtgtctgtcacaacgcaagtaggcattgcatgtctttagtgctgtttttcataaacacagaaatgcttctgctgcatgagcaaacatttgcagacagccagcagactgttcctggctgttggatccagagaattggaaacaatctcttgattgtggcttctgcccctctgggtaacagggtcctttgggatctagagccacatcagatggcatgctacaagaaccaaatgcccagtccatacttgctctgagccagtgtccttcggggccgtcctgaacactgccacctctgagcgttggcatccatctgctaggattagcattggagctttttttgaaggtattttgaagtctaatgggagaggactttggttgaaatacctgaatttttacctaggcctcctcaaggagttggaacaaagctgatcgaggcagaagcagccctatacctcctgaatattggcgtcttttttttttttctaaaaagcttgctgtttcttcagctgcgttcttattatttatttatttatttatttatttttcattcttaaggtgtggcagagacagggtatttgggatatacttttcagactcccccggtcttattaattctcgaaccttcttgatattaaaacaagatgagccatagtcatggtctagctcttttcccttaacaggtcctgtttttagcacttttgttcctgctgctttagggtttggtgctggaaggcaaatgcactcaggctcagagctagttgctggttgcatttatttccacaatatacagagtctatacacttgtctcactcttggccatcagagtgtcatggtcaggatgtctagactatctagtgctctgtgtttggtgtctaaatggtgaaaggggatcaatctggagaccttgtggcttaaaatgattcatccatttggcgggttgggttttcatgtgcactgtgtgcagcttgaacatagaatgtggttttttaaaaagccagcatttccccttaatgcatcattttaaatggtcctgccgctgaaaaatctggtgtggttttatttctaacacatttggctttctgttagtttatgggcatggtagttccccctctagaaaaaagcatagcttagttcctacctagagtgacctgaaaagacacattctagaacagaccaggtgtccttggagatgtggaaggtgctggggagtctccctcgtggtggccctggatggagactctgtttgatgttccttaggagctttgtgtggtctcctccccgagatgtaactggcacatatgcactgcttcagacacgagccctttaacatggaaactggaatctgccccgttgtgggagggggagagggaggtagccttgacctgggcccagggtgctgtccagctccctgtcctctggctggattgggactgaggagcagtgggcgtaggcttgctgctgactggttgttctgtgctctcttcagcaacccaaggagatctgtgcgctggttgggttctgtgatgaggtgaaagagatgcccatgcagactctggtccccgccaaagtggcctccaagaatgtcatccctgccctggaactggtggagcccattaaggtacctggtgtcactttgtgtcctggtcagggctgtgcaatgccacactactccctgctgtgtcacatcacaacttacgagtcacttgtttctttcggttccctgcctggctcctaaaggtctttgagtttgtgatcactggtttatcctatcccctatactaatgcagcccccgaccctgagttcttttgaaaacattttatttccttggttgtaaaccctaatgttcgtgggatcattagcctgtgtattttcagcatgccattcaaaggtgactttgcagtgcctggcttcagcctcaccttctcacatgcactgtctgggtccttccccatcctgtggccctgacagactggatgttcccagcacacccctcagagtgtacggaagcctcactgggcctgcagcctgtatactaagtacatgtgggtgtctattttatttaactaaaacacctcacttggtgaagattagactacttcatcccataataaatttgtatttggcatttattatgggtcaggcagcatgttaggggctgtggtgaacagatgatgtcattgtgcccgtggggcttacattctagttcttcaaggcctgggctgtgtgatgccttaacacgtggcacatgtacacgcttcttgttctagaacatcccacggcacttgactgccagctgttggtctctctctgctgtctcctctctgcatgtgcagagtgtgtgacccaggggccaggccgaagtgtcagctggaatccaggaagcactgcttcttgccttcctctccaccgggtgctcctcagctccagcctgctgaccaaagtgacggccagagaaagtgaagagttatagctcgcactccaaccacatgtgactacttaaattttaatgaaataccatggagcaaaattaaaaattcagccccttggctacaccagccacattgcaggtgctcagtgcacaggtagctggagcttatagtggacagcagagatagagaacatttccattgccacagaacatcctctgtaacagtattgccttattaaaggtgggttccagaagagcattctcaagtgctaatgagacatgggagacacacgagcagacctgaagtgtgttcaacattctgtcttctagatagtggaccgatagtgagccccttcactttgcttttggtccttcatcctcctccccaaaatgaaccctgaatgatgaaatgattgtaaccgaacacatcatcaggacagctcttcggggtggggaagggactttctgtctcctgaactgtgaattcctgggttttgttttggtggggttagggggaggtgggggtggtagaggattggggaagggggtgaatgtaaaaatagggaattaacttggatattagaagccacacgccatttggaattcaggaggcagtggcccttgatgtgctaacccaccctggtctctgtgtcccctttcctttaggggagcaagaccaagggctgtgagtcccagcattgaaagtactctccttctactctttccacagaagcacgaggtcccagcaaagtctgatgtttactgtgaggtgtgtgaattcctggtgaaggaggtgaccaagctgattgacaacaacaagactgaggtatgctgtcctcctggcagagggagggcctctcctgcccccccgagcctgaatgtcccagtgggaaagtcccacaggagagagggcttggcccagccttgacatgtgtacagccatgtccccatctcgtggaaggcaatcctcaccagtgggacctctaggctggcgggggtccggggaggtggacaccattgccctgctttgtagtttggtagttttttgtgggtggaaacggcacccaccattgactcatttcctggccatgttagtattttcagaatgtcccccaacccttgtccggcctcccgtcttctcacacgatcctctcgtgtgtttcagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccggtgagcgctgggtgtggtgcgggagaggatggtgcccctcttgggtctgggagggccctgccagcgttgagcccgctgccctcttatgtagttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcaggtacgccccgggctgggctgcggtaggccagcatggcagaacctgatgaagtatgccaaggctggggtacattttgatggaaaaccagctgtttctgcctccgggcatggagtccaatgaagttttacttggaggtgatttgttggcttaagatgagccactgggggaagcaacctgaagtagagaggccaaatgtagatagggtgtctggaaagggaggccccaggacccagtgggctgggaatgccaggagctctcagggaacagtgtatccagggcctgcctggccttttgtgccccactatgctcggacacccccagagctggacctgtgtccccgctttcctttatagtgtgatcagtttgtggcagagtacgagcccgtgctgatcgagatcctggtggaggtgatggatccttccttcgtgtgcttggtgagcctcactgggtggtgtggtcctctcgggcagctgtaacctggggggctgcagagacccggaagggttgctctgagacttggccgtggggtggagtctctgggttctgctgtgggagagccaagaaggtagggagccagccccccaagccccatcgctttcctcagcaaccctgatgttctgaaagagcgtggtggagctgtgatcctagctccttctggaaactgttttcttagttttgaaagcgatacatcgggcagctctcattctccccctttcttttttccttttctcaccatatagaaaattggagcctgcccctcggcccataagcccttgttgggaactgagaagtgtatatggggcccaagctactggtgccagaacacagagacagcagcccagtgcaatgtgagtagctcagcagacagtgtcaccagcctgtcttgccctggggtagcctgtgtgagaatcctgctttaatgggaacccagtgatcaactctccaccctgcttttatgttatcagaaagctgaggcccagagaggtggttaggcttactcatggtcccctagaaaagacagggtgaactacactcttgtagtgaagggtggggtggattttaattatttattttttttagtatttttttgcttctgctttgttgcttttgtcttcatttcccttgtgacagtgtcagacttgtacaaggtcactccagggattgtacaaggtctgtgggattcattgcccagagctttgcccaggtcctgtcccccgggaacatgtttgcccttgctgaagccgggcccgagtcctcactcaaggccctgagaactggcccctgcccagcagccctagggcactgtggccctggcctggcctggcagccaccagttgggtgacttgtgctgcttccctgggtggggatgtttggttcggtccctgttacttaatgttgctttgtgcaacttttccttcctcaccgggcttccctgtgaccatgtcagtggcggttgtgtcatttcggaccactgcagggaggggcagggggcccccattctggccatgtccagctctttcctccagctaggctccagcccatctccaccgccagccccaccccacagctggttctgctgctgtcctggggaaatgtgggcctgcttctcaaggcccgagctggtgtgtagcctaactcaggcaaggaggttctgcctgggagttagtgtgcaggctgctagcaggacgctgggtgccgggtgcaggtagatgaaggtcctgagccctgcctgcgtgggtactcatctgcaaactgctgcaggcatctgctgctctggactcgtgccttagaagttcccaaaactctgatggccacgtgttccctgtttttaagtgagatcctgtcctgggtcttcagcatctggtgccatccagctgacctaggacaagagaacaggtcctgttttggggtgatatctgatacattgatgggccgggaacggagtttttcatccgaagactaaactcagcttcctctctcctaccaggctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcaagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgtttctgtgacccttcagctggaagagtttgttcctctctgatgagctctgagcccatgacacctttggggcccagcactcccatgacccatcttggccagagaatgaaagcaaagtggataaaggaagatcccacctcatcctccccaagactcagggccagcagtaggtcaggcgcacctgaaggtcggctctgctcttcacctgcccctgtccctgctccctagaggccagagtcagagcacgttgccagttccttgagagttgccttgatttttaaacaaaccattccagaaacttgtagtgagtaccagttaaacaaaaccaaggggaaactattgagggaataacttaatttaaaaaaggaacacacacaaacactccacattcaaaaccggagggaacatcagtcacttctgtttataagctgggcacacatttgggaagccagtgaaatggagagaatgcttgttcattgacattgactttcttgtccacgtggggatgccacctccacctggacgtccagcagagagggatgtggcggaaatgtagcgagacttggactggagtcgggtgtccggccagcaggggatgtccgcgctgggcctcccttgcgcctgcttagccggaggggatggtgcttgcggggtggagccgggagggaggagggcctgtttggcctctttcagctcagcctgagccaagctggtccccagactcttgggccccagtgaccctccttaccttgtccttagatgcttaacatttttgtttggttttcttataaaaataacagatcttatgaaggtagaggtcagatgctgaatgagcgtctggcaaaagtgggatctgagcagctgatgcgggctgccagggccaagccaaggttgtccccaaggcctggccttggagggtcccccccgaccggccctgtccctgcccttgctccctgggaggggacggtggatgggtgctgctcacacccacaaggcttccctgtctagtcacagctctgtgatctccaggggggtctccatgatcacgtcgcgaagtttgtgcaggggtgtggatttggcggattctgtgcgggcgttgcgctcgaaggcagtggcctcggcagcggtcagcgtctccagcgagcggcccaggcccttctggtcttcctcgggcaggctgttgaggtcggtggccagcagcgtgcccgtgctgccgtgcaccacatggatcccatcgggccccttgagctccactggtggcttgtggcggaagcgcaggctaccctgccctgggctgtggtctcctggctcctcgtccagctcagtctgtatcagctgcaagaggccgggacccccacatgctcagggccatgcccaaggggtgagcaggtggatggccccagagacccactggctatgtggctgaaccttgggctcctaccgcagcaggcctgtcagactctgtttctcaaactgcctgcaaaggggaatcatgaatgcttaagttgctgcagatgggttcttgggaggattggcttcttgtgaaaatctgtgtgtgtgtgtgtgtgtgtgtatcggcttcttgtgaaaattgtgtgtgtgtgtatcggcttcttgtgaaaattgtgtgtgtgtgtgcgtatgtgtgtgtagacagagtctcgcagtggcgcgattttggctcactgcaatctccacctcctgacttcaagtgattctccggcctcagcctcccacgtaggtgggattacaggcacgccatgttggccaggctggtctggaactcctgacctcagatgatccaccagcctcagcctcccaaagtgctgggattacaagtgtgagccaccgcacctgccctttatttatttagagacagggtttctctctgttgcccaggctggaatgcagcaacgtaatcaaagctcagtgcagcctcggactcctgggctcaagtgatcctcccatttcagtttcctgagtagc

SEQ ID NO: 12144 - DNA, 47199 bp, Human
actccaattggctaacacataatttctctatgcagcttaagacttcaggcagacagatatgaacacatgaagggagtaaaaactccaacctctggaccacttcctggagtgctcctaacccagactcccacagggcttcctcccatacttcatttaggtctttggctcaaatgttacctctttagaactgcctcaagactggggcaagaggagccccagtctagggctctgagcacctgattctcttccgtccatgttcctttccatagggcaagaaatcccacgggccaacgggatgtactcactcagagctcttgcccctctcctttttagagcatactgtgagttcctgggaccctagaaaatagtgccgcaatagcaacaggtcaccagctacaggctgcctcagccttttcccaaggtctatcctcctgaggagcaaggggtggtcaaggggaggctatttgcaggtgtggacaaaactctgatgtgcagatgtcgttgttataggtgtgggcaaaaggccatttgaagtatgggacagagctggggtgccaagagaagaaggaaggctgagggccaaggacatgttccccctccaaagcactacgttcgagggcgtatctcagaagggtccaagaatcctaaacttaaatgtggccttccagattatgatgaaggtatacatgtcaagataaaaggataggaattttacatcaccgtttaatttgtagttttaaaatatgtagacatgatatgtgggcctccatttgtactactgactcagttcttgcaaatattaagggtagacctgtccctgatcttcgtgtgtaaaatagcacctcctctgccactctattcttaccccagtctacatttcttcataacatcggtcaccatctgatctacatttacttatgtatcatctctttacccccactggaatgtaagttccacgtccctagagtctatattttgtttactgccttatccttatacctaaacaagtgcctggcatgacaccactcagtaaaacttgaataaatgaataacaaatctaggctcaaagctcttacaggtgaaaggggctaacctggcagtcacaaaggaaaaatatcactgtgacaaccgtctgaggagcaccttctccccttaaaataactcactcaaaacagtggagctgcaaaggtgaccagagaaaatccattaacaccttagtgcccatgacaccaggtgagttgatcgggctacttgcgagagggacatgtgagtgagcgtggagagctctgagtaggctgaagagctggatgtgggggatctgggctgctgggaaccccgaatgttggaatcgccctgacaaccttatgagggtggtcagatatgggtcctgaggaaactgattccacggcaactgcccgccaacccagcacaccccacagtgaagaggggcttctgatccatgagtagggcccctcaaatgatgttcccctttagatggtcatggtcatcagcaggggtgggtgcatcgatcctgtggggtcttggtggtcgcagaccaagcgtccctcttctcacatctaattcacaacgtctcatcgctccgcgggagcccaggaactgccctacaacagccgaaatccgggtcgtctattccaacggactcctcttccgttggatacgggggccgtgagaggccaaacaacctccgcgaggctacccccgcagcgaccgctcggcgggcgctccattcctttaccggactgtacacctcgcctcctggggcctgaggcgggaacccgggtcgcgctgctccgaggcctcggcggaccgcgaaaggatggctcaccgcccggccagggccagcccctgcaacaagctcagccccgcccgctcccgcgcccaggagcggccggcggggcggggtggctgggccggcctcgggggcgggggctcgggggcgggggctcaggggcggggccacgtggctcctccttgcgggcggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaaggtgagaagcgggggcggcccgctcccccgtgccccgccgcccggacccctccacctgcccggtgggcagcctcctactccgggagcgcgtccctcttccagtcacctccgcccacctcttcctctccgcgcatcccacgcccaccaccttcatgtttctcagctccatttttgcctcccgctcccttgccttttcctcttggccctcatcccgagcttctttccctctccgcggcctgggcccccagacctgccctgctcgcccggttcgtcccccgccaggttactgcctccttccctgcgagaggtctcctttgttccttcctccgcatggtccgctgacaccttaccgtttcctgggccagccttgtggcagtcctcttcctctcgtccagggacccatgtcatcttcctgccaggttccctagctgctgtgggtcagtgctggggagaaaagggaacggacatccattttgcctccctgccacctttctccactccctcgactggttgaccaggtggtacatagacttcctttctcatttttgtctttgatgtgggtatgcccacctggcagttttcctatctctgttccgggcctctcctgacctgccgcctccagctccttagcttctgggccacatccttctctctcttcccccgctcagacccttatattttaaacccatgcacccagaggcctttggtgcgtgtttggctcttgctccatgttcccaatccctggttggggcaccaaaactatatttcctgaattccaagacaccatcaactgtgagacacactgttcattttatgacagcccaaggggtagaaggataggaaaaaaccactacatgtataaagatttgaaggtgaactctattacagaaatgctaaaattttgaaacacttaagacttagagtcgaggaaatatggtaataatagtaattaatatttacggagcacctatcatttcaggcaccttactaagtactcggcatacattgtctcatagtttcctttccacaatttaaagattcctgtggtgtcacacatccacctaatccaggtagtgggtatttggcgggcaggagtggtatagtgatagtgatttgttcctgacttgctgcctctgaatggagttacttcctgactctggtgctaggtcgctagcacggcctcctaccctgaaatggtcattgaatgagaactgtgggcatctttggaaataggcctttttctagagaaaggggaactggaaccattgttccactgttggtatttcttgataaattcaactctttgtggtagaacagtgcctttgtagatgttagttttcagactcaccctcctcttttcctgagcagcttgcagattggtttctgaagaggcgagatggaaccatgtgtacatcttttagccatatggtcctggaaaattatttttaaatgaaacttataagctgttttgacctccagtttacacttgcctacatgcctcactggtcccattagctgaacgtgcctttctgagcagtgcttcacaccatttcaacacatttggtcaggggaggagtgatgtcaacacatctggtcaggggaggagggaggaagaacatggatcatggaactggaacacctaagataaggtaatctcaggggacattgtgggcatgaacatcataaaaattcccagatcgctttccactttgaggttataagaggtgttcagtggctgcagatggacttattctagaatttcttccttcttgagagtgctggggggaaagattagcttccagctgactcacatgtttggcctcttgcaatgcagagtttttagttttcctatgagttgcatgtctagatactgacccattctgctcctggatgagggttaccacttccaaacaggattccccagtgcatggagcctttctctaaaataagaaagcgaaatcagaatttaacctctgaaaaggaaatggaaggatcaaagtctgtgggggtgagccagggtaaatgggaggtgggagatttcagtggaaactggaggtctcctgtgagccattggtgtgagtcagtccttgagccagatcgtgttgggagggcactggcagaatctgctgtcagcctgcaatgaagaatgtcctccactctaacccaaaggggtgttccctggtgaggccctgctgagaagctagggttggtctcgcttcatctctgtgtcctgaggtttcttgagaaaggttggttgtgggcccgcagagggctgtgctcatcccaccctgggctgtgtgagtactgcccatgctctctgctgaggacacctgtatcttgaggcaggaacagagacagagtgaaggtcacagggagagagaagaattttgcagccatatttggctggcttcaggcatttaatctgactgaatagggttcatttcttcagtgactagggcagtagattctctaggcacctgctgccccggggcagagcatgtgtttctgagaacctggtttatcccctttctattccagagcagctccggttgtctcactgtatgttttggaaactggttgtatccaatttagaccttcattgctattcactggctaatcaatcagcaaatatttgttgagtgataagcattgtttgcattgcagttggggaaatgagctactcatagaaggaaaattggcaactgttacaaagctgtgtttgaaaaaggccaaaggagtggttcagccatttcttatgggaacccaggggaggggaaagtcacagagggctaatctgatcaccagaggccttcatgccagtagttatttattacacgcttgccttatgccagcactttgctaagggccttcacaggccattattatgacaatccttacccgggaaaatatctgtactatggatattgtcttcctctttttttaaaacaggtaagtaactttccaggtttacacagatgctggagaaggtcattgactccagctctttttggctttctggagcctgggcaggtagagaggtgggtggaggaggaaggatactccaggtggaaaaacagcatgtgccgagctatggaggtgaggttcgtaaggcgtgtgtttgagtgacagtgagcagtgttggttttgccccccttctcttccacggcacaggccacatctgctatgtgtacctgtgattcccagcacagagcctggtgcagagtaggagcccactgcacgttcatggtggccagtggcctgagcctcacaggattccaaatgacagcgtgagtgtagaaccttctgctggtgccgtggatcctcttgactcagaccgggggtgtcagccaggtgtgaggggtagagaaggcattttgtccatccagtgacgtcactgcccagaaactgtcagcaaggaggaaggaaggcatgagttggtgaccgcatagtgctgactagctggacagggcataaactaactctctgtgtcaggagagctcctgaattcttcggtgtagagtccagagctgagggtcagtagattctagtcactagaccaccaggtctgactggctcttggtggtttgggtaaatctgtgcctctgtcttcatggaagtccagacccacttaacactcggaggctgcatgtttcttgttaagagttgtttgccatccagcacctcaacggttgtcagagctagaaggggcattagagatcattcatcctggccctcgctgatccaggaggaagcagaggtccagagagacatgtggagctcacggtgctgcagccagttaaactccaagcaaggcttcctgctccacccagtgccctccctgcacttgtgagtggggcaggggacgctgcccttgactccagaccaagcccccagtgggggctcagcagaatccccacaacaccccctaccagagggcatcccctcacccatcaatccaagatttacagctgtccaacttctcttgcctcgccacccttcccctctccattagtccatttattctgtggttggtagaaaaattacgctgttcagagcaataattgcaccaggaaagggttttctccccagtagtagagctagactgatactactgatcattttggtgttaggcatttaagacacctgacacttcaaaaagcctctgtcacccagctctgcattgcgttgacagtaaagcttaaatgcagctttgctttaacaatggagcactcacataaggaccttctctattccatctcctgttacttgtcaaaagacaaaattacaccacattcaaaaatcttaactggcttctatttgtgattctggaatcggacaacaccacattctgtcttacagaatgagtattctgatgagctgagcagaggagtttggctttatagacagaaaaaggctgaagaaagtagaaacagatcaaaaatctgattggttatttcggtcccttttaaaggttaaagcagaggagacttctgtatgttggctgaaactggcttgtttgaagatttgactgttaactcactctctcctgatcttggaaggtcagatcgacagcttagttttggcttggtggcgtggaacttcagcttgagggactccatcttggtttggtctcttgggccttgtgcaggagctcagtcccaaccaatggcctcctagaaatattatttaacagttctccccttttggtcaggttctcacctaggtgagagttactaaaacagggcatcagcactactctcagtaatcatcgttttgggttttcggtcttaacacatcatttataggttaaggtgtcctcattatcatgcgtttcttggagttttatcattccagctggagagagaccatttagcattcagcagagggctgcatatagatatttaagactctttgagaggatacagtgtaacagggaaactactgtaatgactctccccaggataatactaagagtttacaatatgacgcttagccagggacccatgaaccaaaccaactaaaattgaagagatcaaagaatgagccagatgaggaatttaccctttttaagcaagtactatttgttcatttttttgcaactgagtctcaatacactatgtgtctatccatgtgcaacagaaagtgtcagcaattgcacagattccctgttcgctagtaggtagcagttctattatctagtatcccatgactgggttaaattaaagcaggaagtgagaacacatgggtctaaaagtctgactctataaaagggaccactagtacagtttgaacaacagttgtgttagggatgttgctgaagttacccactgggcagactaaaggatccctttggtcatgtaaagatctgggtttagcgtgacaaatccaacagtttgtgaagttacccacagaagccactgattgtgaaattctaactacagcattatcctgccagacaaaaaaaggtagatgtaatcaaggataaagtggaagtcttattccaatgaaactcttgttcagaagttttgggaaagcatgaagttgtcaacttcttgtcctggtttgcagtttgattgtctctggttatggcattgggcattttggtgaactctttgtgtagcgtacacgtcaggcatgagacttgtcccttgaaatgtatatcaagttgttcagcttctgtttatagggctttaggcacagaacagttcctgttcttagttggagaattgtagctagttattggaagaaactggaagaattcagaattcaatccatcttataggtagatgataaaaacttgaaaatgatcaacaaggctacaatctaataacagatgtactatagtttttctttaggaacatattttttctctctatagtcacccccatttctaccaaagataatcagggtaagtgggaggcagaggtcacagtgagccgagattgcaccactgcactccagcctggatgacagagcaagactccatctaaaataaaataaaataaaataaataaaataaaattcagactaatttgcttgcagaaaatatttagtcacatcagacttggcctaattatttacataagtgtggcaagaatagtgattgaccacgtaggctcttcttaagtttgctttgctagaacttatcgataaggaatctcagattggacttttaacaacttctcaaggctaggaagtcaacccaagcccaacttcagatttcacctgcagtacctatagattcatcataggtatattctcaagtatggcatcacactcaaaaccttggtaatatgaccagtgtttcctattgtatcctgttgtaaagagagcagatacttattgaacttatgcaaataacagtattgccataaaaataggaatattcacaaatagtttctgaattccagagaggtcttgtagggagaaaatgtttccatttttgttcacaagagtatacttaccaaattgctgtaaactatagatagcttaaaagaaaataagttttcttaaatctggacaacaaaacattaaaaagaaccagcaacgtttcaaatttaaaaaccagaaaaacccataattcttcattagttcatttagtctcatgtaattaattcttgttgtgcttgatcttggttatcagttttgcagacccatcagtttttttcattagagttctggaaattctttcccagtccaatcgtattatctcgaagttatcagaaatggtacttatcagagacgtttccgtggatctccttgaagatgaagcacttcaggattatagttgcttagaaaaaagcttttagaaaaacatcagaataaagcaattaactgtagacaataagacttaaaatggttgtggttaaagatctgatgagagttcatagtaataatgacacaattgacaaggaaatctggttattgctgtgcatacaacattttaacctaataaccaaaattaaggctgataatgtatcatatttctaggaatatcatataattttggggatacaccttaatagcaagtataaacatacatcaataaatataactcaaagaagattaaacatcatttcttgtttgacaatgcttcccatataattaatacatcaaatgagcctaactagtttagtatctcccctttgcagaatctttgagatgttccagggccccctgaaatgttccaaagttacttcaagttcagaaagccttaatttagaatttgattttgggaagtttgtacaaaatgtcaaaggtttaaaattaaaacacttaatcagcctgggcatggtggctcatgacggtaatcccaacactttgggaggccgaggcaggaggataccttgagcctaggggttcgagaccagtctgggcaacataggaagaccccatttctatattaaaattttaaaaaattagccaggtgtggtggtgtgcacctgtggtaccagctacttaagcagctgaggtgggagaattacttgagcccaggagattgaggacaggtgagccacgatcgcaccactgcactccagcctggatgacatagtgagaccttatctcaaaacaaaaacaaaaaagcaaaacaaaaaaaatcacttgatcaaaataggatcacaggtcactgtgaagtcacagtcattcatctaaccagaatgataattaaaagacttcaaaatgaaaatatagaatgttacattgttgcagaaaaaacagctcttttatagagaggactccattttcttaagtaatcaaggacctagtaaagacaacatgaagcacagggaatcatcttgatgaaacaaaggatctttctttaggagaattacctaaaaggtacagaaaaacctttcactgtttccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttctcttcacaacttccttgtatccattggtttgtcctgtactgttcctctttctcattgtgaaataaccagtcactctactttagaacaaaatgactctctttttcccttaattaaaatacatccttacattttatgacttcctttataaaccgtgccatacttcccttgcatacagaattatgtcccttattatttttagttttagttgcttatattaattagtttttactccttagtaatcttaatttctagtgaaaactagcaagcattgtgaactgtcttctattaacattcaccatttcataatttctagaaacatgtttcctcagcttttcatgcttattacagacccaattatattctctatgccatacaaaaacaagatgccaaagcatatatactttagacttatgttcagcaattaatgtttcagtattttaatttacttagaaatgatattttatgaatatctatgacttaatttaacgtaaaataaccgtaagaggaggctggatatgtggacaggggccaaatgaagaactgccttctggttgtagattttcttctaaagtcagttagagcccccagagaatgttgaatagagattgacataatcagatccacagaaagaaaagatcatttggtggctagagaggccagtgaggggtggagcacattagaacctcaccaggagagaaataatatgttgatgtttctctggaagccctgccatgagaacctgtactagctcatgggacacggagggtaggttggaggtgaggtcagtaaaaaaccagatcacgggttcatgccaacctaggacaggcatgaagagatggaggtttgggtgagggaagagacttcagaggagagtggacaggatgtggaggcaggtggggatcagcaatcccctggtaggggcagagggattgcatcctgggcctggcatgcaacaggccctgaccatacctgcctttgtgcaggctgccttgcaggtgaggtttaaagccaaaggatgcaccccagcttgcagatacttggataggctcaagttgctatccttgtgtgctaagggagtcaagaaggctccccaaaaagtgtgtggtgggggggtgttgaggaggttggggaaatggcatcataggatgtagctcacctcactctgctaaatacttttgacgtctgactctggtaaatacctccatctacttcctcttcccaaccccccacccacctccctccttcgaggagtccagaagctacaatgccaaaagcagactaccagcaagaaaggtgggggaaagaagggggtggtgtggccacaggccttcctcccagctcgcagagccccctcccttgtatcagccccaagaagggccagcttagttgccttctttccagggatgcgtcagggtgtgccaggctcttcctgcatctgtctcgtggaggtgagggtaacactccttccccaggcgtaacgtgttcttaggagctctgataccttctgaaattgtgttcttctgagacgtcgtaaggagtaagttctagggtggagtattagggtgtttttgcattgataaaagtaagtacctgaggctaggtaatttataaagaaaagaggtttaattggctcagggttctggaggctgtacacagcatctgcttagcttctggggaggcctcagggagcttttactcatgacagaaggcaaagcaggagaggaagcaggagggggttgggaagtgccaccctattttaagcaatcagatcttatgagaactcagagtgagaactcactcgttatcaagggggcagtgccgagctgttcatgagggatctgcccccaagatctaatacctttcactacctaatctaatacctttcacctcgtctaacattggagatcacatttcaacatgagatttggaggggacaagatccagaccatatcaggtggggtcagaggtcctgctaaaactgtgactatcagggatgttattcagatattagtgttctgtacttaatgggtgctgggtgggctgcctgtgtaaattccactccctgcccctggggcatgagcttcaaatgggaattgtgcctgccaccaggcaggcctcctcctcctctcatctgcttcagagacgcatgtgggtccagctgccatggacgtcatcctgagctgtccaggcagacactcccagtctggtctcttcttgctcccttctattctggctcccatgcctcccaaaaaccctcctctccaggcagcctggtttctgccagtcctctcctcctccaccttgctcaggcagttccctgcccactggaccgacggtctaggttcaactctgtttccacctttcctgctgagcccatgccttggtctgcagggccgacctctccaaacttgagagttctgtgccacatgatttggcccctgccactgccctctcacggcttgtgtgtcttcctctgtgcgcaccttggcttccagctggagcagcctccatgtgggtggaactttggtggatgctcacggggcacctgacctggaacctgagctcaggagagctgcctggtatatgagcttgtttcttctcagttcctgggctgtggcccagaatggtgccattattctctctgccaatgtttcagcggccagcagccttgtggcccggggcctgatgcaggggccagactctggcctcaaggcttctttccccgcagttcctggattccagatgctcctgtttctgtctggggacccagttcctgataccctttaccccagtcactcaagctctgcccactaccagtatctctggccccaggaaacttccctaagggtcccctggggaattccagatcccctaaggcatgttctccaccctctggaactgatcccatttagagccccagggacaaaggcaataccagggcttttcctggggggtggggggctggggggatggcgaggagcagggcaaactccttcaacatctctcagcccccatccctggccccgattagtaatggagaaacagataccattatgaggcagtatgacttatgctaatcatccaaaacacaggttcccttttgtgagacgctagaaatgcagaccaactggaatatctcagaggtccttttccaaggaaggtgtgacctttgtcataagagctttgggatcaggtgctttgaggttggcaggggtgaggcattgcattaggggagatgggcgggcagagggggtaccagcccctcttatttacccctgggttttttgtcctttcagcctggaggccggccctgtatctcgccgccctggactgtgctgaggagaccaacagtgcagtctgcagagacttcaacatccctggcttcccgactgtgagggtgtgtgactgacaggaggggaaggcaggctgggcctgctttgtttccctttataagggaaagggaccatgtgggatgtgtcgggatgggcagatttcagctgctctgatttgagctgggaggtgatcatcacttgggctggtgagagctcccacctcccaaggtcctcttcaattgctctccctcttgacctccaagccttaagaggtctgatctaactctataaaaccaggattcaggctctgacccacctgtgggcagggtcagactctagaagcctagtggtcccccacaaagggaccccagacactctggcaagcctcagcctcctcaggcaaaaatgccttgaaccacaggtagctaagaagggacctgtcagggtagcctcaccccactgtcagaatgtcagtgcctcaggcagcagggatccccggcacgggagttatcacacccaaggcatgagggctttgtcacccccgctctggtggaaagtggcacgagatctctgatgatgccttacctgccagcctgcccagtgcagggcatcaacagcttaattaacgtctgaacagcttccaaggctctcaaataggaggccctggatagcccagggcagcaaggctgctgcagttatggtgagggccctcccctgggctcaggcctggctccaatccaattagttttcttccagattagagaagccaaattcaaatctctgtctctgtagcaccagctataaataatatgtaccctcccaccagaatggcatctagaaaaccagtttcttctgtagccattaaggattattaggaaatgcctttgaaagctgaaatgccaagcattgtccctggaacaagatacctctgagctgggggtaggggcagccaagtttcaagcagaactgtgagccagaactcagcttaattaccccagcagcatccatccgggaagtaaggccgtggctccaccaggaacatccagctctaactccatgtgacctttctgttcctcgagcccagtgcaacccccactggattcagggtttccacacctaatagaagtcccttcctaaactgttaccacatagggtcagggccccccaggccccaggtttagctgagaccaggttggtctcctgatagcgaaccaacagctactgccgtgtcattgaaaagtggcagcagagagtctgcatgtcaatcatccctttgaaatgaaaggccttcctggcagggacatggtgctatctttggccctaaggtgtgtaattgagaatattcaaacagggcactctgttcctttggctgaaccagggtgagtggccctgagtgggaagctgtgggcaagttagtgtggcacaaggaaccatcattcacaggctgatatttttctcccagtgagcatgagccgcaggggtgcagccactgcccagcccccaggggaggggttgacactggtacagcagccagggcaagacaaccgattggagttctgtagggcctgacacctgagctttctgactctgcctgggagaggctgggcacagcagggatgaaggaggcggcctaggcccaggaggtcagaggctcctcagcgccaccccatgtcacgcagcgcacgcagcctggatgcctcaggtgagtcaccatctcctgaactgcctggctggctgtgggaggggcactgggagggccctcgctgggctcctcagccctcccctgcctccagacgggcagcacctggcagggccagtctggtagtcatctgtccacagaccaacacggtggcctcccccggcaaagcctttcctgcctctcctgaggaacctgtggctcagttttggccagggggaggcacccagtgcccagtccataggccaagtggcttgagctggcaggtctctgctctgaggtcctatgcagcggctctcaaatagtttcttactgtgaccaactgtaagcaatacacatttttacattgtgatcccaaagttggtatgtatctattatcattaaaccagaagtttcataaaacaagattcttactaagtgcagttaaactgtgatattttctgttctatttttttttttaaatccggctgtgattaaatacattgatttgacagctcattacaaggttgtttctagtgtttggaaaacactactcaaacagattccaatatccagagattcggggccatgaagaacctgtgtgcccttggcagaggctgacctggagactgctggtgggccagagacatagccctgttgccctgcctgctgccctctgggggctggagcctgtccttgcactctgtccatgaagagctgaaaagcgagggcccatgcgaagcagggggaggagagagtgcttttggtatgatggggacaggcccacacacaagtctggcctccctgagtggcatgtgtgactgtccttttcttctgtctccagccccttgtcactatgagcaaacagtgagcttctaccagcccagcctgtttagcaaacacctgggccctgaagggcgggccagctgtgtcaggtccccatcaggttggagccagagcccagctggaaggaaacaaaggcgtgggagagggaggggctggttggctgcaggttctggctggagcttggcaacctagaggctggaacttccgggtcaaggggcttctccgtgggcctcaggagtgcccttcagtgggaatagaatgggactttttatggccgaaggcctggccggagcaaggggtacacagcacagcagcataggggtggggaagggcaggtcttctctcttcgaggctctgaggagatcagtgatgtggtttcaaatccaggcctctctgcttactgtgtgtggcttggaaagtcacttatcagtgccccagccgtgggccccagtttccttgtctgtaaacatgggatgataacatccacctaagaggaccgttgccaagtgtgaagtgaggtctcccatatgcaagtgccaccatgctagtgtgatttggacttcagtaaaagttagtttgcttccttcccgttgtcccatctcactcctgggccacccgtggggctgctggtagctggtgtgtggctgctgctggactgtgtggcagtccatccatctgtcagcagccactgcgggcctacttgctgggtgcccagcaccgcactcaccactgcaggcgtggccaggagcgtgagatccccagagcccatggccagtgagaggcggccagggataggtacccagggaatgccacaggagtttgctgggctcacggagctctttcactggtcagagaggagtgtgtgtaggagaggacttctacttggtgttgaaggacagatggggtttggctgggagagaggaggaatgtgggcgggccttataggcaggcgagaaggtgagagccaaggccctctgtgggcagggcgaggtggcgtgttgaggagactcgtccagctgggcagaggctcatgttgagggatgaggcagagctgggggaggagggagcccagaaatggcaggtccttgaatgcaggtttggaagcagggacgccctgtgagggtacagagtctgggctgttaccttctgtggcttttgctagaaggtgagatgtcagggaggaagacaggactccaggatgtctcctgtctctctctggaaaaaggaggtgggcccctttctcagcagtcagctgctgtttttgaggtcttctccatggataatccacggtgttggaagtggttaaggtaatggatcctcatgggcttaccataaaaatatctggaggctggaccattttccttaaaacgttataaaagctggaattgaatgccatcggtgtcacccctgggaagtgtgctttctcttgagctcttttggccccaagatagcagtcactccatagtttcgtgaagaccagcctggtgttgcctggttttctgccattagggagcagctagaggtcttccagtagctcctgtgtaaagtgatgaaagaaaagggctgggtgctgactgctcctggagaaaagcaacacactcccagagtcttaattgcctgcttccagggagctgtggtggtttcccttgggcagggcacacgccccagtggttgacttaataaggatacattttaatcagaggacaaaaatgtgccctgacttgatttccgcatgggcttccagcatggtcaaagggcagagattctctgttcagctgaacagatgtctattgagagatgccagacactgtggagcttgcagagataaataaaatgtcgtcctgcttcctggtcagaggtgggtgcatgggtgagtggtggattcaggttgaagttcattgcagctggagtggcgggagtggagggcaatgtgaggtgagtttgggtttggagcctggaaggccttgaatgcagtgagtttggacattattcattgacagtggggagtcatggaagagatttgaggaggagcaaaatgttcagaccagaactgtgccttagaaaactaaccttagtagcagtgaggaagatagctggagtatgaaaagattgagcatactaaaacttctgagagcatgaaaggtggggactgatgcagtgacccaaaaatacgtcatcatctgtcgggcctggtctagacaaggcaggtggagaaggagaggacttttgaagaggtaacacggaggtcaaattcataggacttgtcagctaactggatgacgggtttttgaagagggggatggtgtgggtggcagggagggggactggttgctgggtgaggtaaacacaagtggcaaagcaggttgagagaggggtgattcagtcttggggatggtgggggaggggctgtatccagacacctgagtggaggccaccaggaagaaccaggagtctaggacaggtgaggtctgagatgcagagggttcagatggcaaatcatttggacaaagtcattggctttggcaagggagaaatgataggtttgttcattgatccctttatccactcatcatttagaagcaagattgagcaacttctttgtgacagtgccttcaacagctttttaaacagaagagtgtcaggacctgacatgtgtctgtaggagagaccggggtaggagatgggggtggacagtgggcacaggagagcagtcgaaagtgaagctaggaccagggcaagggggccaagtaaggctggtcagtgtcaagccaaccaggggagggtggcaacgtgaaagcaacaaaggagagcaaccacaaaatgtggcacgaaagttgacaaatgctcgccatgggaagacaaagcaggcagtaataacatctgtaccagagagaggccaggagggcggggagagatcactggagtggctgaagagaaggtcaccaaggagcttccctagaacggcttcaactgagggttgtggggatggccagagagcagtctgaggagcaagggcagacgctgttccaggaacattggcagcatggggacacgggaaggaaatgcggttactcgagaaggaaggagggcctctcttcatccccatcctccttcccttcccatcctttccttttttaagggttagactagaaggattcgaatctatctgtaggcctagttgggcagctgtagtagaaaagaggaatgatgagagatggctaggaagaagttcctgaagagcgtgaggcgtgggagccagaactcggaggagacattggcctgggaggtgggtgcgaagcttctgaggacagaagggaacagctgaggtgcagcagggccttcccttcagcctgcatcctggggagaggctcttggggtccctgcatccccctgggccactctggctgaccgaggttcctggtcagactccaagctgcttgtggctgctgggatcttgaggggttgcctttttaaaatttttttattttttgagacagagtctctctctgtcgcccaggctggagtgcagtggcatgatctcggctcactgtaacctccacctcccaggttcaagcaattctcctgcctcagtctcctgagtagttgggatacaggtgcatgtcaccaaatttggctaatttttatatttttagtagagacggggttttaccctgttggccaggctggtctcaaactcctgacctcaagtgatccgcccacctcggcctcccaaagtgctgggattaccggcatgagccactgcacccgtcctggagaggctgccttttggtagaagtaatgcaagcctcttttaatatgggcacctgctcagatgtgggtgacctgatggttgatgacaaaaaaatgaccatattacttttcagaggtgaaaataacagctgtagctgtgggaaagccacccatctcaaggcttcatgatgtcagtgttgttctcatatatgtagaaaccagtcaaagtgtaacctgtctgtaaataaacaagagcaccatcaccatgaataactgcagcgcaacatcaccctcgggtttcttttttgtttttaaattttatttatttttaatttttaactttttgtagagatggggcctcactgtgttgcctagggtggtcttgaactccagggttcaagtgatcctccctcctaggtctcccaaagtgctgggattacaggtgcgagccactgcacctgacctggtttattatttgtcggcaaaccaaaccccaaatagatgtatcttcaattttgttcatgaaaaagtgtcagtccataaatgccgtaacttacattatcaatacgatctcctaatcaaggaaatttatgatcattttcttaagtattaggataacataattttaataggccaataaaattaaataactgtaaagaacgctatttaaatatgtgtggtatgtataagtggatggttttcatccacaataaaagtttatattaatgttttgaaaagagagagtaaagcagtgagcaggagtaagggcccgggggaggtcacagggagcagaaggttgcagatggggagagacaggtggcttctctgcagcctttgttcctcatgtgggagagggtagcaggtggcttccagattttctgcctacaaatgtctgtaacaaacaagtcctagctgatcatggttcctagtgtttaaaaggtatgaaggagggaaggggatgctggtggtgggtgatgatggtacagttaacatgtaccagttccttgatgtatgcactaggtaccatgctaagcactttagatgtatggtcatggaatcctcacaagtcttcaaggtagatggtgtcatcctcatttcaaagatgagaacacaaaggttcggagcagttgatgcgttgcccaaggtcacacagcaagagcaaagcagaaccagtccttgaacgaggtctgccagagcccggggcctgttctcagctgccagcttgggataaggccaaacagctctatcccaaggagggagaaggaaaccagtgtttggctgttggaggcagaagtccaaggtagtgaaaagtggccccgaggctagagtcccacaggaagaagcctcttcccagcctgcaggctctcccctaggcagttcagtggccggcttccaggacaactcaactgtgttccctcctgaatcggaagagcgcaggcaaaagccttggcagctgtcttgccgcctgggcagaagcccagattgccaggagtcaggctctgttcggtctgtcctcttgccccaaggaggtgacagactaggcttggggtgtcatgtacatgggaaaagaggacaaagtggtgagttaaatcagctagtctgtagcaaggcatgtttccccagggactcaggtccccgcttcaagagaacctgttctggagaccccttccttgactgtgtctgctgtgctgggctgggacttagtggacagagacagcagcctgtaagccccttttcccaagtaaggagcaagggcacattgacatagaagcaagctgacatttcccaagggacgtaggaagtgcctgcacttcatgttttcagatgagtctgcaaaggaaaacagcagtggtacttcatcactcatccattcgataaatattggttagtaattacatgctaggtactgtgctgcatagaaatggccctcgaggaggaaagtgtatgaactgctgcccacaggatccatggatgcttctgaggggtgtgggagggtaacaggggagggagccagtgtccagctcctagagcaacctccccccaactccccccaattcaccattttacagatgaagaaacaggctcggccaggcgcctataatcctgacactttgggaggctgaggcgggcagatcacaggtcaggagttcgagatcagccttgccaacacagtgaaaccccatctctactaaaaatacacacaaaaaaaattagtcgagtgtggtggtgggcgcctgtagtcccagctacctgggaagctgaggcaggagagtcccttgaacctgggaggcagagcttgcagtgagccgagatcgcgccactgcactccagcctgagcgacagagcgagactctgtctcaaaaaaaaaaaaagaaagaaagaaaaaagaaacaggctcaacaacattaagtgatttgcccagccaccgcattgaataagtaggcagattttcagagcaggcctgcgtggctgcactcttggccactatctattactgatgcccacctgtgtgtttgcttccagttcttcaaggcctttaccaagaacggctcgggagcagtatttccaggtgggtgcccagctctggttgtcctgttagcatcttcctcccccaacctccctcttcacctgggtttctattggggtggagaaagccctggcagtcggcagggtcgagggtgaggcggtccccacgggaagcctaacttgtgtcttcccaaaactatcctcccagtcagctttagggaaaggcaggatgaagaagcccttcaggttggacatatccagggccctagggtcggggcaggggcaccatgttcccagaagagctcttctgtcacaatggggttggcgcccagagagcagaccagagcccttggggaaagtcctgacgactcccagttctgagggattctttcctgtctgagggatgggtgtccttgcactacttggggccacaggaggactactcaagccccattcttctagcacagggaaggactgacgcctcgtctgtctctgtcagagctggctgtgccctcggccctttgtttctgggagtgaaggtggccagtgtgctgtggaagcagctctgctctcctgacactccgctcacgcctgttttcatttacagtggctggtgctgacgtgcagacgctgcgggagaggctcattgacgccctggagtcccatcatgacacgtggcccccagcctgtcccccactggagcctgccaagtactttgggctggggcaggcttagtgcattgtgggccaggatcccaggcctgggagtgagagggtggtgggaacagcagggcggggaccccagtttattttccttgctgcctttgcctgtggggctcacacaccagtctgctggagctactccagaaccaagtggcagctgatggctggtggtgggcttcctatcgcacaggtcctgctgaagagccctgtttttctggggctgactgatggtgcaagggtccatcccaccaggtgggaaggaaaagatggatggggcttctccaggttgtacctgctgctgtttcttgctaccttccctcaaaatgtttgcgggacgcagcaggatttcacatgctctatccccgggaaggccactgagagtcagaatggcatgaggaggaaaaaggagatcaaatattttgagggaaattggggggaggtggagagaaggtggtcatgcctggggcatgggggtggcccctggctctctgtatggcagagcatcaggtgcagtggccggtgctctgtatctgtcagccaggcaagcttcccagcttgcctcttttccaggaaaatgaagacagtaaggtgcatggtcttgcccatactttcccaaagaagagacagctagattaaaaacactaggccccccacttctggatcagaactcaagataggataatgcccacctcggaggactcttgccaagaaggaacaaatccatgtaccagcaggagctgctagagggagcccagccttgtacacagtggaggccccaggtgctaagaaggcctcacaaggccgctgttggtgcgcagaggctctcttaaaagtttgtgtgcaggtgctctcagagacatggccctgctgagagattgtgtttccaagtgtcagttggggttgaatccaactcacaatgactcctttgtcatctttcccaattttccatcctccagagggcctccaggggaccctggatacagcatagtctttatgtggtttggggttccacagccagaccctgtctctccagaaaacacccatgtcagcctgtgccctggtccttgctgcttctatttctcaatgactgtgtttccatctccctccttacacacacacgtacatcctcatggcacattttcagccctggggtatctcaaaagcaacagctcaagcaatcctgccaaggtctctcaaagtgatccttttttttttttttttttggaagacagaatctcgctctgttgcccaggctgggagtgcagcggcacgatcttggctcactgcaacctccacctcctgggttcaagcaattctgccgcctcagcctcccgagtagctgggactacaggcgcctgccaccaagcctggctaattttttgtatttttagtagagatggggtttcaccatgttgcccagggtggtctcaaactcctcagctcaggcaatcggcctgccttggcctcccaaagtactgggattacaggcataagccactgcacccagcccaaagcaatccttttaaagaactttaggaaggaggtagagatgtgtgatgaaaggtgagctgcctcttctgaagtctgagggtgggagtggggaaaggggtactggcccccatgtaggttgtgctcttctgccagcctagggaagacccagggaagaggtctgagaggctggccacctgatgccaccctaaaggctcaacacctcttttcctccaccccagcggggtgcactctggccctcacctgtctagcatatccatttggactgtcactggctgggctccagcatcaataccatgtttttgtttgttttgttttgttttggatatgttttgttttgttttggaaactgggcctcagtttcctcatcttaaaataaggagattgggttagagatatagatggcttctaaggtctcctgaacccaaggctttctgattctttcattgctttttaatgcctgctctagggaggaaggagcacatctcccccttggtcgtgacttgtcacagttccagacttatagctgttgggttctaataccccccagctctcaggggaccaataaaaaccacatccagtcagcctgggcctgccccagcacatggagacaactggtctcaaagcagcccttcccagtccccctccccacacggcctcctacccacttccgactctttttgtttgtttgtttgttttttggagacggagttttgctcttgtagcccaggctggagtgcaatggtgcaatcccagctcactgcaacctccactccccgggttcaagtgattctcctgcctcagctgggattacaggttcccgccaccacacccagctaaattttgtatttttagtagagacgggctttcaccatgttggccaggctggtctcgaactccagacctcaggtgatccacccgcctcagcctcccaaagtgttgggattacaggcgtgagccaccgcacccggcccactcctgacttttaaaaagagacaggaagcaaaaacaaaaccaagcacccaaggtaggtcagatgaagagccagggttagataacaagagcaacatcctttgagactaaaggtttggttgactcccttggagggccctgtgtggaagcggaggagggcgggatggccatacctgcagcactgcatcaccagcgtctggcgttgccagcggttttgtcttatttctgctggctgtgcagagtgactgccagaattgtctcttgcaggctggaggagattgatggattctttgcgagaaataacgaagagtacctggctctgatctttgaaaagggaggctcctacctgggtagagaggtgagctgccctgaagttccctgcaattcttggatagccatggagagagagccccagtttgggagcagggcttttcctgccaattctagggtcttggctgcctgggtcttttagcctggcattggcctgacccctgctgggagccatgggaagtgcaggagctggacctttgcgtttcaaaaccttgctgtttattcttatctccttcacggaaatcaaatataacacctgctgttattgagcattggaccagattgctgacacacgtagctgctaatccccaaaattaatgaaggtgatcaaatagcatgcccaagatcacacagctagtaagttggtagaagagggctttgaaccaggtccgtctggctccaaagccaatgttgtttccacagtgtcccactccatgggactggagtgaaatatttgggagggagggaacattagcgacgccctagccccaccggaggaaatggggtcctttacccagatgccggtctgtctcatgtggggcatccgtgagccagctccccagcgcttccagctgcagtgccctgtctagaaagcagggatgattacgtttctccgtagtattgttgggaaggtcaaatgcagcagtttatgtaaagggcctggattgcagctgacacatagtaggtgctttataaggatccattcccctcgcctaatgcagagagctcaccattctgccattggttcatggacttctccatagaccagttgtgagcttttcccagctgcaaaggtgggacgtgccagtgcacgggagatactccaagtcagtgcagggagacaggcatgagagtaggcatgaaattaaactgcactgtcagcctgagtgattttcctgctgaaactcaacaagcacagctgagagtctgagctgaagccagatgctgtctccaggcctctcagccctgagagaggaggcacaggggttggggaggggaaagacagcttggcttaaggagtgcctgaccctctggggtcccagttcatgcctggggtcatgcctgttatgtagaggtgataaatggtgattggaatcaggtcttttccctcccctcccaccacagtccttgagtaccaaggggctggggtcccagtggttggagccaagtgccccatgcccatgcagtggtgcttagcgtgggaccagtggctaagggcccaggttctggagccacactaagctgggatttgtagcacagttcaggcatatgcaagctgtgtgatctggaggcatgatttcacttctaagcctcagtttctccagctacaagataggagctttatatttatttatttattttgatttttgtgagacggagtttcactcttgttgcccaggctggagtgcaatggcactgtcttggctcgctgcaacctccacctcccaggttcaagcatttctccttcctcagcctcccaattagctgggattacaggcatgcaccaccatgcctggctaattttgtattttcagtagagacgtggtttcaccattttggtcaggctggtctcaaactcctgacctcaggagatccgcccacctcagcctcccataatgctgggattacagacgtgagccactgcgcccaaccaggaactttatttttattattttgagatggagtctcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagtagagacggggtttcaccatgttggtaaggatggtcttgatctcctgaccttgtgatctgaccaccttggcctcccaaaatgctggaattacaggtgtgagccaccacgcccggcctgggagctttatttttaagtaaacacttatgtacctactatgtgctagtcactgttatggcattttaataacattaaccccttcagttctcagaacagcccccctgaagttggtggtattattattattgttgttattattattttgcaagtaaggaaatttggtcagggaaaggtttggtgcagtggggccaggattccaatgcaggcaactgtagtgtacggtgccgcatctcttagtctcctgagaatagctgctatttcagtgtttctctgaagataaatgaggcaatctgtgtggacactacataatacctatgcaatacaggttagctagtgctttctctttatttctttctaaaaaaaataatgatgactgatgtatatttttctgattcggagtctagataggaagctttataaatataagaaaaaaggctagggggcgccacctgctccatggtgaagagtgagacgtcagtaacagaagtccgtgcctgccatttgcagatggcctgtccgattatgctcagaacttctcttcccatttctaatgtggggacattgtcatctcaacaaggcctcttgttgccttcagagagccccacgttaagaaacgttttcagatcttcttataactatacacattgaccaaagggcccctctgactactgcacatactgggctcagagttagcctgctgtttagaagtttacccaattccaaaggtttattttgtttgtatcctacccatgaaatttgttaccatatgtatttgaacgcaataaaatcacagttctttaaacatctgtgactcaagcttccataaggaagactgctcttgcccccaacaattgatatttcaaacaaacaataattagtaatttctaaagggatcttttccctttagaaaaatgttatgagaaggccctggggaatcctggacatcagagagcagtcttggggtgtgaaggtcttaaagacaagaacgtgctggctcagtgcaaaaaacaaacgagaattaaaatgaaaccacattttattgtgctctttacaaattgctttcattagaaagaaaatgctacccagttgggactgtcgtaagaaattaaagcgtgtgtggcatgcacagctccaaggcctctcctcctgggcagtgattggcacttgctacctactggttagctgctgttgatggcgagtatctcttgcgcatcagtgtggtccactctttgtgggtttagagtctggaaggagcacagctgccatctgggtgccttcacaggtcaccgagctgggacccagccctggctccctccacccggtggcctggcccccagatgttctgctgtccctgcaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgtgagtatcctgtctcctggcgtcccctctcgtccctccctgtgctcatccttccttcttgcccagaggggctgcccgcctttcacagtggccaacatgttctttctgaagagccccctcaggagaagctgcagtctgctgtctgcggggccagcgcctccaccgtcaggagcctgggcctgaaacgctaaccctgttccgcagctcagagacctcaaaggcctcagccccccgcacccagtgtcgcctgcaccctcattacgtccccaccacagccctggccctcttccccaccctcttctgttcgcaggcagactcattggcaggctacaggcctggcaagcactcgtatatgcctgaccctccctccctttggttttctaattgcagaaaagttcattagcagccagacaatagccagttccaaaatgccgagagaaaacaatcaggccagcctcagcccctctgccaggctcctgctgctgaatggcccgttaatggcaccagatggtgccttggtgccctccctgggcagatgattgatgtcagccaggccccgcaggcaggagcattgggccagggaggcaaggcttgcctgtggtgcctggtgagctgctcctcggggccctcagtgccgacccacacggcgccgggcagggtggccacttggcctcaccctggcccagatcacctgctagagggcccaggaggtgcgatgccaccaaggacagggaggcactcgctttccgggcaggcccagaaagtgccagtgatggtggggagagaaggcattgtctcctctctccgagttggtggaggggaaaattgtttgtgacgatgctgcctcccgagccatctgctcaccgagaaacccaggatggtggagtggaatgaagccgtgcgtcccatgccagctcccccggggcagccctcacgctgctgctggacccggcgtctctctctgcaggtgccctggctgtgggtgagagggaatatgcactcaggaggtatcccgtgccctggaggactcctccctgtcggaaaaaagaaagaaaccaaaaagaccgtaaaaagatttagagaattctggaggctctttgtcattgttgctacctgttttttgaaaaatcccatatcaaactccctggacttcttagggggtaatgtcacttatagtacctcagggcgagcttatggatgggcagctgccatattgaatctcggggtccttggggaagggagtcacactccgccgttcctgtctgtgggcaccgggctgtcccgtgcctttccatgccctgcctggagccagagggccactgggggaattcttgggcccaattgccttaccaggtgaggtttgacatcaggctggtgtcagagaggctttccagagcatgtgcagtgattagaagggttacagcgaggcctgggtgccgtcttctggcctcacagaggacaagatggaatctcgttcacatatttaataaaccttcctgtccgatgagccacccttcttcctcttctgacattggttagctctaatcttgttctctgcacttactgcctctcctccctggttctgtgccctcacaggctcatggaatccaggtccttctataccgcttacctgcagagactctctgggctcaccagggaggctgcccagaccacagttgcaccaaccactgctaacaagatagctcccactgtttggaaattggcagatcggtaaggctacgcctggttctcctcacttcttctccttcctctgatcacagaccaccacaccttcacacccacgccctcttgctcattcttcttccttgtcatatgattagtgtgtacattctgagccaggctgtcccccaccctggggtctggccatgctcagggaccttcaatgtgtgggagcggcatttagctgcggtgcctctggtgtctgttgcggggccggggctgactggggaatgaacaccttccatgcccacgctccttcagcttaactctgctcacaaatggggaatctgcgtgcaaggacactctgaggcctccagaccaacttcccacccaagcaattatttgtgcagtcaatatttttgagtactcactatgtgctaggcactgtggcagcagatatgtacaggcagatgcattctctgcttgtgcagaccctacagcatcccttctaggaaggcacccaacctcacttgaatgcctgtggtgtcagtgagttcactgccttttcaggtcacctgtgtgtgtgtccacagtcgtaagcatgagagagctgctcttctctctgaggctcgttgccttttctgttgtggttgggcagtgagacagagctgtagacctcctgcactggtaccagctgcataccaggtggaaatgtctgaccagggagctcagagctggccaggacggtgcccctcacaaggggatgcacgagacagtgggggaaaggtgattgcaagaaggactttgcatcctagcatgagggactttaagggtggaaagtgccaaatggagagacttttagtagatcaagggagaaggaaagagagagtgaggggtggtgtaatcattatgatcattccgtcattatgaatgatcatcataatcattcgatcattacagttatgcaaaccattgacgttcttgtaatagcttgggctggtgtatgtgccaggctctgtgctgggcaccttccctgtgttacctcattcagtcatggggccacttctggaggcagggcacaggaatggagaggtaaactgaggcccaaggacagcaaagtggaacacagaggagaccttgccctgaggaggagcataggcagccacaatgcgtaccccattagttgaccttattggctctttccaacctcaggaggttgtcatggaggggtcaggagcaagtcatgtgttttacaggtgagctgactgaggcccaggaaagtcaactgagttgcccaagctcacaaactagctcacagtcaaactgaggtcagaacccaggtctcaagagacaggggaagaggcacccaactttcctggcccctgccatcagaaccctgagcctggaccccagcatgatgggcctggggccagcatggagcctccggcccttccatgagggctgcggagaggtgtgagatgggcccacctaagatgtgaggtccggcagctgtgagcacatcagccctgaaagaaatacaggccctgcttcccctcctgcccccagtcgccatttcccagacttggtgggcagctaaaccctggtctttcagagagggcccagtttttccagagccatgtcgtgtgtatgaacctgctggtctgattatgtctagtggtcttggctcggagctggcctgattagtgagttgcaggaggggtggctgtgggcctggagagagaaaactcctactccctgccaggagctgctgagagttttttacatttgtgcttttatttgatcctctcagcaacttacctgtgagcaatgtgttattcatatcttacagatgaggaattgaggctcagagaaattaggtaatttacccaaggtcacacagcacatttctggcagaagccagtggtaacttacaagactctgtgaccatcagcagtgccccttctcttctctccctttagccctggatgctccttgcagcccctgcaccatggttaatacttctttctctctctatctccctctgggtcctcagctccaagatctacatggctgacctggaatctgcactgcactacatcctgcggatagaagtgggcaggttcccggtcctggaagggcagcgcctggtggccctgaaaaagtttgtggcagtgctggccaaggtgagcagggccatggcttcccttgtctgtgcaattctacggatggtcagtgtgcgttcctgtaagctgggcaccccgtcagcccctccctccagaagcccatggtctggctggacacctggacccacagctctccctgtccaccataggtgataccctccagcctcagccataccccacaccagccccacactgccagggacaaccctgccccatgcagcagtgtgggtgggacacagggcccgtgccccccacctggggatatttccagctgattcagtgactgtggctctgcctgcctgagtcctcagtcagagccccagtgtggcttcccacccctttctgtggtcactgggaaagcaggacccctaggacaccctggcgaaggagaggatgctcttctgatactccttgcttccctcccagtctgacccgatccctggccctggccatgccttccttattcctttatagtttccccgggaaggtggctactccacgaagggtagctcctatttattgaggacttgatgtttgtctaggatttaatccttttaactactctgcgaggtgggtggtttattttgtcctccccgatttaagaggcccagggagctcaagtgccatgccttcgttctgccagcctgaaagtgttgtggtcaggccttgagcctgtgctccttcctctctgaaggtgagaggtggctgccattccctctctgcgcccttccctttggttccagatcctggccattgcgtccctgctggaaaccctggactctgctgctcagtactgctgagtcagatgtggctctgggcgcttcgggtttggccgctggctcagcctcccttggccctggggcccggatctgagcccaccctcctcagtgtgggtctgcaggaagctggggctgccctcgggtgatttgtgcctctccttgggaacttcctgccagcctgatccctccttcccacctccctgtcctggccccctggcttggtcacatgaatgcgtggtgacactgagagggcctgacagggacatttcagcctaaggcaggacagtcgttggcccctcactgaagtcccatgcaaaatgagcccttgttcttcagtccattgccataatagagacctttcctccaaggctgagagctgtttggtcctcacagtgcagaggcctggggttgacaacctagagacttagaggggaaaaatccagaactgacccacgtacagtccctcctcctgacccatgagggagagcacccagcatgctttcccggcatgcctcagacaccccaccaccctagtccagtactctccaaaggagtcaccccaggaagatcggcttgtgtgtcactcgcatctctcagctgtgctcaaacctgctattttctttgtccccagtggggctgtttgcagccggtatgggggaaaagaatgagatacagaaaagtccctgagctgggcagaggcatcaccccctctgtgcctgctgagtctctgccttcagcaagggctgggaatgagcttgagatgaaggtgcctgccctgccagagccagggccctcggggtagggctggcagtggggtggaggacagagggaagccaggtatgccccgcagtagcagcagaggcatcgggggcatgggcctggagaccctctgtttgggttttgcccgcacatcccctggggtctgtagagtattctggcccttgccttgcttgggtagcttcttcctgaatagtagtatcctagcagctatcatttcttcagccctgccggtgcctgcagtgttctttgtatattagctcctcattctgtttctcagagaagattccacagcatggcttctagtatgatctccgtttcatagaaggtgaaacaaagccccagagaactaaagcaccttgccagggtcttccagctagtgaggggctgggcagggagccacacccactcgcatccagcccatgcccattaccaccaagtgcatggtgctcacaggcccgaacccctaagggtgccagtggacactgctggctccccctggctagctgccagccctgcaggtgcccggtcagtcaggaggccctctgcatgtcctgccggtgccttcccacccggcctctcccagcctgtgctccctcctgtgagcagctggtaggagtggccactgggtggcgtgtgggcaccagggtttccttgctcccagttgtccagagctccttaattcatccatccttctggcactgtcgccttagaaggcggaagtttctaagtcaggatgatggcaaaggtcagtgagaaatgctgacttcaagctgtaaatttgtgtgtgagttccagaggcccgtgtgggctcaccaggagggcacgtgtcaaagcgtggtcttttccggccatttctcactctgggggaaggtgtccagcccaacgtttgataggaatatttaatggctttctcagaggaatggatctgttagcaggttttcctgttcagttaccattcgtgtctccagtatccttctcctctcaaatgtttgtctttgctttctttgctgtgattttctcagggtcctcatcccctcggccagcctctttgtggttttatctgatcagcctgctgctgtgcccctctttctcctgccctccgccccttgtgctgtgcacgtgcacacacgcacacacacacacatacacacatatgtcctcctccctggagtccttgtggttttaaagtgctgatactaatcggatttgagttgacttattgtcagagtagcttttcatgctcctcagataccactgggagttaccatcaagatctggatcttggctgtgagcccctggcctggctggtcctcactggcagcccatggaatccaaatgaaaggtctcgtgcccacctaacccagctggccagtcagttggcaagtcagctctatccgaggaccacccaaagacaggactgtgtggcccagggctcccagcagccctggcaaggggcacaagtgctccagccttcctcccagtggtggcacatggtcggggggtgctgcacaggagcctgaggtctgagagagggagacttccaggaccccaccccatttagagcgagcaccttccctaccctgtcttctagccttaccaggtgtcccagagcaaaggtagtacagaagtcatatttgtgtcttagttagaatgttttcctggtggttttggaactttgcacaacctcctccccactgccccccgccccccgccccccgccttcttctgcatagcttcctaccatctgcaggacggggaacttggggaattgcttttcactctccagcttccgcttgttcctccccacagtatttccctggccggcccttagtccagaacttcctgcactccgtgaatgaatggctcaagaggcagaagagaaataaaattccctacagtttctttaaaactgccctggacgacaggaaagaggtgagtctgggaagcaaataaagatctctccatcctccgtatttatgagagtgcaaggggttaaccctgtcatttctgaccttcttcgccagtttgcaccagggagtcagtgatcttcgttgggtcctaacaataatcaataaatgactattgattgagctctctatgcgcacatctcatttaatcctcataatgttagtggaaggtagatattctccccatttagcagatgaagaaacagtactttgaaaaggttaagcaacttgtctgggttcatggagccagtaagtgtttgggctgggatgaaaacttggtgagaccccagagtttttaacaactaccctgtgctgcctcttagtttgtggtgctgctcagcatggcctccctggccctctccagggcaccttctgggctcctgctcatgctgctatttgcaaaagtgggtcactgcagccagcagaggtgtaaaaccctgtagacttgtagggtgtcaaatctcgaagggacctcagagataacccccttgtgttacagctggggaagttgaggctggaacgggatgcagcttgatctgggtcacagctttttaggtctgctgctgcttcagtgggtggaactggtgaaagggaaatgccaccttcgaggtgatagactgagggacctcatttgtcttagggctgtctcctagaagcttctgtctctgcctctcccatccttttccttctccatatgtgcactcacactcatgtgtccctcagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaccaatcccaggagggagcagactttaggaattcaaccagtcctgttttcggccccgggagctctggggctgaggcttctccctgtctttctccgggcttatagtttgctttgctttcagtcttcatgaaaaaattgtgattctatttttttatactcttaacaaagaaaaaaacgtgtattttacagtttacatagctgatacatagcaggtgctttgagcaattttattgcacttcccactgaaaaacaatttcctgggggaagttggggaaacacgtttcccctgctgcctcggattgtccacaaactgcaccaccatgttctccggccacgctgccccacacctgcttttgaagactgaaaggatgcgcatccaattcagtccacactgattgaggaaccaggtttataccaggctgcggcttggcttggaggatagatacatgggtgaaaagggcgacagtgcccgctcttggtggacctctagtgtgaggcagggggacagagaggcctgcagtgcatcagggctagggccgtggtggagagaaagatgtggggtgaagagagggcaggctcgacgccattgggaaggggcccgaggccttacggggtgagttgaggggtgatgggtgagtagggattccgccaggagaggagcatcccagcagagggagcagcctgtgtggagccccgtgaatcagaggaactgccaggcagtggtgtgggaagccagtgtgtatggagcatctccaccatgccatgtggcgctgcaggtgccggggacacagcagcatatgagacaggtccctgcccccacagggccagtatctgagtggcaggagacagacacagagggatggcttcagccatgatgacgaatgctgaggaagacaaagcaaagcagtgccggagcgggtgctgtctggagaggggtctgggaaaggcttccctgtggagggcccggtgctgggacccatgtggagaggagaaggcagtgtgggacgtctgggaagagagtctcccaggctgtgttggtgtccttgggctgcactcacaaatgtcaggctggggctcagccagtagacgtctgttgtctgagttctggaggctgaagtgcaaggtggaggtgtctgtgctggtttcttcgagcctctccttggctgggcggtggtcgtcttctccttgtgtctccgtgcagttgtccctctcccaatccatgtccaaatttcctcttcctgcaaggacaccagtcctattggattagggcccaccctaatgaccttattttaccttcattacctctttaaagaccctgtctccaaatacggccacattctgagaggctggggattagggcttcaacataggaatttggggggacataattcagcccatagcacaggctggagaccagcaggtgcaaaggacaagcctggtgtgtgggcagcactgaaagaaggctgctgtggccggagggagggaggtgaggctgcagagacaggccgggggcggaggtgagcgctcgtgggctcagaggccttggcgagggcagggtttggaggttggtgttggcattttgagaagccactggagaggctaacggaagtgacagttggttaacactttagaaaggtggaggatgggctactgcaggcagggggaggcagggcagctgaggagcaagctgcatgctcgcccagcagtggtggtcgggcctggactagggttgtcagtgtgcccctggaggaagtggtcagatttggggatatgttaaaggcagagctgagggacttactgatagattggaggaagggtatgtgggaagcaggactcgggtggactccagggttgtggggcctgagcctctggtggatgatggtcccataagctgaggagtcaggggctcgggttgggatggtggaatcaatggcccgctttgtgtcaatagacctcccaatggaggtgtgcacagttgagtctggagttccagggagaggtggggaatagagagattagctttatagtcattagtagcatcagagctcaagctgtgggactggatgagctccctggcagggaggtagagaagagtgctgaggactgaatcctgagcatcaaaccaccagcaaaggaggctgaacgggggaggccatggtgatttcaagggggccccagagtccagtgtttcaagatagaggtgtagtcactggggccagtgcagctggaggtggcgcaagatgaggacatctctagcaagggctgtgtcggtggagtagtggaggtaatggccttgttggattcggctgaagagagaccaggaggcaagattctggagataatgagcaggaactggggcatgactgggttagagggaacttctttatgatcatccttttccccagttggaatgatcccttatcaggggataaatggatgacgcagtaaagaaaaaacactaacgggagtgaaatcctggaggtgaggagtggggtaacccgagcagcagcggagacagaggctgagcaacgccagggccgtgtggtgaggccttgtggtggggaggtgggcacctgtgctgggtgcagaagaacaagctgagaaggcagaggagagagagagaggcaggtgtgggctgctgcgggtctcaccttgccaggagtgaggagagtagggtgccaacgtcctgctgcgtggaggggtaaaagcaggagattggcttctaaaggcctgggaggtttgcggtaggaaggagcgagcttggaggcaagcaccagcagccctggagcctgagggtgaagggcttaggaggggcgtgttggattaggagtggtgtcctcagcggggagcctggtttcagttagagcaagaaagtggggctggttaacaggtctttgctgatgccagtccagagggtccagtgggtgggagggggtggggggaatggaaggggagagcgaggagagatggagacagattaggaagggcatgtgcaggccaggtccaggcccgagggaggtgacgcatggtggaagcaagtcggacaggcagcatgagtgggcaggggaggaagggccaggggctagggcggtggccctctggcccctgctgacctctctcaccatgtcacaaagagcctgagtttcctgccaaggagtgtggactttgtcctgggtgtgagtgacaggcacccaggttagtggcagggaaggggatccaggtttaggagttttggggggatggggtctcctgtaaagtgaccatggcaggtagagaagtagacaaggggacactgggcctctgctggcataggctggggtgtgtggcacctgtgcaggggtggccacggcaggatggggggcggcagggtggcctggggaggcaacggctgtggggctggcagcctgaagggctggtgcgtggcatctcctctgccctgtagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtaaggaaggaccatccccaaggctggagtcacttgtgggggacgagggggtgaggatacttgggagtcttaggccaaaatttggggaagggacactcattgtcccctcagtcacagcccaggcctgttaaccaatgccagtatcatcagccccatttttgacatgaggaagccaaggctttgacactgtaagaccctggtcttcccatgccgttgctcactttttccctgctctagggcccctctctagcctactggggtccctctcccgcctcccctgctccgtcttctggctgttggccccttactcaaactgctagggcagagggagctggggttctctctccctgggaagggtctgatgagagaaggggctggaggagaccaggtcgttcctggaaataccaggcaccggctcccaggagggagccttgccctctgcgttccctcattatggtgcttccttttcctcatcaggagtctgatggctctaacaggcaaacacattaaactccagggagctgggtcgggagggagccatctgtggacaggaggcggtttgtgtgtcgggagggagcggtgcacgtggctgtgacagcctcccgggggggggagaccagggcggagccgaggttaaaggagctgaatggagcaggtggtggtgcaggcgcctgcacttggtcgtggtctcctggggcctcctatcgaactttgaaaggaagacatgtgcctgtcttctccttcccccaccccgcccctgccaccaaatgctccatttgacccttcagccccttgacctcggcaggctcccagctgctgctggagggccaggagcctgggcctgtccctgagaggccagaagcagggtggttccctcccctctctggtggggtcctttcagaagaaactcaaaattaccaggcacaagctgagagccccctccacaaggcctgatcactatgactcatgactggacccttgactctgcttgttgtcccctccccaaaataaccattctgacttgcatgccacttgctgttgctgctcctgcttccttgtagtcaacaacttgtccccctattaaaacctttaggagaagtgcttctacagaagggatgggctgatgcattccctgggcaacactgcgtgaggggctggtggccgtggctcaccctctgggactcatccagaggctgcctagagggctgggcccacctggggtaccaacagcctgcagccccagcagcatcctgactcttccaagtacccctcaggtctccccccaactatcccttggagcccacccctaccccagagggctgctgctgggtaaaagcaaggattgccatgagcagctgcctcttgcttgaaaacgcattttcccttgaattgacaaagtaacctatttgtgcagtttgtataatttggaaaatgtcagaaaaatgcaaaaaaagacaaacacgagcagaccgaccaaagactgcaaaacagatcaaaatgagtattcttgccctttcccatgtctggtactggggtaaaggctggttgtaaagtccacatagcaggacagtgggtctggccaacaccgggaaatgactgagatggcgctcttcacgcttccctggaaaaccacggagggccggggctgaggggtaggtggatctgcctcctcctccatgctgccatctgttgagctcccactgtgggctagtgtttgtaatctgtattttctaattacccatcctctggaagggcagtggcgagccctttctgcagacaaggaagctggcgttctgagtggaggagtgtggtctgggtttttgggtgggactgatgtcaccaccagcctgtgtatgcttccctctgtaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaagcattggtgtgttctttaacttgctacttggagacctagtgtccagtctggacagaatgcacagagaccagcctcacctggaatgcagccagactcgatgtccctcagcacacacagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggag

SEQ ID NO: 12145 - DNA, 17593 bp, Human
  misc_feature (1)...(17593): n = A,T,C or G
cacacacctccatggatgtccaggtatccctaagcacaggggaagaaggagtgggcaggagccaaggagtgactgtcccctctaccccacatccacccagagggaacaggggatctttgagaggtcttgcctaatgctcagccactacccccacccccaaccccaactatcttccccatcgcctggctcccagcttccttgctgtgaagctcagcttccaactgtccagccactgctaggcctcagtctgtgggggaaaggggtgggctcacagccaacagggctcagaccctggaaacttggggggaccaggcagacctgtgtggggagggctttgccgcttcctcctcccacccctgtggtgtcctagcttcctgttcttgataacaatcagcataggctcagagccgggccctctttccaacccccacctgccccctcctgtgtccccagggcccccactacccaccagtggaaacactgactggtgtggggggtgaggcagaggccagtctccaggtcactgctcgcaagcatgttagggattcccaggttcctgcttccctccagtctgtcctgagcacgggaaccaacccctttcccagccctaatcggcctcctcctcagggaaacccacccactccggagaggaacgcaggctgcagggaaggaggtgccaggatcagctggccatggaggggctcaaaaaagagccagcccctgtccccactgccaagagcaagggcgggtgctgggaggccttctgagcctctgggggctgttcttgttcttcgtctcaaccctcctcctcaaggggccagcagaaggccagccccctcccgaccaccccctccggcatgcctaccccctgtgcctagggtacctcatttcttttttgctgtcaccatttgacagctgaatcagggaagtgggaggaagaaagaggacgtggattgtgcgtgttgggggccgggaagggaagggcgtttgaaatgttacaaggtaaaaggaggcgtgcagcgagcatgaaccggctgggctgctggcccgcaaggagcctgccaaggtcaggcaggggcagtgggcagaggagtcttggacttgggggccacccttcaggtcccaggcatccaggcaccccagcagcgaagaggacatgggagtcccctggtgtgagggccagagactgtccactgtctgtaagtcttctaagtagatgtcagggttctgggaggaggcctgcagggggctgagggcccaggggaagcccctcggactccctcccacaagtggactctgctatctgcttcctgctgggctggcctacactcaggccgtgggctgtggagagctgggccgtggcacaggcgtggagacgacctttttggcctggccccggccctttccttcacattgtgaggcatggattcttgcttcttctttttccccaccccgagtctgtgccacatctgctctgggaagatgtggtctgtgcttggccatgaattcccaaggcttgaagcagcaagggctttgagggagagggctttgagggagagggccttgagggagagggctgtggggcagaagcagagaaggagaaataagcctccggccaaggtcaggttgagcaggagagccttgggttctttgtgggacagcacagagctgggggtcaggcgagctgtgcccagcaagtaggcagcggctggatgtgacaaagacccagaggagaaacacagaagaggggagagggtctggaagctggggaaagcaggatggtcgggaaggcctggcccctcacccattcccagggaacggggccttgggccccagaagggcacaggcgggaggcagccgacccctggtggcagcggcagcaggcacaggagggcagaatgcagctggggtgtgcgtgggtggcagcaaggaggggcggagggaggaagctggcttcctggagccttctcagccctcaaagacagaccgacagacagacagacagctggcaagaggcagcctgggggccacagctgcttcagtaagtatctgaaggggggactgggagtcctgtggccccggggggtgcgaactccggggatataagagggcatctctaggagggagtgcgggagggcgagtggggcgccacagtgcctggctggggtatgggtgctcacagacctgatgtccccaagacgggggtgagcagggaagccacagggagctacaaggagagcagaggctgaagggaccttttctgctaccagagaccctcgctctaccactcacacctgtgccaggcccattctgtcccctcacctccgtccctgctgccttggtgattcaacacccccgccacctcgcccactgtgaccctggctctgggagatagggactgcccccaagaggagatggtcccaccacctccatgccccctgtcttgcccccagctgtcgcctcaccatgcgctgtcgttcaagggcttggtgaggccatttcctgtgacggttacagaggcgggagacggggggatgggcaggaggaggaaggaaacacctccagcctacctccctggacagagaccccagaagccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggtgagatcttccctgggggaggggtcttccgagccctgagcccccattccgctcctcccttccttccatctgcccctccagctctgacagcagggtccagagggccctcagttgttgactccaatttggaaaggaaaccagtagtgctcatttgcatgtcttttgcatgtctggagcacagagtttcatatcaaccatgagcctgctccctaaattccaggcaaggcccacagccttcttggtgctggatgcatgtcggagccacagggcctggctgggagtgggaagaggcaggcagctggaagaagcagttgagttcaaggctgccctgttctggctgacaaagggagagggctgagccaggcatggtagctcatgcccaaaatcccagcactttgggaggctgaggtgagaggatctcctgagtccaggaattagagaccggcctaggcaatatagtgagacctcctctctctcaaaaaaaaaaaaaaaaagagggcacacagcaggggcccaaaccctaaatttactgggctaccaggttaaaggaaagataaagagcggccccctcagaggtgccttataacagtaatacttgtaagaaaagcaaatatggtcaggcacagtggctcatgcctataatcccagcactttgggaagccaaggcagaaggatcacttgagcccaggagttcaaaaccagcctgagcaacagaacaagacactgtctctccaaaaaaaaaaaaaacttaaattagccaggtgtggtagcatgtacctgtggtcccagttactctggaggctgaggtgggaggattgcttcagcccaggagtttgaggctgctgtgagccataatagtgccatcacactccagacctgggcaacagagagagaccctatctctaaaagaaaagataaaaagaaaagaaaagcaaatatgattgggtgctcactaggcagtggtgggctatgcctgcaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttggtaagaaattggggtcccctctgaatcgctctgccctctgtatcagaggcagccagctggaaccattctctcacgggcaccctgggcaagtctcccctttgggccccttaggaaagagaacttcagggctgagggaggggctgcccccaggcttccccttctgcccccaccccatctaggcctacatactattgtcaagaaggaatggccagagtccagctgttctagaaaaaggtagaaggagagaaaaggaggctaggagtcagctgctcacccatttcctccccctgccagaagatcccttcaaactttgtcagccccgaagacctggacatccctggccacgcctccaaggaccgatacaagaccatcttgccaagtaagaactgctgctgggatgaagggagtcgggtacagtccctggggctagagaacttcagaggacaaagtacacagtttcagccagggaagatcaaccttgcttggcacatcttctctcagcagagaaagggggaagaaggagcaagaatcacaacagcagcaataataatgtttgcagatatgtaccctgggccaggccctgttctcaatccttttttttttttttaagacggagttttcactctcgtcacccaggctggagtgcaatggcgcaatctgggctcactgcaacctccgcctcccgggttcaagcgattctcctgcctcagcctcccgagtagctgggattacaggcatgcgcctccatgcgtggctaattttgtatttttagcagaggtggggtttctccatgttggtcaggctggtctcgaactcccgacctcaggtgatccgcccacctcggcctcccaaagtgctgggattacaggcgtaagccaccgcgtccagcctcaatcctttatattcactcatttctcacaacaatcccatgaagttggtactgtgatgaccattttacaagtgaggaaactaaggcacagagaagttgaatatcttacctaagatattcaacttagctacttgcaccaagcccctttccctgtcttcctcttgcatgggaaatgcccagccaaggcttgcagtgaaggaagcaccaccaggagggctcccagagagatggctttgagaaagtcagatggagacagggcaacggccagcaagagagcagtggaggcggggagggaggacactgtgctaggagggggtgaccctgcaaactggcagacccggagcaagcaccttctatttttcggaggcaggcatgaggccccggagcctctccctccctcccctgctctccctacagggaagctactcccagcttgaggctttagctcagtgagcacccgggccctgtctcctgctaaccctcctggagtgtcctctgcctgcatgggcggatcaaggtgctattagcgctattccaggccagggggaggagtagcccttgttcttggcctaattctaatcagccctgcagccaccagaaaagggaaaaattcctttgcctgagattcccctggtccccagggtaccttctgtccatgaccaggctggcatgagcagagcgagagtctcttctcctttcctcacaagccagcttcttcatccatgtttgggtttcatttagagaaatccttcccccttagaggcagaggccaaatgcctcgtggctgagcggaatctgagtcctagtcccacttcacagctatgtgatatctggcaagttgctcatgtgaatcccatattcaccattagaaaacaaattcttcttcctctacatctctttttccatccctagtggcataatcttgttctaaacctgtactgatctcaaggatagaatactgtatctattagaatattatatctaatattgtatcttcccatttggtctctgctgttccgttccctttcttctctagtccatcctatacagcaccactcagttaatcttcccaaactattgttttgatcatgtcactctcctgctcaaaaacattatacagcttcctactgtctgcgtataaaatacttcaataggggccagacatggtggctcacacatgtaatctcagcactttgggaggttgaggtgggagaattgcttgaagtcagaaattcaagaccagcttgggcaacaaagtgaaacccaatctctacaaaaaacgtaaataaataaataaataagcaagccaggtgtggtggcatttgcctatagtcccagctatgtcaaaggctgagacaaaagtatcacttgagcccaagagttagaggttacagtgagctatgatcgcaccactgcactccagcctaggcaacagaatgagaccctgtctctaaaaacaacaacaaaaacaacaacttcagtgggtgtaaggccacctgctatacacaaggtgctatgactgtgatgagcacaggaactctcctctttctgaccctgcttgagtctgtgttagttggtcaccttctgacctctgacctctgctgatttttatttcctagatccccagagccgtgtctgtctaggccgggcacagagccaggaggacggagattacatcaatgccaactacatccgagtgagtggcctggctgcagtggtgggcggggaatgggggaattctcagacgtctgagaatatcttccagccatggctggtggatcaggtgcctgcatttcctaccctccctgctccagctcactgctgtcatagccctaccaagctgggctggtactgaacatgccccaaaacaccaacctaaaaaacggagcagatgttgaaaaatatctggagagaccaccaagtctccctaacctccactatcagtcctcccatgccaccctctaaacttagcaggaagttagcattgttgaacccaatctccagctgcttaagagctcacagctcccgagaactgcataggtgatgccagcactaatgggacctccccgccaacttaccttaactgcccctcagatagcccctcttatatgaagatggttgattgacgtcaagctataggaagctccaggccaggtgggtgttccacgccagcttctcgctgctgtgggccctaaggagatgtaaaagcagcgctctctagtgactcaatgtgggtaagacatcagtcaggggcgcagggaggcgaaaagctcttagctagggaagccatggggaaacatgatcttacatttgccggccaataccggatcaactgcagtctggatttcaccatcttgagaagcaggaagctgaggatcctgaaggtgagaaaatcaggttagggagagtgtgctacattttgctactactttcatagaaaagtagtaacctgtaaatgtgaaactgtcactgaacaaatattaaacactgtttaggtattttgtgctagaagaaagcagcaggggaggaagggaataaacatttatagagcacttgctatcggctagactctcaatatatcttactgaatttaatccactctacattcctacaagatagatattattatgcccaatttacagatgataccactgaggcttacggaggctaggtaactggcttatagtggtacagccaggaaacagcagaacagggatctgatcctcattccagaacccgtatcctttccatcatgtggcttctgagtgtgcgtgttcgtgcatgtgtacgtctacacgtgtggttcacagcttcaggctgaccccagcacctgaggcatctaggatctccccagagctctgctctcactgctccccaccccttcccctgtgcttccaccttccagggctatgacgggaaggagaaggtctacattgccacccagggccccatgcccaacactgtgtcggacttctgggagatggtgtggcaagaggaagtgtccctcattgtcatgctcactcagctccgagagggcaaggaggtaggaggcagagccacagttcatgatgaacccagaaagtgctatgcccaccccacccccaccccacacacagggcagctcagaaccagaggtttccctgggagccagccccagctcatacctctcagaaagttccctgagatatagccctgggaggctgtctatggccaaaatacgggatagggtgagcactctgcttgcaggtatcaagctcagaagagccaggctccctgttgctgacctcccatccagtaggggtggaggatggggaggagataccagcccctctctgctgccctgtcacctgctccagctgaccctcttctgactcccagctccctccctcctagaaatgtgtccactactggcccacagaagaggaaacctatggacccttccagatccgcatccaggacatgaaagagtgcccagaatacactgtgcggcagctcaccatccaggtaccacccccccggagccaggcccagtgggaagttgggccgcccacagcatctctgggactcaggctggctcttcactaggagccaagggtttgctcttctaaaccatcttaaacccacatctatagcagaaagagaaacttgagcactgtcctcagcctctagtctaatagggcagagccaataagccaaataggactaccgggaagtactcacccatctgtgtaaatggtcaggcggggacaggcaggatccaggagcagggccaagggaaggagaggaggttaaaggagatgtggaaggccaggtgtggcggctcatgcctgtaatcccaacactttgggaggctgaggggggcggatcacttgaggtcaggagttccagaccagcctggccaacatggtgaaaccttgtctgtactaaaaattacagctgtttggaaggctaagacaggagaatcacttgaacccaggaggcagaggttgcagtgagccaagattgtgctactgcactccagcctgggtgacggagtgagactgtctgtctcaaaaaaaaacaaacaaaataaaacaaaaaaagagaaagagatgtggaataacatgtacacaagggcttttaaaatgccttctattattttatggtgttttatatttttgaaagcattcctctatcaactcattctcctccaaatatcctggcaagtaaaccagtaagatatcactgttcccattttccaggtgaagaaaatgagatcaagggacttgcccaaagtcatgtgcttatgggaagcagagccagggcttgaatttgggtctctcccctctcccaggacaatgctccttcccgggattttgaagggggaagtggtggagaacaatgagcacgaaaattgcaacctagcttgctttgagtagatgacccccccacagggtaattccagcccttgccctcctcaggcaccagagaagaaggtagacagtgccctccaccctgaccttggttctcatgccttgtctccaatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcaggtgcgtggccctcccttcactgcagcctgtggactgtgctcccctcccctgccccctgggtctctcctggggaagggtctgagcagaaaagcatcaggcaagcctagtccttactcagacatgactcgcaaggccattcagcaagggctctgttctttttacctccttcacgcagaacccagacatctgggctggacacccaggccccatccatagaggggatggaatatcaggaagatcccagtcagctgcaggaggacataaacaggattccagctgttggggaactcatttacttattcaacaaatatgtattgaaaatcctattattggccgggcacggtggttcacacctataatcccagcactttgggacgccagggctggcagatcacctgaggtcaggagtttgagaccagcctggccaacatggtgaaaacctgtctctactaaaaaatacaaaaattagccaggcgtggtagcacacacttgtaatcccagctacttgggaggctgaggcaggagaattgctcaaactctggaggcagtgagccgagatcacaccactgcactccagcctgggtgacagagcgagactccatctcaaaaaaggaaaacctatttttgtcaggcacggtgttagctgctaaggagacagctatgaaccaagcagtttggtttcttcccagacagttttataggctggtgggaaagaaggcagattaggctgggtgcagtggctcatgcttataatctcagcactttgggaggctgaggcgggaggatcacctgaggtcgggagttcaagaccagcctgaccaacatggagaaaccctgtctctactaaaaatacaaaattagccacacatggtggcgcatgcctgtaatcccagttactcgggaggctgaggcaggagaattgcttgaacccaggaggtggaggttgtggtgagctgagatcgcaccatggcattccaggttgggcaacaagagcaaaactctgtctcaaaaaaaaattaaataccacgcaatgtgatgagagctgtgatggggatattatggggaccatagaaccaagtctcctaaaccagactttgaccagagaaagttttccaagagaaaggccatctaagccaagctaagacctgaaaggtgaattagccaagtgaagagagggaagggaacacgttccaggcaagtggaagagcacatgctaaggcccagagaagaaatgtgaaaatggatacactgctgggagcagggttacaggttaggcccagaggttgtgtgtggggtaatgatgagagatgggtttggaaggccagtgaaggtcagatgatgaggggacttggaggactggctaagacacttggatttgccattttaaaagaacactttggctatagagtgaaaaatggattgggccagagtgagggggtgtcgtaggggacaagactaaagaaagggaccatttgggagtgcatatcctaaataaaacagagcacagaggcaaaaggcatgacacaggggcctcccagcccacccacaggtagcactgggacatgtgcagggaggtcattaggggctcacgcaagaggaaggggaggcctagggggttttgaaataaagagagggcacgatagagaaagcagaacagagtggagagaagactgtgggagggcgccaaggtgggaaacagaggggccgggcgtgggctgcgtggaagatgagtctgagctgagaggaagtcaaggttagataaggagggctcgagggtcagcacacccacaagtgggaaactgtctgttggaaaccactgtagactcagcagaagggagatcgtcaaaatgtccacagggaccaaaaggtggcctgcaacaggcttacagtaaggctggtaagaaatgtaaactcctcccatgccaattaaaacctgcctccagcagggcccccaaggggactggaaagcagagtactgctacctgcctccatctccagagccctatccccaaaatatagcacctgcaggtcccatttctttctccatagtttggggcctggctctcatattccctggtctcccatgacctccctgtcccctccctggctatctccagtgcagggattggccggacgggctgcttcatcgccacgcgaattggctgtcaacagctgaaagcccgaggagaagtggacattctgggtattgtgtgccaactgcggctagacaggtgggtctgtgggtgtaaacaaggccaacaacgttaacggatggcatcagtgcctctgggccccagagttctgctaggcccatcaccatcaagcactcctgcaagaaaggaagaaaccctttctgcttagagctgtttattttacaactaacaaccaggaaaaaatatctatctggatggccgggtgcggtggctcacacctgtaatcccagcactttgggaggctgaggcgggtggatcacctgagcccaggagttcgagaccagcctggccaacatggtgtaaaccctgtctctactaaaaatacaaaaattagccaggcctggtgcgggcccctgtgatcccagctactcaggaggctgaggcaggacaattgcttgaacccaggaggtggagattgcagtgagccgagattgtgccatcgcactgcagcctgggtgacagagcaagactctgactcaaaaaaaaaaaaaaaaaaaaccaaaaaaaagaatatctgtctggaatgttggcttggatgcctggaattaaacatgatatgaggcagcaacaagtagtgcaaagaagatcactgggtggaggcagagccggtgttcagattctgacatctgtctcactgagatgtcactagatttctctgagcccccatttctttttttttctttcttctttttttaataatagagatgggggtctcactatgttgcccagactagtctcgaactcctgggctcaacaatgcccacttggctttgcaaagtgctgggattacaggcttaagccactgtgcccagcccccacttcttctttatctagacagagataatggctccttcccccagaaaactgttgtaagaaatgagttaacttatatgaaaatgttttggaaatggaaactactatacaaatgtatggaatcattatttttactttttaagattattagaaagaaggaaacttgaggctcaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcatcacccctcagcacgtgtaaggggcagagacttctctcacagcagtatctgaggggcagcaatgaggagtagaaagtagaaaagatgaatataggtggtggggcatggtggctcatgtctgcaatccaagcagtttgggaggccaagatgggccaatcacttgaggtcaggagttcaagaccaccctggcaacatggtgaaaccctgtttctactaaaaatacaaaaattagctgggcaaggtggcaggcacttgtagtcctagctactcaggagattgaggcaggagaatcacttgaacctgggaggcagaggttgcagtgagctgagatcataccactgctctccagcctggctatcagagtgagactctgtctcccaaaaaaaaaaaaaaaaaaaaaaaaaaagtgaaaagatgaatataggcaaaggagttggcatgttctttgagaaagtcaggactttcccagtaggaccacagggatgtttgactggagccattcagccagcaccctgaccctccttcactcatggtctgtgtgtttctccttgcagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgactcattccttctttccatcttcttcttggccctctggggcctctttgtagcaagagagaaagactgcagaccagggacaggcaggctgcaaatctttgcccttgggatatgcacttttctagcacttccaaggacataaagtaaggtgaaaccaaagtcaatttaggaagtgagacagggtggaccctcatagcctacccaggcagctgtaacaattcacactaccgtaaaccatgtggcttctaaacaacagaaatgtattgctggcctggcgtggtggctcatgcctgtaatcccagcactttgggaggccgaggcaggcggatcacgaggtcaggagatccagctaacacagtgaaacgctgtctctactaaaaatacaaaaaattagccggacgtggtagcacacacctgtagtcagctattcgggaggctgaggcagaagaattgtttgaaccctggaggtggagggtgcagtgagctatcatgccactgcactccagcctggatgacagagcaagactccatctcaaaaaaaaaagaaaaaagaaaaaaagaaatgtgttgctcacagttctggaagctgggaagtctaggatcaagacccttgcagactcagtgtctggctattaggcagagccttctttctgtccttgcatggtgaaaaggttgtgggctggtattcttccccctaatcccaccggccccctttataaggctctaccctcatgacttaatcacctcctaataccatcactttagggattaggacttcaacctatgaatttggggggacacaaacattcagtccatagcctttatcttaggagctagaggaggacttataaagggcagaggttagaaagatggtgcttaataaaccagaatattggccaggctcatgcctgtaatcccagcactttgggaggctgaggcaggcagatggcttgagctcagggcttcgagaccagcctggacaacatggcaaaaccccgtctctaccaaatatacaaaaattaggctggcatggtggcgcatgcctgtagtcccagctactcgggaggctgaggtagaagaatcacctgagcccgaggaggtggaggctgcagtgagtcgagatcccaccgctgcactccagcctgggccacacagtgagaccccatcaaaaaaaaaaaaaaaaaaaaaccagaatattatgctagccgaaaccttgtgattcttctactttggtaactgtttgactatttggggtcatctaactccagttgattggacagatatggttgatattgatagtttacccacttttgactaaaacaatagactacatatgactacatttgaaaaccaaaccccaacgggcagccagcataggctggggactgcccgaagcctgagcctacccgggactgccagctgaggttgtcagcctgcctgagcaggtcctatgggtgggtcttgcaaggagaggggcaggagtaaggcatctttgcaggcactccagacccacttcaagaggagaactatcacttctcctcctgaagaatactctgcttttcaccaaaacagggcaacattttcctttgtcacagacgttcctcactgaaaaccccctgccaggactgtatctgtttgggtatcttggggatgctggtaaaaatccggagcaagttcaagcgtccgtttcacttggggccagaggcttcctaacaagtggtcggggtaaattgtggtgaacaaaacaagatggagtattaaaagacccgaatacggttgtccctctgcactgggtgcattttgagaggatgggactgtacccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12146 - DNA, 92363 bp, Human
aaatacagagtaaaagttctttactcttcaggtgacctaggcagagaaatagggagtttttttgttcccagaaatacacagatgttctaggtttgaccttctttgagtgtttgttaacttgaaaggatttgaaatctctggtctggctgtagattaaaagtctgtagaatctctcgaggggaagaaacttcgttttttcattaagaggtatttttaaaagcatgttttctaaaagaattgaagcaggccaggcacggtggcacacgcctgtaatcccagcactttgggaggccaaggcgggtcgatcacttgaggtcaggagttcaaggccagcctggtcaacgtggtgaaaccctgtctctattaaaaatacacacacacaaaaaaaattagctgggtgtagtggcacacgcctgtaatcccagctacacggaaggctgaggcttaagaattgcttgaacccgggaggcagaggttgcagtgagctgaaatcgcaccactgtactccaacctgggtgacagagtgagactctgactcaaaaataaataaataaataaatagaattgaaacaattttcacttttttcttttttcttgttttaactttcctcaaagtagacacagtagatatagtagacaataacatagctttatgtatagcctatttgaaaaagaaaggaatatgccatccttcccgctgatttgaaaattagaatgtggaatttcatttcttttggcagttgttagggatggtgctccaaaaaagcaataaaaaattataaaacttgttgcaatattttgcttttctcacttgtgtacaattaaatatttttgctctttagttattgggagcttttctaaaatcagttttcagataaataaccgtttgggtactgaagcagttgctaaagggcatacagttagggctgaacgctgaataaatgccattttttttttaacttgtggagagctgactatcaacagtagtttccacaaatgagagtttacatggctgtcttcttttggctggacaattagggatgaaatggctttaactactggatgataaaactgttagctgtgggttgaacacttggtagtgattatatttgtcgttagcgctatttacataagatttagggaggatacaaacctatacaagagaaaagggaaagtgattgggagaaaagaatggtcaagctgacaatccttttggggtctttttctcttgctagtgtcaggggatgccaccgggacaaatgaatgctttgaagtgagaagggcaaaagctctctaataaaagacttcaggaaagagtgcaggcgacctggggaaatatgctgcggtcaagtttaatcctgggaaaaagtggtcctggagaaagcagatgaggaagataggaaggaagatagggagggggagacgctgggtgtggagggaggaaaggggcgggggtgggggcctggaaagtgacagggagcaagcactaattgtggctaaggcgactgggtcgagaaccacagactggggaaaagggagagtacgggaggaggaggaggcagagccccgcggagccggaccggacccctggccgggaaggtatcggcgcggggcagcgggggcagcttggcccacatcgggccccttggcaggctcaggcgttggctcctcggggctccctccctcgccggcgcattgttcctttgccgggagacgaggaaattgccttttgattgcggaagtcagcggacggggctggggcgaggcagcgcgggtcagaatggcagcgtgggaagggcggcgcgctgcctgtccccgccgcctctcgcgtccgcagcccgcccggggcggcaggagcagcagcagcagcggtggccgcagtggcccctgcgcgtcgccagccccgagggaagcgcgctgcgcccacggggcgcgctgagcgcgcgcaacaggtgaccccctgccccggccctcgggccgtcccacgtccagccccctcggtctcctctggatcttaactactgagcgcaatgctgagccatggagccgggttggccttgtggatcacactgagcctgctgcaggtgagtggcccgagaaggggtcagagctgatgcgccccctccccgccgaaaaccaaattcccactccactttctcgtctatcgggttgtgctttgaagagggaggtggcaaaatttcttcttctgccttgggaagaatgatcctctggtgagccccccaacccagaatgacagcttatccagctgtcaaagcaaaaagccaccttctctctccagctgctctcaagggacagcagctagggagaaagttgccatccacctcccctgcaagcctcttctctggccagagggcaaaaggactggctgaggcaagggacaaaggataagtagaggagaaagtgtggcttgaggagcttgctgtggacatgtccctgagcagtccagactgtggacttaaactgttgtgtctgattcctttgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacaggtaaaggatgacaggtgcaattggatggccaagccacacggggttgggccctgccttttcaagctggtgtttcatttgagttccagggatacaaaaaatgaaggtaaaaatacctgtgaagataaatattgacagaaatgtctggtttcctcagatctagccagaagcagcttggtggactttcagagactcccttagtgctgaaaacagccaactagctactgaaagggtcggggtggggtgcagggcggtcagcaaagagaaactttgggctgcggtgggaattttttaaagtgatgtggtttaagcttccattgcattaaattgtcaaaccctggaataattttaagtaaacgtttttagaataaataatagaagtacaatattaggggtatgcctttcctcaacttagttttatttttagaactgtacataaaatctgcaggaatagaatggagccattcatcagggaaaattagaaaagtctcttgaaatgaggacatgaaaattgttttgtatctcttgagtaataacccaaacagcatagtatcagagaacgtcctttgattactttacagcaattattttccttacacttttgctgaatccctccatgtggatatgttcagagtttgcctttcttgcctcagttttcttatctgtaaaatgggagtgttagacttaggtcattcaagtccaagttcttaccaagtgctcaacacttaggtatgggctgtcatgtacattacctcatttaatcctcagagctaccctcagacatgctctaaattctttaacaattttcaggttttctgacttcattagtcttcattatctctatttgttgcaacagtgtatccttaccttcatccagagattcaaatttatgttaaaattttaaaagtcaaatttagaaatgtgttgcccttagtattctttcacatttcaacctgaaacaggatcatttcttttgctacagttcttcaaagaggtgtgagaactttcagctctaaaggcaggtgcagcagtttcagagaatttaactgggctcatgtagtaagtcaactagatattatctttttttttcaaagaaaaaaatcaaaatgcccaattacatcacttaacttacttcagatgaaacttttagatgatatctgagatttgcagcatcttaagttgaaaagagaaatcgcttgttaagaatctggtggtttctctgactgggcgcagtggctcacacctgtaatcgcagcactttgggaggctgaggcaggtggatcatgaggtcaggagttcaagaccaccttggtcaacatggcaaaacctcgtctctactaaaaataaaacaaataaataaataaaaaattcgcctggtgtggtggcgggcgcctgtaatcccagctacttgggaggctgaggcagagaattgcttgagcccaggaggcagagaagccagattgtgccactgcactccagcctgggcaacagaggagactctgtctcaaaaaaaaaaaaaaaaagaaaaggaaaatgaatctggtggtttctaatatggaatcagagagcctgaaatagaccacataattagaacattttacaaaagttgaaaggctgggtttttagtccaaatgttgttggtttcttaatattacaggatagttcttataaatactcatattgctaatactgtgaaatacataacatagaacttacagatgtgttaattgtgtttagaaaggcatctggccaactagtgtatgtgttcagtggagcagagcaatttgtaaaagcaggctgagctttcagaagtttgttggagaaaagattaagacctttaagaagccagaatatggttgtttaaaccagaggatttactttttggaaaaacagtaatggaaaaggacttactgtgggtgtaattagttagaataggctttgagtttaattatgcaagtaggtattcaagtccagaggcatttctgaaatgtaagaaatacttgcattttattgaccatgttgagtgaaacaagacttcatcagcatccacaatgtgctagcattcagggttctcaccatttttcttaaagagacacactttacttgtctacaaatattatgagctgcatgataaatgtgaagcatgaaagttgcaggtggtatttgcataatgataaatttcccacatgtatttgtatgatggttgtttagatttaaattacttttttaaataagatattttaaaaattgtttcagggaggaattttttagtcggttgttatttatttgtcagtagttctttctacattttaaggacatatgtgaattgttcacttagttaatacaaagtactagtattcccctatgttaattgctgagctatagagatgagatgcataaatcatattttactgttattaaagcaatgccaactagtataatattcaaactcagacaaacttcaaacaaaaaagtaattgaaaatatctgtgctttctttattctattatgcctgtcttatcagtctaaaacaaaatagaatgagagcaagacatgatttggatagaaatatagttgttgcttagatgatctctatatcattccaaatgtgactggcctgattatttttcctgataaactgtctaaaatagctcattattttcatgtcatatagacacgaccttaaggataaaaaaattgaattaaatgggcaatatttcagcaatagtcattttccattccagatttaaaatcagaatcgaagaacataatggatttaaacccagttcagtgcacatgtatcaaacataatactgttgggaactatgccaggtagtgattagtaagcttataaagatgactaacaaaaagtggttcctgaccttgttgtctcgtgcagaggtgagagacggttatgatgaaagtggcaacagagctttatctcatcttttctggatgaggactttactctgcctcatgtatgccatgctttcataaccatagaggacaagatatttggcaattctcaggtttacttggtcattaaacggtcaacgcaacaagaatatcctttgaaagccaaagtatttagtgtgaactcaccagaaatcagacaatgaacataccagatatggaataagttggcatttttttttcacttcttgtagagctcttcttaaacttggcacttttgaagactgtactcagagtctagagcagaggttgcaaactggtagcctctagagatagctaggtgtctaaataataactatgttgtgtttggctcatgtagtgtttgtgaaaacatccagatcatttcaccagcattaaaaatcaaaaattcacattaaaacccaaatgtatggattctcttaaaattttggaagatttggcaaaactgtgcctaaaactctctagagctgacttgtgtcttctccttttagataccaactcactggaataccacttcattcatttccttacctgaatgcattctaaagacatttgaatttgtgacttctactttgtggttttcatttgaaaattttagggagcatttatttgtctggcaataagaagtaggttttcagtacttaaatggcatctaatacatggtaggtgttccgtaaatactgattaaatggatggatagatggatgaatggaaagatggatgaatggtggatctgggcacggatgatgagtagaagagatagatagaccaatatatagatacagataagcatgtagatgtgaatgaatgaaattaatattttagtgagagaatgtacatatactaaaaatatattctattctcattggattatgggtagattacagagcccagggaagagttgtagtggtagataactttacctgtagaaataatattttaaaagcattttccctcttgttaagtcagtttcagctacttattagtcagcctagaaaaataaaaaacaaaacctctcaaatgattttaattattttaatatggctaacttgtctttaataaaaaacattttaggaacgttaattgttgaatcaccatatcagctattatttccacttcttattgtattggtttactaggagtgtcttaacaaaatacccctgactctaggtggcttaaacaacagaaatttattttctcacaatcctggaggctagaagtccaaggcgaaggtgtctgcaggtttagtttcttctgaggcctctccttggcctgcaaatggcacctttttgcatgtcctcatatagtggtacctctgtttctgttgtctgtctgttaatgtcttctcataagaacaccagtcatattggcttagggcccgctctaatggccccattttaacttaatcacctctttaaaggccgtatctccacatactgaggtactggggtttagggtttcaacatataaatttggtggggacacaattcatcccctaatacttctatagttttaaacataagccatcatttcttaatatctgtaggttacctgcatcgaaatatcttgcagagctggttatgaaaacatattcttggtttctaccccacatggaaagaattagaatttagaaggaatagagctgagggaatctgcattttaaacaaatatcagagtgaatcgatgcacacaagtttaagaactattgacataatttttctattatttgttggcattaagattttgatacaattcttcttaatgcatgatcaaatctataatgcctaggagtatttattatctttcccaggaagagaagagtactctagtatttgttttgtgcttctttaaaattttattttatttttttaatttttttcagacaggatcttgctctgttacccaggctggagtgcagtggcacaatcacagctcactgcagccttgacctcccaggctcaggcaattctcctgcctcagcctcctgagtggctgggactacaggtacccaataccacacccagctagttttttaaattatttgtagagatggggtctccctatgttgctcaggctggttttgagcctctgtggccagcctgttttgtgcttttatagcatataaaagactaccacatattatgtttaattggtaacagtatgaaatacatattatactgaccatctatagcctaattttattctcatggcaaccctgtggagggggtattgtgaaagggcagtttgcatagagactaagagttgagttttgaaggtagactgcctctaccgcttactagccacgttattttgggcaagttatttaacacttccaggtctgtttccaaacctacaaaatggggatagtataacaataactcatggggttgttatgaggttttcattggttcatacatcaaatctagaaaagcttttgtcacatatgaagtgtgtagtgagtttcctattattacttccaggttggagatgagattggtcttcataagaattaactgacaatgtttacgaattcacacagctaacatacaatagagtcagaacttgaactctggtttactggctccaactccagtattctttccactactctgcgaaaagtatattatttttaagttggcattagctttttcaaattaccacgtgttattttattatttttcaaagtcaagtccttttaaagaggaccaaatatcttataaaatcttttaaatatatatatacttagcatacacaaaaatagaataatggttaaatatgttttagtgtgaagcaattgcgagtcactattgatctctgattgtgttgaacttttggtgatgacttcagtattttgtaatcagccatttacagttcatttatttcaggaattttaaggtcaagctgagctacctatatggaatgaaccagcccagttctctgaaattggtcttcctttatgtgcctagaaatatttctctattagtctgacttctgttggtaggcatggcactttacacattagctaggaagaaataaaatctaatttgtctggacagaatgaaaaaaacaaacaaaaaaaaaacaaaggaaaactgtttgccttccattcctagatgccagtttgctggaatccccctgggaataaaagataatattagatttttctgacctggtaggagaaacaaatcccattctatatgtatgaatgtgtataaattaagatgcatatacccctaaacatataatatgaaactaaaatgaacacagtaagtatatatctaggtttgcagggatttttgtttttgatattgtgttttcttccttttatatggaaaaactcagtacctaaaagggtaaaaaaggatagtataatgaactaccatgtactcatcaccttccttcaataattaccaatttatggccaaccttgtttcatctatatccccacccactcccccactgcacatcattttgatacaatccaagtcgtgattatttcatttcacttgtaaatatttcagtctacatctctgagtaataaccacaatataattatcacatctaacattaacaataatgccttaatgcctagatgtccaggtttagaagtacatatcaagtgacagctcatgaatttctacataagaaggcttttggacagcaatctgattagaagaggggtccaggggacttctctgtatattgcatttatacagcattttagataatattgaaaaagcctcagttattgatattaaataattgggctggaactactgaagaatatcatggggatgagggtgcattagtcttgttaagttgtctgggtgccctcagtgctgacatggttctctaatattcactaaaagtgagcttctaattttagatctagtgtatacagatgttacattaaatgcacagcaacctgatgtattagcataatttaatgcatcatctttaaagtaagccagaaaactgactattgtcaaacagcaataataacaaagtaaaagaaattatctctcagctagatgcggtggctcacgcctgtaatcccagcactttgggaggccgaggtgggcagatcacaacatcaggagatcaagaccatcctggctaacacggtgaaaccccgtctctactaaaaatacaaaaaaaaaacttagccgggcgtggtggcgggcgcctgtagtcccagctactcgggaggctgaggcaggggaatggcaggacctgggaggcggagcttgcagtgagccaagatcatgccactgcactccagcctgggtgacagagtgagactccatctcaaaaaaaaaaaaaaaaaaagaaaaaagaaaaaaagaaattacctctctagaaatgtatttaattaactggaggttgtgcacaattcttttccgttttgtttttcttctcattttcaaaaacctgcaccaaaggatggtttggttttttgccccatcccaccctgatttttacaagtaatcctccaattatttcatatgaatagtggatgtttactccattttacataaaatgctacataaatgcagttccaatcaagtctcctcaccactctgcttgttactagattggtatcccaatttctgtaaagatgctgttgtttggttgggaggcagggataaaatccagtttgagaagaactcaagtgcctagaaagaaacttagactttatcctgaaatagaaactcatgaaaagtttttgatgcttcaaggggaatgaagatgacagatggggcagatgtacaaagagattatttggcaatcatggaggaaagacggaaaataaggaagaggcggggcgtggtggttcgcatgcaatcccagcactttgggaggctaaggtgggaggatcatgtgagctcaggagtttgagaccagctggggcaacatggcgaaaccctatctctacaaaataatacaaaaattaggctgggcacgctagctcatgcttgtaatcccagcactttgggagtccaaggcgggtggatcacgaggtcaggagttcgagaccagcctggccaacacaatgaaaccctatctctactaaaaatataaaaattagctgggcgtggtggcaggcgcctgtaatcccagctactcaggaggctgaggcaggagaatcgcttgaacccaggaggcggaggttgcagtgagccgagatcatgccactgcactccagcctcagcgacagagctagactccatctcaaaaaaaaaagaaaatacaaaaattagctgggcatggtggtgtgcacctgtggtcctggctactcatgaggctgaggtgggagaatcacttgagcccaggaggttgagactgcagtgagccatgatcacgtcactggactccagcccgggtgacagagcaaggccctgtctcaaaagaaaataaggaagacacttagaaggctttcaaagtaatccaacacaaaatgaagggactccaggtaaaggcaataaaataaggaaaaaagggaacaggcaagaaaaatattattttcgaaaagggaactttcatgctcacagaattagatttagctgttactactgttgttactcattttgactatgctacagtagcaaaccaacatctgaaaaattctataaatatgcctatcattttccgtagacatctatttttattttttgtcattacactgaatatgcaattcatgacatcatttcccacactaggacagctaaggtgtgatagagagaaaacaggatttagagacaggtattggaagctcaactttactacctgttcctatacaacacgagtgagtcatttaatgtctctgagcccctattccaactgagaaagcatgttgtagattatcaggtcctatacagatgtaatgtggtgctgtcgtgcctttaagaaaagcttttggcaccaactcatggattggctgccctttttgttataaggttgaatttatttctatagcaaatacaatcacttctaattctaaagagtctagacatttctatatcaataaatactaatgttttaatgaccatgctgtcacaaaaacaattaagaagcaaatatcatttgtgctataaatatagctttctttctctttctaaataacattaaaaaaaaaaaaaaaacagggtctttctatgttgcccaggctgaagtgcagtagctattcacaggcactattatgatgcactatagcctccaatacctggacccaagcaaccctcctgcctcagcctcctgagtaactggaactaagggcacacatcatcacacttggcttcctaagtcacatttaaaaaaaagaaaaggaaaaaagaattcattttggttcaggaattttgccatactttgtcttttcttttgagaaaagaaaaattgtgttgacgtcaagcctgcttatggaactctggggctttctggtgctggtagatttattcaagtatatacaatgaatattatagaacttactgttgttattcattttgactatgcatttgtcattccatatttcaggtctgttgggaaccaagaattacaaagtgctctaaatttatggctaatgataaatattgatatattaatcaagactaaagctttgatttattattttttgatttgatttattattagttctcatattttataatacttcactggttactatgcgtatgagtgtgatgattggaaaaaccagaggctataaatgcacacatctgtgcattgatacctttaaccattcacataaattatataagtcaagtaggatttcctaattatgtacgatctgtcatatgatcagaagactataggtacatgactaaattttcaagtagcattaaaaattttctctttctccatatatatatctatatacatatatttaatacatacacacacagtcatattatatgaaatgtgcacccctgatagaagtatctaataaaattttgaaaactttttaaatccatcagagtttttattgggcttagatttaaagggagtctgaaaactatttagtttctgcagcatgcatagcaatagtggacaactgccagcaaagggctttatcacagtataaatggggttttaagtgtttgtttccagtgcaggttctcgcagcccaggcacttcccagtctcattgttcctttgttctagcggatgtacaaaggattgactgttttgttttctggctcagaaagattagataaagtctgcatttctgaacttcaccctctagacacgcaaccttaaaatttatttctatatctcatattttgtggattatatatgtttggattctactgatcatgacattattttttaaaatttttatctggcttgatagtacatgtagatgatagtattgatcccttttgaactatcactggaagcagctgtccctctcatccttgtccttaaaatgccacttcagcaaaagtatgtcatctcaattgggtacgacagcattgttcttgagtttcactggctattagaatctcatagactcctctatatcttgttacttttcaaaactgccttggaatataagtattattattatactccccagataggaaagtggaggcttagacaggttaaatagcttgcccaaagtctcatgactttgttagagctgagatttaaatttaattctgactccaaagcccatgctgtctgccattacatttcactgcttctgtggcaatattttcacctaattataggaataataaaaataataacagctaacactgagtacttactacgtgccagatacagttctaactactttttatataatattcaatgtaatcttcataacaattctactaaaaagatattattatcaggattgcataaatgaggaaactgaggcacagggaggttaaggaattgcccaaagcacacagctacaaataggagagcccaattcaagcccgggctgtcaaaccctagaacatatgttcttcaggtgaaccaaagggctgtgctgtggtgtgaaccatgcaaccttgtcttccaagctcacctgtgtttcgggcactctgttaatttttgtcatagttactgctgcctcagcttgcttgtcagctaacatttatgttattattaattattgatgttataaatgtggcatatataattttgcaatatgatgtacttagcataaatcatagcataaaacatagaaacattagatttcataggctctattaagcctatggtgtctattggtcagccatacatagtcttatgagttgtctgtttataactgccttttgaatatagagtaaggctatcttatttcttttatatgtaaattacaagtgaatatcatcttaaaacatataagaaggttatatcttctaataaggtctagaattcctggtgttatattgtgaacacaatatagtctaccaggaagtagtgaagtttctatagccatgccattataatatctgacctgacccttcaatattggtctccaatatcttgatcccactttctagaccaagaaccatgttggatttctgaaaatttctcataaagaggtctctcaatagttctactctcagcactcagggtaggggcagccccttatttcttagactttactccccactgtaccaaaagaatggctgctcactaaatatcattgacttagttcctaatcctgatatgctttttattctattcaagttcaatggtggagattcaacataggcaaagcaggacttctcaaactgatccttggctttgagagttgaaataaggtgaacagctgggtgcaagatttgcccattcccacttactctgggtgctctggcagcaccaaagtgccccaaaattgagattttaaaaacctagggatatagggggccagatgcggtggctcatgcctgtaatcccagcaccttgggaagctgaggcgggcagatcacctgaagtcaggagtttgagaccagcctggccaacatggtgaaaccctgtctctactaaaaatacaaaaaaaaattcaccggacacagtggcgtgtgcctgtaatcccagctactcgggaaactgaggcagaagaattgcttgaacccgggaggcggaggttgcagtgagccgagatcacgccactgcactccagcctgtgtgacaagagcgagactccatcttaaaaaaaaaaaaaaatctagggatatagggaatcccagctactgggagaatccattttggtaagcaaccctatcctaggtttataatcagatgtgtatcttttgtggttgtctaatatctaaaaaccacccaaagttacatatactagacaccaacaatctacaacctaggaagaagttcagtgtatatttcaaattatttcttaatatctagattttctgttgagatcttcagtatttatccaggcataacctggatgtttgtcaatgtttgaaaaagttgctaaactgcaagccaaagaaaatataactttgcttggactttcaagatcagagctaccttaacaacaacaaaaaaagtttcagtagaaaaaggaattcatatgactagtagctaaatgggtttttttttttttaagaaagtgaaagggtaggtttggaagtgaagcaaaatggcaatttatttcacaaataacagatttttgagaaaaatgaacctggactgcagtaaaataagcagttatttgcaaaagtcttcaagccatgttctttttttttctttttctttctttttttttttttgtgtgtgtgtgtgtatttgccttgcagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacaggtaagacctgtttattttatagctgagtagttaataggatacttttcaagttatactttattcaaggaataggagtaagattgctactccagagcaaagttaattaattagcaattagttaaatttttaaaaggagcttgtgggatacagtggacagactggactgaaaataggatgcgtggctatgctggtaacttgttgagtggttttgaagaagtcatgggacttctgtggaattggagttttctccaacttggaatggatactccctaatggcccttctaactcaaatccaaagcaacaagactttctgccccattttctaagtttgtgccataaaacttattttttagatgtttttattctttgtatactcttctcataacatcaagtcataatgtttcctaactattcctatgtttgaaacaagtctttgtttctccaatgtggtgaaaaataaggcatctgtgcacccacatattatgatatacatggcacatcactacctccttccataaagtacatgtctttcatgtcatttgctctcccctcattttctctcttcttaaatttttttattatactttaagttctgggatatttatactttaagttctgggatacatgtgcagaacatgcaggtttgttacataggtatacacgtgccatggtggtttgctgcacccatcaacccatcatctacattagatatttttcctaatgctatcccttccttatccccctcaccccccaacaggtccccgtgtgtgatgttcccctccctgtgtccatgtgttctcattgttcagctcccacttatgagtgagaacatgcagtgtttggttttctgttcctgtgttagtttgctgaaaatgatggtttccagcttcatccatgtccctgcaaaggacatgaactcgtccttttttatggctgcctagtattccatggtgtatatgtgccacattttccctctcttttttaaatcttcctctccatttttcatcttctatagttctttcctttctctcttctacttactgctgtgcaatgttatatacttcactggcaaaagccaccttaatacctattaagtgggggaggcagacaagtaaattatgatgtaacttgaggctgcagactttgaaaagagcactaatcaaagttccagtgaaatttccagaatcctgttatttactaatgctattatcaagttaagatgtacagaggaacacaaatgaatatgtgacttctaattaaatgtgtctatgtctcctataagggaattattaatgacatttggacatgcattttatcccactagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacaggtaagttccccctagctagctgaagaagaataaagtgaaatcaagggaatgtttaataagtcaagtttattatatgaataactgtaatataggacaaattgaaattcttataaggtatagaagacccatatccacttttctactcagaaaaagaaggattctcttttattctaaagtttaggctagcccttggcaacattttgaagtaggcaaagttaattactgatatggacctagcttctcttcttctctttttaatactctatctccttgctaaggattcctacttccttttcttaaacaggcaactgctgtctttatgacatcactcacagtgaaccagagttactttctccatgctatacataccctactcctgtgtgacagtcatttccaaaattttctatctaaccatatgacctgggacccaataccacaggacctactcccacagcctaccctagactaataaatgaatctatgctaagtattaatgagtaatttatacaaactttcattcattcagccaatagttattgaatgtaagctagatgctgggcattgctgatataatatccaagagagacaaagtctttgccctcacagcgcttacattttagtagaatctaatgcttctagcaagtctaatgtgtgaattaaatctcctctcttggtaagttatctaattttaagagaaactctaatatatgtagtgccttagacattagtttctggaactatgggaggctggtgggaaagatatttgaggacaccggtacatttacataccttttataacacacctcaaatatatgtagatattcctggccaaaaatgttctatatatcttaaaagttatttatgtacatcaagagcaaattgcattcctgactgccttgtgcaaaatcagagtgctgtgcccattctttttttttttttttttttttttttttgagacagagttttgctcttgttggctgggctggagtgcaatggtgcgatctcagctcactgcaacctcagcctcccaggttcaagtgattctcttgcttcagcctcccgagtagctaagattgcaggcacctgccaccacgcacagctaatttttgtatttttcgtagagatggggtttcaccatgttggccaggctggtcttgaactcctgacttcaggtgattcacccgccttggcctcccaaagtgttgggattacaggcatgagccactgctcctggccgcccattctgttaaggaagcttcattaatttatattctagaaagagtattcaccaaagggtatctcctttttaatcattttcctctgatgaagtagtaacacaactcattaactttatcatgatttaatataaaaattaaagtagttttatcacataaaattttgtaatcaatcaattgatcgatctatttactatgtactcaatattattgaatattaatatataaaggcgataagaaatgaggcagatggcagacctttttgtgcattccacttaaagaatttctgaactggaaaggaccattgtaggtctttgacctagcctcatttgccaataagaaacaccataaggctcagtgaactagaaagagctgtccagagtttcccagctgactaatggcccagtctgaaccagaatccaggcttctgcctgccaaggttttggccttgccactaggcatatagcctacctttggttttacaacattactttttgcctctttaaaacctttttttatttttattttttcaccatctgaagaggataatatttgcctcttgaagtgcttgttttctccagagcaaggaatgtggcttgcagaaataaaattacaggtcaaaatttggccataggacttgtgagagatcctgagtaaaagtctcctttctgttctttcctgattagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatgtgagtcttgggctccagaatgttccttggttgctcaaatcactctctgatccaccttaaaataggacaaaataagtcagcaggaaaactcctttcccaatctgagaagtggagcctatgtaactgaaggtgtctgtagtatggcccattcttctgagtcacttaggcaactgagtttggatttctgaatgatctgcatgttgtttctgtcttatgctttttcatgtcacgtcacttaagtagcataaatgcattagcattgataccagtatataaaacatttctgattcattcttacagtgagaaccagttagcatttaaccatgttttccatacattattttattaatttatgtcctcacttatctatccagtgccttatatatgtaaattactgtactattgttaaaacgactaagacatgctacttgcctttaaggcaggatccagcagactaccccatctggtgccaaatctggtctgtggcctgattttgtttagccctcaagctaagagtggtttttacatgtttaaagggttgtacaaacaaataaggaaacaaacaagaaaaagatgagacagagaccatatgtgtcctgcaaaacctgaaatatttactacctgatccttacagaaaaaattgtccaactcctgctttagaaaactttcattttaatcacacagatgtggaatacacacatgtacaaaaataaaaatagtacattttaataatagtgactgtattgatatttgcatgtatcaggcactgactaaataatttatatccattatttcatttagttctcacaacaaaactgtgagagatgtcttgttatttattaccattatacagataattcaaagaggtcaaataatttgtccatagtcatccagccagtaagtggtagagctagaatttaaaccaggctatttgattccagagtccattctctctgctattagagatctgaagtaagagatatatggtcaaaaaggaaagataaaattttctttcataagagcagtaaaaacttggaggaaatgggagcagggtgcggtggctcatggctataatcccagcactttaggaggctgaggtggagggttgcttgagcccaggagtttgagaccaacctcagcaacataatgagacctcgtctctacaaaaaaaaaaaaaaaattaattagctgggcatggtgacatgtgcctgtggtcctagctactcaggaggctgagctgggaggattgcttgagccctgtggttgagccatgattgcatcacttcactccagcctagcaatagagtgtgaccctgtctcaaaaaaaaaaaaaaaaaaaaaacttggaggaaatagaaatgatctttaataaggacctaaaaaatgtaacgtttgtgacaaagagggaaaagagggaagagcttttggggtggaggggacaaaataagcaaaggcccagaggcagaagggcccaggagacttgcaggtctacagaacatacaaccggaagccagctttccaaagggtagggaaggagagaggatggcttcagaaagtagtctcagttaagactggaaggatatggggtctgaacttaaagagccaaaaatgtaagcagagggcttgacattttattctgcagattatagagagaccttgaatgtttttaagcaaaaaaaaaaaaaaaaaaaagaacttaatcttgcaagaacattaatctttttagttggaaaagaaagaaaggaatgcctcatgatcacgacatccaatatctcttacaaaggatgccacatatcactagattattaacactacaacagaagattacattactgatatcactaaaatgattttagcggacatttcttgtgtgtcaaatgtctccgaaataaagaacactcatttgcaatccacagacatcaagaggggatagaaatgttttgaactgcagatattgtgtctcctatctactgctgcccaagaaaagtaaatgagtatccttacttttggtctgtaatatctcctttttgacatcatttcaccgtttagttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacaggtaggcaaatatgaagatgttaataccaatggaagagtaatttgttccctctcccaggtaacccaggtaactgccgtaactgctaatatcataccctggtgttttctgaatttgagatattaaggactttaaggctaacatggggtttctaacacctaatttgtcaaattagaacatttaaaatcacttccactagtaactccattatttcatgaaagaaagccatttcaaacaccaaaagagtaagatgcatacattctgaaaacaaacactgacccttcccacaaaagaagaaccttttgctagtgatcagcattagggaaccattgccttgacctcatgttgactaatgtggggatttcaggtaccaatgaagagtgattaaagtggagagggatatatttggattttagggaagggaagaataaggatactgaaatgagaaaacaggctcaaagaggttataacttgcccaaagctttgcaatataatcgtgacagcaagaataccaagactcatgtttcagtatcctcatactgtcaaatacttgtactcatattgtcaaataagagagttgcacttccaagttcaacatttgcttgataatccttgtaatgtgaaatactccatatttagagtgaaattcaaataccttctttcttagttcgcctgataatagggaaataactacatggattcactgttcttcttagaacaatgtcaaagaaaaggatcatgacacccacttagcttgccaatgtgtcttgcagtaatctcctcatcttccaaatattaatatccactggatgatgatcaaagacctacagagcttaaactaagcgacttttagtatttcacaggacaagcatctctgtcatctccaatattttatcactcacctcaaataacttggaaatggaagatcacagaacattaggggctctcagcatgtcagcataattctcaggagaacttttatttatttatttattatttttacattttgagacagagtcttgctctgtctcccaggcctaggctggagtgcagtggtacaatctcggctcgctgcaacccccacctcctaggttcaagcaattcttgtgcctcagcctcccaagtatctgggattacaggcgtgtgccaccaggctcagctaatttttgttcttttagtagagacaggattttaccatgttggccaggctggtctcaaactcctggcctcaagcagtccgcctaccttggcctcccaaagtgctaggatcacaggcacaagccacggcgccaggccaaacttttgtttttctttttctttcttttttatttttgagatagagtttcactcttgttgcccaggctggagtgcaatggcatgatcttggctcgctgcaacctctgcctcccaggttcaaacgattctcctgcctcagcctcccaagtagctaggatcacaggcatgtgccaccacacctggctaattttgcatttttagtagagatggggtttcaccatattggccaggctgctctcaaactcttgacctcaggtgatccacccgcctcaacctcccaaagtgctgggattactggcatgaggcactgcacccggcccaaacttttcttaaactgtgtctctggttcaccttattcaggtaacttgaagtaggcctcgatgtaaataatcaaattatttctctataccgaagaaggaagatggagagttagggactcaattagaatggatttatagaaaatttatggatgcaaaatttacaagaaaatttttaatacttgattctttcataatttaaggcagcaacactttattcttttcttttcttttcttttcttttttttttttttttttgagacagagtcttgctctgttgcctaggctggagtgcagtggcaccatctcagctcactgcaacctccacctcccccacttaagcaattctcatgcctcagcctcccgctgagactacagatgtgagccaccacgcccggctaatttttgtatttttagtagagatggagttttgccatattggccagggtggtctcaaactcctgacctcaagtgatccacccgcctcggcctcccaaagtgctgggattacagatgtgagccaccgcacccaaccaacagtttattcttaatgtctcctagaaattttaacaataaaaccttttaaaggaatcaattttgagataagtcctcaattaaatgctattattgccagccaactcgcccttccatgaacacatcagtgtcccccacctcagaaatgagggaaagttgcacttggtctcctcaacctatgggggtaacaaatactcctaactccacctaaatacttaaacaggaacttttctttgtgattttgtgaatgacaagattggagtaaatatttttgtattacagaattcatacaaaaagataaactcaaagtattatacagtcaaaaatcaatgactcttctggcaagatgttttctaattgagtctgtatttctggttacattacatgaacaaagttttttgtgataagattttgttttaatgctcagagacattcataaaataaatgttgaactgaaacacgcttaaggatggaagaggagaactatcaaaagtataccctatgaatatgcctcagtccatcaatgacccatctccattgctttttcctcagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacaggtagtaacctttataaattttacattttaaagtgttctgtctgctgaattactatttaacatgcaatttacaagtattcattaactgcctattatgtactgggcattgctttatggatcctttctattgtgtttgttttctattttaccaattgcagttcttatctttattagttccttctttttactttgcttggatttagtttgctaaacttgaaaaagagtaaagaacaaccgtttcaaggagttttgctgtaaaggagagcagagaaatagggcagcatctagaagaggaactatggttgaaaggaggatgattttttaaaggcagaagaaataacagcatgttttatgctggagggaatgatctagaagatgtagaagggaaatcatgatgatgtaaagtgagagggaagaattgctgcagttattccatgagtaggcaagaggtattgggatctagagcacaagtgaaggaattggctttagaaaggagcatggggaatctaatctcaatgtcagctggtatattagtctgttttcacactactataaagatcctacccaagactgggtaatttataaaggaaagaggtttaattgactcacagttccacatgactagggaggcctcaggaaacttataatcatggtggaagttcagttagaatggcgatcattaaaaagtcaagaaacaacaggtgctggagaggatgtggagagatacgaacacttttacactgttggtgggactgtaaactagttcaaccattgtggaagacagtctggcaaatcctcaaggatctagaactagaaataccatttgacccagccatcccattactaggtatatacccaaaagattataaatcatgctgctataaagacacatgcacacgtatgtttattgcggcactattcacaatagcaaagacttggaaccaacccgaatgtccatcaatgatagactggattaggaaaatgtggcacatattacaccacagaatactatgcagccataaaaaaggatgagttcgtgtccttggtagggacgtgaatgaagctggaaaccatcattctgagcaaactatcccaaagacagaaaatcaaacaccacatgttctcactcataggtgggaattgaacaatgagaacacttggacacagagtggggaacatcacacaccggggcctgttgtggggtcgggggtcgggggagggatagcattaggagacatatctaatgtaaatgatgagttaatgggcacagcacaccaacatggcacatgtatacctatgtaacaaaactgcatgttgtgcacaggtaccctagaacttaaagtgtaataaaattaattaattaattaatttttaaaaatcatggtggaaggtgaaggggaagcaggcaccttcttcacaaggtggcaggaggggaagtgatggagatgaaaggggaaagagccccttataaaaccatcagatcttgtgagaaatcactcactaacacaagaacagcatgggggaaaccactcccatgatccagtcacctccctccttggacacatggggattacaattcaagatgagatttgggtggggacacagagccaaaccgtatcagctaggaaagagagaatatgtgggtgcagatgccaataggtggatcgttgtagggtgagcagttatcttctaattgctttcatttttttcagtgtaattggaagcaaagtcatcaagatttccctttttagttggacgccgtggctcacatctgtaatcccagcactttgggaggccgagatgggtggatcttgaggccaggaattcaagaccagcctggccaacatggcaagacactgtctctactaaaaacacaaaaattagctgggagtggtggcacatacctgtaatcccagatactcgggaggctgaggcataagaatcacttaaacccaggaggtggaggttgcatgagtcgagatcctgccactgcacactagcctgggtgatagagcgagaacctgcctcaaaaaaaaaaaaaaaaagaaatttcttttttcaatgtatatactattgtcctgtatcttatttttctctcctcttttgatcccacaaaaatataattattgctttatatagtcaacatctgtttagatttacctaccaatttactaccttttttctcattttttccccctgcatctgagatgttttatctgggattattttcctttatcctggagaacgttattcaaatttcttcattgagagtttctagggacaaactctctcaaattttgtttttgctgggcatatttttatatagctctcatttttatatagctctcggtcttgaaagatattttccttaagttccaactctgtgtttaaagttactttctctcagcacataaaagatattattctagtctttctgggatttattgttgcgctgagtcagctgtcagtctgatttttatttctctatgagtctgtttgctatgactgcttttttgcctttggggttcagttgtttcacaataatgatcaaggtgtagatatatttctttttgtttctcttgctcaagattgattggcatttctgtactttccaactagtgtctttctacaatcctggaaattctcagctattaactctctaatattgcctcttgccccttctccattccccactctgtcatcttctggtattctagaacacacatatatgaacacatcaatatatttcatattttccatgtgttttctctctgaactacagtataggtaactttctcatatctttgattcatttcattaattctttcttcagctttgtctaatctattttaaaatctacccactgttttaaattttaattgttatgttcacttttaagcattctctttggctctctttcaaatttatgttgtgctctgttgctctttagttatattttcattcccctcctgtattgttatatgcaaattaacaatgtttattttccatcctatgtctgataattataatagctgaaatcttcaggagttaagttctgttgtcttttgattttcctgccttttgtttatgttgctttatttctttaaatgtatgtgatttctttttactgtaagcctgttttccctagaattttattctgtggaaattatttaaggccatgtttgaaggtgagtttcagaaagaattttcatttgattctttcaggtgcacaagactgctatcaaaccagacctactttaatctaaattgtcaactttaggttctttgatcacctgggttttataaattcaggttgcaaacacattgaaactatcttaaggttatgagttctcagaggaaatcgttttctccatccagtattaagaaggctgaagttgtatggggagtaaagagagactatttatttcacttatacttagaatgtagcctttccaatgttatgcaaggtcagctatgagtttcttcagcctggaaaaatctacactttacctcctttctccaatatcctgcagtgctataaaatcaaagcttacatttgcatttgaaaggtgctctcaacacaacagttcgctttatgatccaattacctctctatcctttactttttggcctttgagaatctcttacattcctgacaagtcattcatttacattttcacattttatccaatatgtatagttgtgtttattagaaggattttcatggtatctagcctatcatactgccagaaagggaagtccaagacattgttttagacctaaggtcatttttatcatccccaccacccatattgctgggtcatatggtaaatgcatgtttaactttgtagaaaactgccaaactgctttccaaagtattgtaaaattttacattcccaccagcaatgtatgaaatttccacttcctccgtgttctcagcatgtagtacatggtattagcagtttgttttaaaatttagccattctaatggaatagccattataataagataatgatagctcatgtggttttaatttgcctttttctaatgtctaatgggtttgagaatcctttcacaagcttatttgtcacccatttatcttttctggggaagtttttgttcaaatattttgctggattttaaaataggattgtttgtttgtccttggtcaaaatgttttctgtcggtttttcattttgatgtccaatttatcagtttttttctttcataaatcatgctgtggtgtcatatctaaaaatatttgcctaaatcaaggtcacaaaggttttctcctagaaggttatagttttaggttttaaatgtaggtctgcgacccattttgagttaatttttatatatgatgtgagatataggtgaaggtttttttctttgcatatagacatctgataattctacctctatgtattgaaaagactatcttttctccatgaaattgcctttgaatctctaaaaaatccattgatagcatattcttctatctctgggctctcaattctgttctatcaatctatgtttctgtctgccctttgccagtattatcctgtcttgattacaagatttttagtgaaatcaggtggtgttagtcctctaactttattcatctttttcaaaattgctttggccactgtagctgtttgcctttcatataaaatttagaattataattgaatctttagaattgaatctgatccatatacagtaggatttttttaatgaacgcttttgtatcttaatccagaagtcaatgaactttgaaaaagaggggtgccaaggttccagtccctttgattattgtaattcaggaaagaggcacaaagaagaatgtatgttgaccaagtgccaacttcaagatctgtgtataagatttgttaaatgataagttggaagaaataaatgttgttaattaggaaaaggacacaggcttaggggttagataaatctagctttcagttccaggttggctatttgttagcactgtgatataggctaaattacttacattttatgatccttggtttccttgttaataaatggaataataaagtcaactttatagagttctgaatgggtgtcaaataatgtaacctttatgagacatatagctcataactggcacatagtaggccttcagtagttgttgttattatcattattttttaatatatatattataatttatattattatcacatgttcatgtataataacagcccctttaagaatgtgccagtatagaactaatcagtttgctagaccataatcaacagactgaagggaattcccaataccaccccataacaatcattggctcaggtagattagatagctttgaattctcatggggtaaggacagataaaatcacattaactaagcagttttcaaaaatagcagccttcattatctaaaatttaaaatcaaaaccacttaataagcatgcatcatctcatctttggatcttaaataattttgattccctatataagcagctttttcaaagtactagagcctctctagaggagtagttctccatatgccacaggaaatagaactgagagtctatagcaacaacacaaaaattatttttagtactttcaagtctgtctccattttttgactcatttttcttacactttcttaaggtgactaagtgtcatttgttttttcttctgtctactgttttagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacaggtaagaagtagagatatgtgtctgtgacttaactaagatctgagtacatgagacccctaatcagaatattatagaaatatcctaaaatcagactcatccctggcctttacaaaagctaagtttcacaaaagctagccatccagaaggtatatggaatggaaattgggcgatgggtgatggcaagagagaataaattctgatttttttttttttttttgagacggaatttcgctctggttgctcaggctggagtgcgatggcgtgatctcggctcaccgcaacctccgcctcctgggttcagcaattctcctgcctcagtctcccgagtagctgggattacaggcgtgtgccaccacgccctgctaactttgtatttttagtagagacagggtttctccacgttggtcaggctgctctcgaactcctgacctcaggtgatccacccgcctcggcctcccaaagttctgggattacaggcgtgagccaccactcctggctgaatattttaacatctccaatgaacatgtaagaactcctcactcgatgtctagacttatccccctattcagttgatttcctttgaaatgtttatgttccagttaaggtaaacaataatggataaaaaacaaaacaaacctcccaaagaaagcatctttcactcttatatattcttggtttgcaagacataaaaagaaaatgatctccaattaatatggttagaggtggagttgatctaattttcaggtctcatatattttcataagcaacgttaaacaagtgcttaatatgctatctaaacaatttttcttgaccttaatagctccctgttagaaagctaagtaaacaaataagtgtcattatggtcatgtatgtcagggagccatggcactgaggaagaaattacatagaattttctatgtaatacaatgaaagaacataaaaaattaatatatatgatatataaaatgtatgttcatttcttagaaaaaaattacataaacccaatagaagctttgataattattagtgggaccttgtctacttaattttatataattattttaagttggatttcaggcttctccttctgcatcctcaacactcaaattctgtttatcagctgcaggcatcatagatgcatctctttccaaaatcatgaatctcatctacttaatgaacccagaggacattaacttcattaactctcccagaagaacaatgaagtcactgagaagatgtttcatagtcttggtagaaattcactggtgtatgcccatttccctcattctatgacagctgacattgtcacttgcatgtttcttttttttttttttttttttgagatggagtctcattttgtcgccaggctggagtgcagtggcacgatcttggctcactgcaacctccgactccctggttcaagcgattctcctgtctcagtctcccgagtagctgggattacaggcacgcaccaccacgcccagctaatttttgtacttttagtagaaacagggtttcagcttgttggccaggatggtctcgatctcctgacctcgtgatctgcctgcctcggcctcccaaagggctgggatcacaggtgtgagccactgcgcccggcctgtcacctgcatctttctccctgatattttctttcctttcttttaatggttcttggcaccatccattggtgtagcatacttgggggtaggtagctgaaaagcttagcatggaaatcaggaggcctaggttttggtcctagctctgccattaacttatttccctaagcttctgtgttttaatccacacacaataattcactcctaccctgggtgtcagaatagggaaggagaaataataaagctgaggagaggagtggaggacgaccttgcattcatttcccagtgatttgcagttgtatcagtcacattagactgatttaattcatgcttagacactgtataatgtgggtgttcatgattggatgcctctattggttgggatacagtctcctactatcagtggctcttctttgctgtaggtcctcagagctctccccatttctccagagaatggaggttggggaggggtacaactcatcagacttgggagtaggcatttcacttccacccacattccactggccagaactcagttacatggctacatctgactgcctgggagcctgagaaatgcagtctagctgtgtgtcaagaggaaaaggaaatggtcggggaaccatattctgccacacaggttgattctcattttatataccacaaggattgtccaacttattgtgagctactaaaatagtctagtctgtgctatctcttgaaataactgtgtactttaagtaagtgggacttaaaattatttttattttttaatttatatttttatttatattttaattagaataaaggtacaagtatttgacccatattatataatagaagcattcaaaaaagggaaaaagggacaagaaattatttgaagaatggtcataaagttttgaggagagaatcaaatatgaataaattgagcacgagttattttactcaaacatatgaagagtgcacattatcacgataaaggaggaaaatgggagactcctgtaaagcacaataatagggattttgaaaggtgcctcttttagtaaattttgtacacagtcaattgtaaagaattcagtgggtaaggccttgataatccttatcatctcctcaaattgctgaaacattagtcaatattgaaataattttgaaaggtattcttatatttcacctgtttccactgagttgaaacatataaataaaccctcccagcccagataagatggcagaatatttaaaattaaagatattagatatacttaacaaatctaattctaatctgggaaaatgctcatcctaaaggaaaaacaaattttgtatctattttttcttaaacatgtgaatcatatttctgtgaaaacttttgataattgtgtcttttctaataaaatgttagtagttgcaaatatttccagcagtttttaaaaacaagcataatgagttgcttttgagagcaactaaaggatgtatagatggttggatggcagaagaaaggaaggaaagaaagcaaaaaggaagaaaagaaggaaagaaaaggaaggaagagatgtaccaatatataaatcttctggctaaaaagttcaactttatatctaggaaatgtccatatatgtggatcaacattaccagagttgttcactagaatgcagtttataatttttagtgatggataagtgcttttaagtataaggtatgctttggggcttaattcacaaagtccgaacatattacattagaaggattctcagaagtcatctagccaaatcctgtccattataagtgatgtactgatattgacaatcatatgaaactgttaagttaatcaactaatgattaaaacagtagtgtagttcatatatactgtaatattttaaccctatattcatttatggcagtactatttaatgggcacctatttctgatatgtggttcaacttttactcaatactgcaattactaatttgctgactatacctccaaccagagaacttcttgaagacattcatgcgtttttcatttttgtatacctggcaaatagtaggttctcagtaaacgtttgtgacactaatccccaattcatataagcaaatgattatagttgacatcagaaaacccattatcgccataacagttctctctgcccttggttggtccagcttccagacttcttacttccaagataggtttttaggcttatttcttaccactagagggcaggaaatgccttgcaaagggaaaacggtccctctggttgtgttagctattacttcccaggaatgaataacttcatcacaaaaaaattgaagctatcccagtttaaggtctttagaaaagctatcgtattcttcccctttccactcaaacatttttgctttattggtaagtttggttcaagttgattcatttagattgttgaaatatttgttccctttcttacagggaaccttctaaaacattgtataaggatgtctccacttgaaatgctttacaaacagcaaccccataaaaatgcagtagtggcatccttgtatttacgaggcatcccaaaggcctccggacatttttattttgattagttttctgatgtaagaacactcagcttctggaagctgagtgaaatcctcacgcttccttgacctcttatataatcagattagatctcctgagtgagtccacggtttgtgctgactgcaatagacgactcaaacttttgactgtgtctttctttttgaatcccccttcccccccccccccgccccccacctttcaaaatcacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacaggtaaggctgtatgaaggttcagggctccgtaagaaccaattcacatgtggctcagggcaccacagagctgtagcaattctgtaatgatgggatgaaaggcccttgagatcacaaaactgttatgaagtcttcgtattttaacccaagaaactccttatgtgagcagaccctgtgtgactagaatttatattatattcaaatagtgaaaaaagtgttcccgtttatggagtactttttggttgctagggcctggctttatatatcttaactataactaacccttatgaactccttattgaggtagtcattgttattattcccattttacagatcaggaaaccaaggttcagggaggtcaagtaactcgcccaactgtttaccttgttaaacagccagtgtgtttcagatcctggttttaaacccagttctgaatgactccagtgcctacaaagctctccatcctaaaatccatcctgaaatgtctgttggtcaaaaccactattcatcctttttcacacaaggtgaaaatgtgaacctttatggttctgggactagggagcaaaaatcttagcaaaggaaatgaatgttcagtccaatgtgctggaaagaattaaatttaaatagctaccattttcccaatatatttatgctttctggggtttatacctgagatttctgcttaaggttggcatcaatacattgtcaaatgtttcctactaagctatgggttgatttctgtattttaaaatgtcagtttttccatgaggttctgagacaattgtccttatcctgttacctagcgcaggacctggggcttagtaggcactcagtaaatacttggcaaaggaataatcagaaatcacttagatcaggggtcccacctgggagtccatggttcatgggagactttaggaatgtagtaacccctgaaattgtttatgaggttgctggggataggaaaggtatatgcatttctttgagaagaaacagtccatggcttttatcagattcttatggtttctgtgacctccaaaaagctaagaacctctgatttatattgttacaggatgctgacattgaaggggtccttagaatgatctaatcctgtttcctcatttggatataaaggaagtcccagagaaggagtgtggcttctccagggttgcagggctgactggtagtggagttcagtctagctccagtgctgtccattccatcatgctgtatccgagagcactagtcagggatataaagagattatccctacccttgaataatttgaagcccaattacactgacaatcacaataatgacttagatctgaaaagcagatttctatttacaaagcagtcttatgtcagggtctcatattgatcaacttggagcctaaaaatcaccagaaattaaaggatgtgttacctaactaccaaccccttgcttcctaccaatgtcaattcatgatgatttcctatccgtatgactttaatattgccaagtcttttgctgagattgttttaaaatgcaagaaagtgattctttattcagtgcatcctcttgactccttgaccggcatgaacttggacttggtacacgactaatggaggcaaatcattgcccctgacaaatcagtttaactggagggtcatgtctgagttgttctcttgatgattttggctgattatcttaatgcccttttccatttctgatgctcttgttctacattttgggtgaaaataccaatatttctaattctgtatcacatcatctcactgtgtagcaaggcaggtctccacaaattaccccgttccacctggagagctccttattgacttaacgtgatattcagccaggtttttcttcctgtaatagttgctttgcctttagcaaattgcctggatcattgacctttcttagcccatgcataaaatgccacttcataatttcctctccttaactctgtgatgactgtattctaacaacactgtaattggttttaggtaaatatcttggagaaagcatatctgtccttgctccatatctgtggtgagctatattccaaacactaatcagtaaacacaaggcaacaaaggatgctaatgcaacttgcaggtgtgagaaaatggagcttccatgccaaaatactgaaatttctggatcatttcatgatttgagaaaaagtagaggtgaaaaattggacacagccttggcatgtggtcagatcagaaacccctaatatataccaaatacagaggacatgctagtattaggacaagagtttagtaccctggatccgagttcatgcctcttttcaatgctcctcctcattaatatgtataatgtccagttaccgtgaaatagtaatgaatctgtggcctactgttgaattaaaattcagccccaaatggaaaaatgaaatctccttaatatcatgctctaaatacagaattgccttattccacagtgttcctaagtaacatgcatatatttatttactggttggggaggggaccacagatatacagaatggtttcgttcatatattagaaagaacctcacatgcacaaaattgtattaatcataattcttggttcaagaaaccatgcatccccagcactttgggaggccgaggcgggagaatcatgaggtcaggagtttgagaccagcctggccaacatggtgaaatcccatctctactaaaaatacaaaaaattagctaggtgtagtggcaggcacctgtaatcccagctacttgggaggctgaggcaggagaatcgcttgaaccagaaggcagaggttccagtgagccaagatcgcaccactgcactccagcccgggcaagagagtgagattctgtctcaaaaaaaaaaaaaaaaaaagaaaagaaaagaaaaaagaaaccatgcatcaactgccacctttactttttaggcatctagttagtaatttttgataatttaacatgtacacaagaaaccaaccagtacctaaaataaaagctaggaccttgacaataacctacatcaaagtatgtggtccccacctcgtgaattcactcaaaggtagccaacatcttgactcctatgttcacctctcccttgctttccatcttgcatagttttattgcatttatatacaggcctaaaattatgggtttcaaaattttttgttgtttttaacattatttaaaaaggtatttttaatgtagtatttaatatcttagggacttagatgttttacttattatacaggtaagattcatccatattttgtattttgatgttaaggacaagaaatccatatttttgtgttttgagttaaggaattaattataactattatataatatttcactgtgtgtgtgtatgtgtgtatatgtatgtattcattatccagtctcctgtatatattcttctacacgtggtttttatatagttttttaattttgccagtcaaatggatgtaaaacagtatttcactgtggttttgacttgcatttccttgatcaccagtgatgtggaaaatctcttcatttattatgcaaataaccatatgtgtttcttcttccatttttctttttccttttcttttctttttttttttttttttatgagatggagtcttgctccatcacccaggctggagtgcaggggcatgatgtgatcttggttcactgcaacctgtgcctcctgggttcaagtgattcttccatctcagcctcccgagtagctggaactacaggtgtgcaccaccatgcccagctaatttttgtattttttagtagagacggggtttcaccatgttggccaggctgttctcaaacttctgacctcaagtgatctgccctcctcagcctcccaaagtgttaggattacaggtgtgagccaccatgcatagcctcatttttttgaggggggcgggttgggggattgcttatattcttcttagtaacttttgagtcagcaaggtatgttggaattatctatatcgtttaccatcactcatattaatcatcagccatcatgtttaatgttccatcttatacatgacactttgtgcaggcaaacagcaggcttagaatgagttcatcagcttctgttaaaagatccgtttaatcactccacatagtgtaacaatctttcccctccagaaatttgtaacctaaggtctaagatttttcttttaaatgcacacaataataatctactctctctttttattgtcccagcttgtcatctgtgatcaattactcactcagaattcataaatatttagttactctctgtttccttttcagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaagtaagtggaacgattgcaaaatctgacagttggttggacttgaaagtctctagtaatttatctgaaccttgaattttttctgcttattcattagtacattacattcccagtaagtctcacttggtgctaacatcattcagccaagccatggcctataattacagaatatttattggtagataaaagcaaacatagtgagggagcaagaaggctaaatgtcccatttttcttccctatcttcctgcatcatggcatttagattctagacttcttgttttatcttatgattgagatcataactcattttataattatgttctaccaatgctgatcatgtaacatttatgtcaggaaaaaaccacaatgttaatagttgcttccaatttttcttgtttaattatgcatgaagtagtgctagtggtttatttggggaagggagatgttgccagttccttgaatgtgattcataaattattatgtaggtaaactctgatcagttcctttcctgaaatgtcttctcatttttctccctagttccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacaggtaatgtgaaatactgttcttgaacctgaatagatgcagtggtgcatttaactttcgggtagttcaggtatttcgattgagcatttggagggataaaagggagacagcaagaagggacaaagtcatgttgatagtgacaatgatgttgtccaacctggatgaatgaaaataaagtatgatgtcagcagagagtggcggggttggagggtgctttcagagaaatagcaatgaactgatgtgatcagctggtgcttctgaggcacacagattaagaattaagtgttacttgggtatcacttctttagaactcttttaggagtgttgccatagtagttaacatgtactgacagttcaccatgaaccagacccacagcaaagcattttatgtctacatcttgttcagtcttcacaatgctttggaagccaaggcaggaggatagcttgagcccaggagttcaagcacagcctgggcaacatgacaaaaccctgtctctacaaaaaatacaaaaaaattagccgggcacggtgttacgtgcctgtagtcccagctactggggaggctgaggtgggagaatcacttgagcccaggaggtataggatgcagtgagccataatcatgccattgcactccagcctggacaacagacagagaccctacctcaaaaataaaataaaattaaattaaaaaagaatcaatcttcacaactctatgggctggttagtattatcatcactgccatttttcctaatgaagaaactaaaacttacagaggtcaagtaatttgcctgtagtcccacagctagtgagtgagaaaaccaaaacttggaccaagacaccctaactagcccctcgctatataattagcattcctcatttccactcaccggctttgacttccccctaagctttcccccatcaactttagttcacacagaaaaatcagagaaaagtggcaaattgttactttctttttcatgtgagttctctcagtgggtgccaaaacatcagaagcattcaaaactttgtttgaaaatttcaacagttcattctctaagtgatgacttttaaatttattttctgttttagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacaggtaagcatccacctggagaagggctagattgtagaatgcctcatggttctccaaaatgggacagtgaacgggctcagctattcacaaatccagatttaaaaccaccaaagtttgtacaattcaatggtttcaagagccttactcatttattctttgtatttttctcttaatagagatctgcaaaacaaatgaaagggaatcagaaaccaaatcatttgaacacatttttatacttgctaaaggataataaaattttaaattttaacaagcaggctgggcacagtagctcacgcctgtaatcccagcaccctggaaggccaaggcaggtagattgcttgagttcaggagttcgagactagcctgggcaacatagctaaaccccatttctactaaaaatacaaaaaattagccaggcgtggtggtgcacacctgtagtcccagctgcttggaaggctgaggtggaagaatcacctgagcccgggaggtcaaggctgcagtgagtcgtgatcgtgccactgcactccagcctgggcaaccggagtgagaccctgtcccaataaataagtaaataaataaataaataaattttaataaggagacttccataattatgcatttttcaaaagttctaccttttaagaaagagtacacatctgtgccatctactttacctggtagagctaaaaaaacaagtatcaaatgtatgaataatatatctgtttatatcaatatcactattcatgtattatttttgaaagatctctagccatactatagttctcttacagatgaggaaagaacagttcagaaagcttgtaaaacagtatcaaggatacgtatataacaagacctaaagctataattcaagtctaggtctgtctggccccaaacctcgtgccctctccactgtgacacaatacttcttagatgtctcccattctcatgaccacttatttagttgtggggtctggggcttctataccatgccctactatgcctctatttcatatctatatttatatctatatctgcatatctttaaccctatgacaaatcctgtgttagaagtgggcattcgggccaggcgcggtagctcacgcctgtaatcccagcactttgggaggccaaggtgggtggatcacaaggtcaggagattgagaccatcctggctaacatggtgaaaccccgtctctactaaaaatacaaaaaattagctgggtgtgatggcagacgcctgtagtcccagctactcgggaggctgaggcaggagaatggcatgaacccaggaggcggagcttgcagtgagctgagatcatgccactgcactccagcttggtgacagagtgagactctgtctccaaaaaaagaaagtgggcattcagtagcaaggcaaagcccctgacctcaagaaccttataatctagtgaaggagatagaaaagtaaaaaggcaattacagtaaaacatggtacgtgctaagaaaaaagtggttatgagatgttagaggagcaaacaagaagagtcagggaaggctttcaggaggaagtaatatttaaagaaagactaagaagtcatccaggtgaagtgtaagttgtcttcgttccaacagagaaaacaaagccctggaggtgagagaaaggatggcacatttgggaacctacaccttttttagtatactagaataaaggccgggcacggtggctcatgcctgtaatcccacattttgggaagctgaggtgagtggatagcctaagtccaggagttcgagaccagcctgggcaacgtggcaaaaccccatctctactaaaagtataaaaagcaaaagtatactagaataaaaaatgtgaggcatgtggccaggtaagtagagagaccaaatcacaaagagctttgtttgcctgtgaaggtgttttggaattatggagagccactatagggccattagcatgggagtgctatgaaaatatgctagatagagtctgcagattgaaagagtaggaggtaaggacacaagtgactggtcaataggcagttgcaataatgtatggtctcatttatacttgctaaagggtatgatgtggtcctgaggtagtagcagtacacaaagagggagtggctagattcaagagatagaagatttaggatacagaaataaaactcgtatttgattatatatacaagggtgagagtgataactgaagtttctgacttgaaccaagagatagaaacaaaaaaacaatgagaatattgggggagggagatgaggagtccaatttggacgtcttgagtgttggatgtctgtggtacattcagggagagatgtaatttgcaaaagcaggagaaacatctaaactgaaagtttaaatttgggagttgtcaccttatggatgacacttcaaaccatggacatagacgaaatctaggaagattatgtagaatgagaaaagaaatgaacctagtacagaaaatattattataataacaataatactattttgcctttcacctcaggagctatagaacaaatactagtatccactactgctgaagtcaagtcttgaagttttgaccttagttaatgttagtaataaaagtctaaacaagagacataattcagctgtcaaacccacattcactgaacatgaacttgctcagcattcttcactttctagattcataggtatgcaccactctgcatatttatcagggccattttcactaacttttctatctgagatcctatttaaaatcagagaaaaaatggagaatcaaagtagttgtacagacaggttaagccaacaaatcctttctcctcttttctccataagggcacacagaaagtgtcaatgacacacaaataaagcaaatgcatcatcttctacctgcagttgattcaggagtttttctcaattgatgactttaccctaagtgataaaatctgtattttgttgctccacttgtctctctgcagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacaggtaattagcacagcataatgttttgtagcacatattgccaatgtctgctattgtgtaagaaccccagggtgagagggatgaagcaacattgggagatgatatctatctcttgatacgctgggaacattcaccctgatttgccacttccatgtcagttgccctatccacgcaggactcagcccaccacactctgtttctgatttttcattaatattggtgctattagcttcctattgctgctataataaactatcacaatcttagtggcttaataccacccaaatttattattttctagtcctgaagattagaatctgaaaatggttttttgggactgaaatcaagacaacagggctgtgtttcttgtagagactttagagggagaatccactccttgcctttttcagcttctgaggccgcccacattccttggctcgtgtccccctcccaacagtgacattgctccaatctctgcatgggaccttacatctctttctctgctctcctgcctccctcttccatcttttaaggactcttgtgattaccttggtcaccaaccggacaatccaggataattccttcgtctcaagatccttaacttaatcacatctacaaagccctttttgccacagaaggtaacatattcacaggttctgggggttaggacatggacatctttggggccattattcagacaaccacattggcctaattgattgataacttatttattaagtacataggtctgaaggcggggatggttatgttgacagggacataaagatgaatcaggcatgcttctcgtccttaaagagctgactgacgagacagacacatggacaaataatggcaatgcattgtgataaagagtacatataagagagggatgtctggcattcagggaagcatggaggtcaggtagaattgagacatcttcataaaagtgacatttcagtattgccttgaaggatgaagaaattctccttatggagagaaggtagaatactttgtacagacagtctgtcctgtgcaaaggccaagaggtatgaacaggagaaaggagaagttgtgggtggctgaaatgtgtgttgcatgatggaaaggtgaggctgaaagccagattggagccaaattagagggtgcctggtagccttcctcaggaattttatcttaaagcaatacaaaacttttagccagagagtaattgttttgtaataaaagatgtatctttaaaaagataaatcagatagcaatgggggaatggattgaatggaaatgaaccagaagtgaggagatccacctatcaattcatttattattgagtacctactataggctaggcactgttctaactgctggatatacagaagtgaataaaaaaactcccatggtcattatgtttatagtctagtggggaagaaagtcaataaataaaataaataagtaaaagatgtaggaggttgggtggtaataaagaccaagaaggaaattaagttaggaaggtgggatagcaagagttggggcttacaattttatctatctatttattattattattattattattattattattattattatttattatttttggagacagaacctcgctctggcacccaggatggagtgcagtggcacaatctcaattcactgcaacctctgcctcctgggctcaaacaatcctcccatctcaacctcccaagtagttgggacttcaggcatgtgccaccacacccagctaatttttgtattttcttgtagacacagggtttctccacattgcctaggctggtctcgcactcctgggctcaagaaatccacctgcctcaacctcccaaagtgttgggattacaggcacgagccaccacgcctggtcaaggggcttacaattttttttttttttttttgagatggagtctccctctgttgcccaagctggagtgcagtggtgcgatcttagctcaccacaacctccacctcctgggttcaagcaattatcctgcctcagcctcccgagtgcataccgagtgggactacaggtatgcaccactacacccggctaatttttatatttttagtagagacagggtttcaccatgttggccaggctggtcttgaactcctgacctcaggtgatccaccctcctcagcctcccaaagtgctgggattacaggcatgagccactgcacctggtcgggacttacaattttagatagtacagtccccaaagacttcattgaggcagtgacatttgagtaaaaatctgaaagaaatgagaaagtcatgcaaatatttgggtatttataagcagagccaatgccaacacaaagaccttgagtgggtgtgtgtctgacctgttggaggaacagtaaagaggcccatatggctggaacagagtgagcgaggatgagtggtggggatgcagatggacaggtaatgggggtcatgacatgactgcagtcataggatgataaggaccaatagctgaatgaatgcaggggccctggtgaagaatagtgggtacagtcaagaaatatttttgcattagcttaagtggcacttgggggctgagtggattatagaggaagggacagaagattccagagttttcacctgggatgtctggtagaagatgatgccattaattgagatagaagaaggaggagagagggtcaagcaaaactccagagttcagctgtgtattgagtttgagatgcctgagtgacttgcagagagaagggaccataggtatttggaaatatggatttgagctcagaagagaagtgagctggacataaaaagatctggaccagaatgctagttaaatccataaattgaatgagactgattgctcagctggggctatagaatatgaaggaaacaaaggatggatccttgggaaataacaccttgtaagggcctgacaaaaggagaggagaaagcaaagagagcctgagaaagagcatttggggtggaggaaagagaactcaggcgaaatcaaggcagatgtcctgttctgtttctactggcatcttaagacttctgaggaatcaggcagcatctgtgccagcagtttgcaaggaggtggttgctagcagcacttgaccttgccaagaggtagcacagaagtccaaaagggtttgcaaaattctaacatgaagatttttgtaaagtgcttttggcttttcctattgttactgtttcccgtatcactgaatccaacttcctctttctgtttgcttttccctcttccccacctgctcccttctcctcactgcatttccctccctcattctcttgctcctcgacttttccagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacaggtaagaccaagacccaagcagtaatgaatcgtgggggaattgtcccggtattcactggcttttccttggttggtccttagtttcctattctattcaggatgtagctttatatggcatttgtgactttcaggctgtttgaccctaaatcgcacctttgattatatataactaatttgtggccagtttttgcactggcttctgctcttttgcctccacttatttacttcctagggcttggtaaaaaatgaatgcggttcctcctcttgccatcaaactgtacaagagggctgtaacccatcatagtttaattcgagctacacccttcagctttctaacaagaaatagacggagaggagagcaggagcagagaagggcaaccacaaatataacaaacaggcagtgactgctgcgaattagaaacacagcgctagatgaagtgaaaacacagagttccaggaaagtgagagacatctctctgggctgcaaacaaaaaacagaatctacccttttcccataatttgagtcctttatctcctgttcaaaaaaaaatgttttggggggggacgagttctcactctgttgcccaggctggagtgcagtgatgccatcatggctccctgcagcctcgaccacctgggctcaagtgatcctcttgcttcagcctcccgagtagctgggactacaggcacacgacaccatgcatggcaaacttttaactttttaatttttattttttgtagagatgggggcctccctgtattgcccaggctggtcttgaactcctgggctaaagcaatcctcttgcctcgacctcccaaagtgctggaattagaggcgtgagccaccacggtcagcccacctattcaattcttttttctcatttgacaatagttttaggtgctcttctgtgccaggcacatggcccactgctgtaatgtgacggtgaacaagacagtcaagggccctgccctcagagaactctgcaatagcggggagggaagaggacaaggacagatcatcaaagggagatgatctgggaatgccttaaattctatgaaaaaaatgatgtgtcatgatagtgacttggcaggacaagcaactgctttagataggagaaggcatttcagcagagacctaaaggtgaggggagccacgtgggaacatattccaagggcacccaacagaagttctgtttgtcttttgaaaggagtgaaaaagagcagcgataagcttcaaccacaaatagaattgcctagatgtcatcatttctgaggcaacccaccctttgcacatctttccttacctgctcattaatgcttaaaggtctcccaatgtggcaacagtcttcattctccaaaaaatagcaaagctattgggataggtggcagcatgactaatctatacagtgataggagtgactgttaacacttctctccctaaatgaagttgtaccaatacagattttataaaaaagagcacaagagaactgagaacctaaaggagggtacagaggatgtaaagagacccagagagggttgttatgggatggtggctgcaatgagataggccacactgggaggagctggaacctcgtatatacattttctgggcctttttcataagctaaatgacaacgatttattcatcatttatgaagatttcattttacatgcctatcagggtccatgtggcaagcatctagaagtcaccacctggtttgttttgttttaatttataccatatctctagtccatatgcccttaaagttaaatggcctgaaatgtaggcaagatctgactacaatatgtacgactcacccacatgcccaacatagcatatactctcacctgtgggccaaaatgcctgtgtttctgttttgttctcagtaacaatttttcttctgtttaagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacaggtgagaagcccaggtgccaatggccaagggatggtgggaagtagcttccagagacacattttgattctgattttaatgacaagagataaagccaataatgatataccctgagctagcccctgaatttgggaagggactgtgggacaacagataaaggacaaggctttggtccaaaagaaatatgtccttagcttagctctatgaatctgggcaagtcattgagcatctctaggcctcagttttcttatctgcaaagtgggaataatcatatacatcatcactgtgtggctatcaccagtgcttcctaactgtttttatgtcatgggcacacacagaggtctgtgtgccaccctggagttaatcaacaaggctatctgcaactgaacataattgtctgtggacgtcagccctgtaccccaaaatctgatggaattaatatcttcacacacttgtaacccattcagggcacactcatgctccacagcaccatggtaaggaagatctggctatgaatatttaagaaaaggtatatgaggctgggcaccgtggctcatgcctataatcccagtactttgggaggccgaggtgggtggatcacttgaggtctggagttcgagaccagcctggtcaacgagaggaaaccctgtctctactaaaaatacaacaattagccaggtgtagtggtgggcacctgtaatcccagctacttgggaggctgaggtgcctgtaatcccagctacctgggaagcggaggttgcagtgagccaagatcactccactgcacttcagcctgggcagcaagagcaaaactctgtctcaaaaaaaaaaaagtgaaaaaaaaaaaaaaaaagtacataaaatgctcgaagacagtgccttacacataataaacactattaatgaaagctcctgctactatattattatcatattatctcttcctacaaagtacattaaaagtgtgtctgatgttgctcagctatcttatttgtatatgttatggcatagctgtgattatgtgatttttcactttctcctacattcagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaagtatgacatgttttgctactcttatttctcaaatggagtagaggaagtatatgttcaacatcttactcaaatagggcttggattaaatccatatttttacatgggattggtctggatttgaattcaggcagaagtctctgtagatttgttcgttcattcaacattaacaacaagggacaataaatctctctctgccctcatggggcttacaattaggtaggacgtactatttgtaaatagacattatattttgggtgtgatgagggaagtaaatggtactatggagacacttgttaggtaatctgacccaatacaagagaacttcttggaaaaggaaacatccaaatagaaacctaaagcaagagatttaccaggtagaggtaggggaagaagtggagaatattccaggtagagagaataaaatattccaagatgagagaggagggagagtacaagatctaccaataggggaacagaaagaagtttatttggccatagcataaaaggtgaggattaagggaatcagataataaaatattttgtattccatggtaactactttgaactttattttgaaccaactggagccactcaatttcagcagagatatcataatcattatttacactttagaaagttactctgggtacagtgtagagaatagattgaaagaggcaaaactagaagcagagggatcatagttagcatatactgctgtatgtccctgagataaaaatacttcgacgacgaagcatataccagtttcttcccaaaggcattttgggatagatactatcaccctcaaagaaagacaggtattcagtgtagggactttaatccaaatatttgtgtttcaataatacccagtataagtagcttctgggatcagatcagatagttattggttgttgataaaatacatagttgaaagttagaaatttaagcaagtagttgttttatttttttaataagcattaatactataacaagtataacttttatgccacattgtatccaaagagcagttatttgtgtgtcaagagaaatatgtgaaaaagaactaagagttttagtttatggcgagctcaggatgagttttccgtggctgactgtgggctgtgttcatgaaatctgctaagcagaacaccctgcactggttaccaaacccagggcagaactctaaacacttctgaccattgcatctggtattagagtagccagggaaacacaatgcaaacactggatggaacaaagctttacttacatagagaggagacagagtaagatcagcctcaacagtatgcatcagtcccccacagccagctgcagtagttgcccagagatgcacttgctatcttcaaccctgacaacagaaaacagaagggcgcattgtctgtggtctcttccagcagccaatggagggcagttggctaagtgcacccctctcgggccacagtagaaggaccctgtcctgtctcctcagaggacaactatagcattggtgttcgccatctaccatgtgacacacatgcttaagcagaacaaaagagcatacattgagcttgcaacagggaatgatactcccacacaaggcaatgagcccagcacagggtgtgtaggctctccatctcttggtaagaaagtatcttaagctcaagggccatttcttacacagccaaatgggggttgatagactatgcacatgagactgcctttcccaacagcctcgcaggtgctcagtttaagagctcatacaactctgttagaggctaggcttataagtcacaactggactgttgtattcagtcccgggtgctagaatttaagggaggcatttaccaaaagggggagtgcccaagaggacaaaaactgccatgaaagagagactcagtgctgtttcatgaggaatgattatggtggaacttgtttttgttttgttatgttttgttttgttttcttcgaggcttgtatttattaggatcgggtgaggctatgggtaacagaaaatccaaaatagcagaagtttaaatagaatagaagtttataattttcatgtaaaatcattccagtactcaatttctcacaaatatgcttcaaccataatgaatgatttgcagttctcaattttctaccatcccactccggcacctcctcctttggtacctgggtttctggtttttctctacgtagaatgcctctttcgtgataccttggcagagtgtcacctctgccttacagcttttactaactcctgctgatcactaatagccagcagctaaaagttgtgtgtcacaccacatagcaccttctctcaccatttcttctggtatgttttcctttctaccttgtgttatggctattttggactcatttccatttgtagaggttagagctaacgtcttatttacctctgtactgttcataatccccagaagagcacctggcacatagtaggtacttgtttctctcaacacgtgaaagaagtgttcactccactctctttttgtttgcatggcttcagaggaggacataattcttaactttgcttctctatatgtaagttgtttttccccctctggcttctttcaggaatttttctttatctttgattttctgtagtgtgaaaacgatatgcctagccatagtttttttggcatatatcctccttggtgttttctgagcttcctggatctgtggttggtgtctaacatttatttgtgggaaattcttagtcattcttgtttcagatatttcttctgttcctttctttcttcttctggtattcccattttgtgtaggatacaccttttgtggttgttccatggtccttcgatcttctgttctgcttttcagtctttgttttctttgctttttccatttggaaggtctctattgatatatcctcaggctcagagactgtcctcagccacgtctaactattaataagcccatcaaggcattctttaactgttactcagacttgtccacacctgtcctccagcttttcctaccccaaccttggttccctgggagatttatgctcatgtgtctctgctagggtgagccacgacactctgtatttgcctgtctgtccctcctatacctagatctcagagctagttggacccaaaggagctgaaaaaaaaaaattctccctgagttctgaaaagtgttgcctcctctgtttcctttagagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgtaagtgtccctggaggtgcgcacagagcctcctgtcactggagtgaaggggctgtgcacctttctctatcatatccatcactgctattcacttgcatacacttcacttttgcataagcctgtctgattgccacctggagaggaggacctaaaagtctccagaaatggaaacatttctctgggtaaagtaccctgacagcaaacaagttagatggtcttaaagtacctgaatgagttagtatttaaatatatcactttgcctcatatagttagagctataatggagctcttaagcaatttgaagctacaacttcaggaaattctgctgaagagctacctctttcattatgtttaatgtgccactggcaaatcacttcctctgcctgttttccttcaggagaaggggagagtttcttgattacagcattaaacacaggcacacgctcacacacacacagtctgatgcaggagagcagaatccttcatttcactaactgttgtttatgctgtgaaagcagagttgtgacccctcttggttccttccccacctctttttccaggcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggtaagttatcatgagttaactccactctgagacacagaattgcttcctcagaggtcatgtgggagatctttctgtgacaaagtttaagaaacttaagtagaaaatgtaatttttgtatcattcacccctctctctgctggatacagggagatgtaagaaaaagctgctcaaaggctctttgggcaataaagcctgttatcctctgggtttaattattaaatagaagagtaatgataatagcaaccacaacgataataacaataaccatcatttattgagcccttactacgtgctgtgcactattggaagtgcattgcatgtaatgccttattcagtcctcttcattattgggtcagtcttgttcactactcttttgttctaccattaaacattaatatgcctcaactgtcttcacccctccctgtctcaaatgcctcaactgatcatgcttgcaaaccacccaccaagtcacaaaaataaccaaaagcttaaaagaaggaaaagatgttcatgaaaaacattcttcccttctccactgaattttgaatagttttattctctagtttcctaaattattcaatatctacctaattcctacagataagaacaaagtctagggaatagttatcacaacatcacatacaaccactcagtatgagctttcaagcttattatatcagcatttgtcaaaccacctgtaagagtgttgtatttggggcacacctgtccatatatgtattcgccattgaggtcttgtgtgttatttctccaaaagagatgcttgtgcctggaatgacattaatatagtttacctttcttatatatttttatactgtttaaggtgctgcatgagtttcttaagcatccctgataattttgacccatttgtgggtaagggggaaacttgaaacctgacaaactgtgaggagtttctaggccaatgggtattttaggctcacagtatctaacagtctatgtgctttcacagtttatttaattgtactaaatctggttatgcacaattaattaaataatttcaagggtcagtggtgtgtcccagatttcctcacaccacataattgaagataaattagtgaactgtggaaagactttagacttaattagactgcaatgaagacagtgttttgctacatgaatatgagacagtaaccaaaaaagtcacaccccagaaagtagccttgtgttccccagccagacagccttcccattattgatgtccatggagatgagctgtgatttccaggttagctaagataacaatccatctcatataaacgccatttatagtgtacacactcatgctaaagacaacatttctttttaactactgccaacaaaatatttctaagactcacttatgagcaaattttattaaacaagaatccaggatgctatgataaaccctcactgcaccacttcttgaagctcattgtaaatagtatctgatctctatagtatttatctttctacttacgcttttctccagccaacatcaaaactggtttgcagtgccaaaacacacagcaggctgggtggacaggggaagagttctgggaagtgctctgagtaaggggccaaatttggatggggattaaactgtactcaagataacagatccacatgcagagcaataatcaaactgggcatgacatgtggagcacgccttgtgggatgactgctctggcctaggacatgatttctcttatctttttcctatttcccaggtcataggggtttccttattagctcaactacaatggttattggcaagatagtttatcaagtgggttcactcacaatgggagttgtccaacactctggagttgtgagacatgctctcatttaatgcaatgagctacccttattttatttcctaggaaaatgatgctgtgtgtgtgtgtattttatatacacactatttatgtattttggaaaaagtgaattaaaattaactttattaggagaatttcacatcgttctttgagattgcagaatctgtactttggaaatggccagagatagtggatgtggaggcagccttagaaacctaatttaaaatcactgaaatcacctaagtcacaagaaaggcagtccttaactgtgggttttctcctccaggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacaggttagatatattaccactgttttgctagaagggacatgctacattactaagcactcagctgtctgagcaactgatgcatgcgagcttccatagattaataacctacgttacaagagtactgtgcattttactgggtaatttataaacgttggattcctgcctccacttgcaggtaatgtgtcaaaagggacttcagcactatgcaaaagctccagttcattaagggaagaactgaaggttcttaatagattgttctttcttctacaactttcattatttttttttttttttttttgagacagagtcttactctgttgcccagactggagtgcagtggtgccatctcggctcactgcaacctctgcctccctggttcaagcaattctcttgcctcagcctcccaagtagctgggattacaagtgcacgccaccacacccggctaagttttgtatttttagtagagatggggtttcaccatgttggccaggctggtctccaactcctggcctcaagtgatctgcctgccttggcctcccaaagtgctgggattacaggtgtgagccaccatgcctggcccttctacaactttctaaatatgagtccaatactttactttgctcattattgtaaaaatttccaaataaaatgactgagtttagggagatccaaaaacaatatgaagttatatcttctacttataatgtgaactgaaattatactcacttatttaccttctaaggcatctaaagatggaagcgctctttgctccagacagaactctggaaggcaaagacccctgaatgaatgggaacacgcttttttccccatggagatgactaatgaaaaggagcagctgtctggctttggctccaggaaacatcactgcagtcactaggcccttcggccctaggaattggcagtgctcttgttctgcactgtgttttcagaaagcaggtacaagcagaagtatatagcatcccaatcagcatcctcaagagaaagggaacctaggctaccgtcttggatatagagctactgacatccaacattattacttctgcagaggatgtaccttctctgttgggtgttggaagagctgatacctaaccaatatggcagtaaattaggttttccatgggccagtgttcgttctgctttgttgatgctgaggtcttattggttctcacatatttgaagtatcactcctaggtctcagtagaaaaaaaaactctcctgccacttccaaaaggagactatgacgtactgttacacccaagagagttcttagcccctccctcacatcaaaaaagtcagacagatgtttttcctaaaacaaagcactcatttttggcaggaactctgtaaagctacctttacccaggactcaccagacagttactgttacctcccaggcaaggtcagcacctccagattaaacaaacacaaactttttagtcatacttacttcaaaaagagaccatacaagcctacctaaaggaaacaagatttcagaagaacaagggagaaacatgaaagatcagaaaaccaggatttatcagttcctgtaagaatcaagagatgcggctgggcgtggaggctcacgcctgtaatcccagcactttgggaggccgaggtgggcgaatcacttgaggtcaggagttcaagactagcctggccaacatggtaaaactccgtctctactaaaaacacaaaagttggccaggcacggtggtgcacgcctgtaatcccagctacttgggaagctgaggcaggagaattgcttgaaccctagaggtggaggttgcagtaagctgagatcatgccactgtactccagcctgggcgacagagcaagactccatctaaaaaataaaaaagaaaaaaaaaaagattcaagagattcctcatctccttggttacctgggctcaaggaaactcgagcaaaagtcacctaagggctattttctttttgagttggaaaactgaagctgatttagtttgtttacttatggaaaggggaggggtgaagataactcattactaaatttcaaagagagtaagaagctataaaaaatttgtgtctggaccagagcccaccaatctcccagcacccatagtaactgcggaggtctttggaagagcccctgcatttgagttccagctctgccactttttaactgtgtaagcagcatttcaattctctaatcctcatcttcctcacctgcaaagctccataaggttgtcctaagtagtagtcctgagtatgtgacagatcaaacctagtcatgtcccttctaaattaaggttttcccatagttcccattcacttaccagagcaagagcagattccagtacagggcacactgagccctgctttctcccgcctgcctcaccagccttgtctccaatcgtatttgctccaagtacccactgctctcttgctactcctcactcctcagagttcctgaatgtgacatggttcttttatacgcctgagcctttgcataatcttttcactctcagatgctttccgctcttatctggctggcgaattctctgtacacttcaaaagccagctcaaccctcaaccacccacactatcctgtcagcccacagctgggcagttgggtgctccatcagccccatgtccacgtccccatcaccgtctgcctacattcctctaatcctacatttacagtggcttttaaccctttatcgaattacctgccctctttactagactgcaagaactcacagtccaacaggggagacagatgtgtcattggttacaaaacaatatggcaagttcctggcacaaaggatgtgcttgtgaaatgtttatgaacaaatacgggaatgagccaagatgctctaaggatgtaacacattcgtgttatggcttcatcatctctgtgtacatatttgtttttcagaacacacctttcctatatttctccaatatatatgtttacttcagtcctgttaaaagcatgccagacagataatgcttgatgagaggaggtgtcgtctcccaaagcacatcagagaaccacatgcaaatcagcctcttgcgtggtggctgctgaactcagtccagtcagaattctgcctgtctcaagacagtcattaccacagtgaccctccttgttgttaggcatccttttttccaaagcgaataggtggacaggaaatagcacggtaaaagaataattaggattgagaaatgggaaatgctaggtttagctgatacgcaagtttattatgtcaacagatataatgtgtttcattcattgttgggttcctatgattcatatgttttattccattgttccatatggaaagagaaagggcagatcattatggtgagagagagttggaaggttaggaaagtgctggtctggttttgtttttattctaaatagaagagcagtgtgaccatagtaaggtggtcagcttctcctgacctcgttttcttcaaaggaaggaaattgaaccacatgatctctaactttctgctatagaattctgattctggacacatttaaagtggaaaaaaatctatcagatatttgttcattaaaaatagtgtcttgttattgtgtcatattcataattatctttctataatatattcagcacattttattgccttatctggcaatacgtgttgttgggtgatagataaataaggtggagccactgccttcaagaagcttacaatgtggagacagaaagaagccacatctgcaaaatagaggcagaaatgttgaaggacataaggaataaaggaaaataaattctgtgaaggttcagaaggcttctcaaaggatgtattaaaacacaggaattaaaacataggaaaggatttagaaatacccagatagggacagaaggagattcaatgtggaaggaatagtgggagtcaaagcgtggaggtttaaatacacaaattgtttagagaagaacaaacagtccagtttcaaacagagggtgaataaaaaggagtagactgggatgataggacgagagaggactgtgggtgggtgctaagtgctgggctggggaaagtagttgtgatattcatttttggaaaagttttaagggaagagtgcctgataacccattaattttaagctgaacctatactaggtaattatctccttcctaaaggtcctttttatctgcattcattcagtactttgtgtttacacttgtggtttcagagcagaccatgtcaaggttgttatagccaatgcttttattttacagatgagtcataaagaactttagggaccattcaagtagccagcaatggagtaagagtgagaactagacttcagatcctcttgttcctagcccaggcttttttcatccttcctacaaaagtcatggcgtgtgtgtgtgtgtgtgtgtgtgtgtgtgtgtgtgtgagagagagagagagagagagagagagagtcttgctgtgttgcccaggctggagtgcagtggtgtgatctcagctcactgcaacctccactttttagattcaagcaattctcatgcctcagcctcccaagtagctgggactacaggcacgcatcacacgggcctggctaatttttgtatttttaatagagatggggtttcaccgtgttggccaggctggcctcaaattcttggcctcatgtgatctgcctgccttggcctcccaaattgctggaattacaggcatgagccactgtgcccagccagaagtcattgcttttaaccaaaaattaagccatgaggaaataagaaaagagatctgcactaggagccagaaatatgaagttcagttttcgttcatatctttctgtgtgatcttcgagaagacatggactctctcctagcttcaggttccaaacctctgaagtaatataataaacttctttattatattggagaggttgaacatgatcaaacagaaacatgtttgaaaaagtccttatggctgggcgcgatggctcacacttgtaatccgagcactttgggaggccaagacaggcagatagcttgagcccaggagttcaagactagcctgggcaacatggcaaaaccccatctgtaataaaaatacaaaaattagctggccatggtagtgtgcacttgtaatcccagctactcaggaggctggggttggaggatcacttgagcttgggaggtggaggttgcagtgtgcattccaacctggtgacagagcaagaccctgtctcaaaaaaaaaaaaaaaaaaaggaaggaaagaaaagaaagaaaaagaaaaaaagtatttccacacttataaataagaaactcttatcagagagacactgaatttccaaatgtataataaattagcaacatatttgccaaggcattggtgttatggtggttagcatagctgccttccaaaattagcaaaacacaccaactcctcaccttcccctttaatgtgtggtgactacttgtttccctttgtggacctttctcaatatacttccattaacaggctgttattcctggaagaacaccttttgacttggaatggatcttttggagatggaagttatagatgtgatttatcaatatcatcttgatgttcattttacaggattacactcggatctgggcataagtcagaagaagcgggagcagggtcagaacaatttgccctggcctagtaccgcttcagcattatcacaggacatgccaagaaatatagattttaaaaaaacaaaaacaaaaaaaaaaaaggagtacttctcgtcactttcatagaattgaaattaacactagcaaaagttttcccacataaaccaagcctaatactccatcagttcaattagagaatcttcacaataggagggacttaagaagtcacccaagccaatctttaacttagagcagcgatgccctcctccagcttccctgggactgcttctcctccagcctctactagaatcccactcccatcttccaacccccagtgactgggagctctcaacctaggaggcagctcatattctaatgttagaaaacagcttaatgttcctaaactcctccttccttataaattcagcctacagagcctaattcttccttcaagaagaaaaataatcatgttgttttcctcttctacatggcagtcttccttaaatctgaagctaactatattatgtcccttgaagtcttctctatcattgttcaggtcagtcactcaaatgatctctaattcatcctaaaatatgcccccagaaattgagtgcagctctccagactgggctgacttatgcagagagcatgaaacttaggtcctatgatagggatcacaggcttctcattcaagcagaggttacaaatctgtgtgtttgtagctgcatcttgcttgtttattgaatttaggaccagctgattttcaggcactatcccacatggacatgtggacagccacctcagcaactctcctgctcaggtgactggaataatgccagtgtcagctggatagttgtaaatcaatgcctcactgtccctctaaatcgagtatatcccaagcaaagcatatcctccttcaccagtctgtcatttttttttttttttttgaggtggagtcctgctttgtcacccaggctggagtgcagtggcatgatcttggctcactgcagcctccacctcccatgttcaagtgattctcctgcctcagcctcccaagtagccaggattacaggtgcccgccaccatgcccggctaatttttgtatttttagtagagacggggttttgccacgttggccaggctgatctcgaactcctgacctcaggtgatctgcctgccttggcctcccaaagtgctgggattacaggcgtgagccaccgctcccagcctgtctccttatttctatcaatgatcccactgttctcttgagtgacatgagctcaagtcttaggccatccttgattctcccctgcttctcttcagtctgggccccatctagttcctcctctcagtgcctttcacagtcttctttccattctcattgccagggctcctggccagggccctgtgtccttggcctgactatcccagcagtctcttcattgagctctctgctccagccacctcacctcctatgcccacacacactgtttcctccatattctaccattcctcatttgccattgtatatatgctttcttattttgctatttgcctgattcctttgtattttgtctttcaagtttccaagactagtgaccatacatctctttttaacttcagcaatttataaagcagtgctttaacaaatatttcctgttgacaataaatatgatattagaatatttttagataaaatgatctttagaaaatagtgccaaaagatatgtaagttaaaataacaacaacaataatattgatatttgggccacttgacttctctaatgggcatctcagaattacttcctccacaactgatctgtctggatcttcccaaaccccccagtctacttctcaatagttttccctcatgttagtaggtgacacctccattcttccagttgttccccatccagaacatgtggaatcatccatactctatattcatcagcaaatcttttagttcttcctttgatatatccaacacttctcactcactgccttcatcactaccattctgaatgaagcagtcccacatgctttattcccattgctttccatcttccttaccctgctcttttctttttcatagcacacatctcatctgatttattatatttgtgtgtttattgtctgacttcctccatgagaatgtaacctctggaatggcagggactttgttttgttccttgcaaagtcccagctactagaacagtgattggcgtgtggcaggggctcaataaatatttatgaataaattgatgaatgaatgcatgaacccaggtctatccgattccataactcatattctaccctgctacccactgaccaggaacccgccctatttctccttgaacacatttttcagctactgtgttcaacaactaatttatatttaaataaatcggttttcttttcagaatcagcattcgagcttttacacagctctttgatgaggacctgaaggaattcacaaagccactctattcagacacatttttttctttacccatcactactgaatcaggtaaggctaacctttacatcatgttctaccaactgccatgtcacctacaagagcctctaatggggagatattggctgatggtggggggaacatttattttcatttggaacttaatctttatgtgaccaaaaattgatgtggatcaaagggattgtacaacctctctagaagaatggattgaaagggggttaatctaaaaagaaggtggaagtacagtatttttttctattaaaaatgaattattttctaaatagtgagtgaaaaccattaaaatcaagagttttcacaggccaaaatataagttactacaaaacactttcagttaaaagtgagaatgtatatatgcatatacacagaaatgctcaggaaaaaaagactaaaagaaaaaaacaccaaagtattaatgatgtgtatctcaaagtaatggaaatacaggtgatttttcttccttttgcttattatgtgttgactttgtagtactaaaaaccattaatataaaagactgtgcataacaatttctgaaagagacttctctagtgtgttagagggaaagcctgagtaataatagtggctagtatttactgttcaccttctctatggagacatagttttaagcattttacatgggataacttgtccaattctcatgacagtcttttgagctagatgctattatcatccccatcttaaagatgaggacatgaggcaccaagagattaagtaatttgcccaagatggtgcagctgaaattctggcactttctgcccaagcgtacaacctctgcactgccctgtctctgaatacttccaccaggctgagaatagcatcatttcatcaccttccctcccaacaccatcgtctgcgtagccttttcctgtaatccgtgttctgcaatgcttgatctctaggtctgggaagttctttacagctaaaactgtctctcgtgctgcatgacaaacgatgactcagcctcacaaacattccaatctatttatgccaaatatagggataatctcccaatttcaagctaaagggggatgagaacacagttaagaggatttagatgtctttacttataatttaatgtagggactttgtaaacacaattctttcctttttgaaatactgttacatgacaaaaattgcatgtagtccagtacaggaagacagtaaacgtatattcaaaaaaggatattaactacattcaaggaaagatgattgtgttgatttgatgagtcttgaaaagcaacatggaacaaacaaatctaagatcttaaaatgcaacttcaaaaatgggccacttcatagacctaaatttaagggataacacagtaacacttttacaagaaaacataggtgtaaatctttgtaaccttggattagaaaatagctttttagataggacaccaaaagcataagctacaaaagaaaaaatggatactctggatttaatcaaaattaaaaacttgtgcttcaaaggacactatcagcaaagtaaaaagacaacctacagaataggaagaaaatatttattttccaaatcacatatctgataagggctgaatagcatataaagaactcttacctcacaatttaataataaaaacacaaattacactatatatatagtgtaatatatatatttttttccttttttttttttcttttttttgagaaagtctcgctctgtcgcccaggctggagtgcagtggtgcgatctcggctcgctgcaagctccgcctcccaggttcacgccattctcctgcctcagcctcctaagtagcagggactacaggcgcccgccaccacgcccggctaatttttttatatttttagtagagacagggtttcacgtgttggccaggatgttctcgatctcctgaccttgtgatccacctgtctcggcctcccaaagtgctgggattacaggcgtaagccaccacgccaggccatatatatatatatatttttttttttttcaagacggagtcttgctctgtcacccaggctgtagtgcggtgatgccaccttggctcaatgcaacctccacctcccaaattcaagcaattctcctgcctcagcctccccagtagctgggactacaggcatgcgccaccacacccggctaatttttgtatttttagtagagacaaggtttcaccatgttggccaggctggtctcgaactcctggcttcgtgatctgcctgcctcagcctcccaaaatgctgggattacaggtatgagccaccgtgcccagccaaattacacaatatttaaatgggcaaaggctctgaatagacatgtctccaaagaagatatacagttgactaataagcacatgaaaagatgctcaacatcatgaatcattagggaaatgcaaatcaaaatcacaagaagataccacttcacacccagtagcatggctataatcaaaaagacagtaacaagagttagtgaggatatgaagaaatcagaaccttccatacactgcttatgagaatgtaaaatggtgtcactgctttgaaaaacagtttatagaaatattaaacctagagttaccatacgacccagcaatttcactcctcagtatatacccaggagaaatgaaaacatatgtccacatagaaacttgtacatgaatgttcatagcagcattattcataatcgccaaaaagtagaagcaatttaaatgtccatcaatggataaacaaaaatgtgatatatccatacaatggacgattattcaaccataaaaaggaatgaaatcttggtatatgctataacatggatgaaccttgaaaacattatgctaaatgaaaggagccagtcccaaaagatcacagatttatgatttcatttctatgaaacatccagaataggcaaatccacagacacagaaagtagattagtggttgccagggatcgcggggagggaggagtgggactgactgctaataggtatgcggtttcttttgagggtgatgaaaatgttttaaaattgattgtggtgacatttgcaaaactttgactatactaaagaccactgaattgtacaacttagatgggtgagttgcatgctatatgaatgatatttcaataaagctattttaaaaatgaggccactcttacctcttcataaactcccagtagcgttaccataccagataataaaaataagacttcttaaaatagctccaagcaatccactggattttccaaagccccagatgctgtgtaacatgttttatataaatgaaatggcatttttatcttggtggcaaacttatggcctttatctcaggtgccccaagctttatatacaagtgcaaagtccaaaattcctctataagctatgcaacattaacttcaaaagtatgcagtgacacctggcctcactgctacagggtgggagccagcctttcatcatcttcttaggtgcatactcagagcctttggaaagtaaatgcctcatcgtgggcatcacttgaattctatttgtaataacattacttgggagatatggcttcaatagctttcttactggttccctagcactaattttcccacctgcgtttgttgtttctatctggattattgtagagcccttgtttggagctattgaaggtgtgagtgctggtctgtttttaattggcatgctagtggctgttgttgccttattgatctgcagacagaaagtgaggtaagtacaaagatccttttggtgattggacccacaactttaaaaatgcaactgaaaattccctttaggctgaaaactaagaagggaaaataatttaatttttccaggttaaattgtcactgttttctcaataaaaacaagtcaaactctaaagccatgactcacttttctcagctcttttatatcccattgatgaattcagcccttaccaaaggactgaggggccatctatagctttatttaaagatgaagtgactccttttgcacaggaaaaaaatattttgtgtgtgtgtgtggttcatatcctcatgaagacagagatgtttgcaaattgcatgcccaagtgcttttctgaaatatcctgaaaagtgtggttgacatcaccattttgtagttcatatctgccatcctaatttaagaagggaccaaaaagaaccaaatagcatgtggccccaagtgtcgtgccttcttctcttagtgaattttttttcttaatttggcacatgttcctctttattgaagtcgtgtctggcatctgaaatttactggatttttttaaagcaaagttttattgagaatgtgggaagtgattataacctgtagccaaaaaccaggagacaaatcttcagtttttgcagagatccgtttctgggtgggaatgatctactttattctctttcctttccctccctcagagatgttggctgagtgcaaatctatatgaatactgaaaaatccatatttgcacaaacatccacagccttaccataaatggaaaaatttgttcaagccaagtatcataatcagaataaaagttatctcccttatgtttcagccatggtcgagaaagaccctctgcccgtctgagcattcgtagggatcgaccattatctgtccacttaaacctgggccagaaagggtaagcaccacatttgccttcgtataatttgttgaaagatggtattatgtgaaatttgctaacaaagtcttcctcttttggcttctcttcacagtaaccggaaaacttcttggtaagagagagaacacattaattactatattatctgcctttgaaatatgagtcagaatagttatggcactttcccttttctgcagtaactcttttctgtttgtttcatttttaattacagtccaataaaaataaatcagtttgaagggcatttcatgaagctacaggctgactccaactaccttctatccaaggaatacgaggtacaactcaggcagaatgaagcttcagcatccctagttcttagcagaatttccttcctaatgtttactgtgtcatcataggctgattgagctcagaagttaggaggctgcttagaatctcagctgagcactcttttatgcctaaactatgccctgaatagaatataccatctaatcttagaggccagcttgagctccagaataacacagcaaaccaagggctacctggatcagatagtaaggaagaattaacaaatctcaaatgcagacctaatgctgtcagatattcagcctggccatttgcttggctggaagatgccgtggtttcgcaaaaagcacgtagcttttggaactgattctcaggtttgccacttgggtgacctggggcacatcagttatcctgactgagcctcacctgtaaaatagtgagaccaccacctcccttgtggggctgttgtggggatcagggctaatgcatgttgagtactaggcattcataaacaatagctagtgtatatattttcatgttattatgttatctccaggactgtatgatttgctttattctatttcatattctccacttacaaactcatatttgacctaacaggagttaaaagacgtgggccgaaaccagtcatgtgacattgcactcttgccggagaatagagggaaaaatcgatacaacaatatattgccctgtaagttttgtgtcaaaatttgtaatactgtcttcctctagccatttctgcatttttctccaaaaatgaaatgaggctaaagaaatataatatagctcgatatggacaatctcaagctctgaatgcctttaataagaaatagcttgtatattcctgcacttccctccagagggataatagccagtttaaattctgattatgaaagtcctcttatgctgttgacatttccccatgtgatgctattgcttctctttggaggctaagcagtaaatggggttaacagcaagggctctgacatcaagcagacctgggtttgcttagcaaagtcttcggttagcaatttctacttaaatttccttaccccattaggtaaagcaatagaaggtaggttttctggattgtattcattccagcagtgaaagggagctggccactccatcaggcaaatgtggtaatgttagaaagggaagcacagatggggcttcatgttgtctcctgtgtctgactggttataggccacctatgcaacatggggcaagttagttatcctgcctgagcctcatctgcaaaatggagataagatcacttcccatctgtggctgttgtggggatcagagctaaggcacatcacacacatcacataaactgtagaaaagtcactccaagactcagcagcaaatctctccttccagatgatgccacgcgagtgaagctctccaatgtagatgatgatccttgctctgactacatcaatgccagctacatccctgtaagtgacccactaggccatagtgttcaggatgaggctttggtgggtggctacactggagatgccactcctccatgttcctgttattcttaggtctggaaacacctgtagatttcagaagagcacatctgaatgccataaaaaaaatggggtatccaattcagttcctgctacgccacatttttcacaatggctatagtcaaatgaaattatgagcccaagatgcattttcatagatcatctactctctgcagtccttaaccaagatgagagcttcctaaggaagatggacctcccctgctaaagctgcctagctagagaagctgatcccatgttatttggaatcttcacaaccacagacacaactcaaaggttatatcaaatctttgggctctggttttggttagcatcttgccaccttcctatggcatactgcagtggaaaaagctttcgggtcaaacaaatctaggtttgaatcccacttctgccccttgttgattctgtgaccttgggcacattatgtcacctttttgggcctccattttcttttccaaaaactgatgataataatatttacctcatacctcaagcaaccatccattcactcaataaacacttagaaattaagtgctaactgagctgtttacaggcatgggataagatggaatcctgaccctaaaggaactctcagaagagttgaggcaagaaaaggcaatggcatgggaaacctgccacagcagtgcctctcctacattgaaagatgtctgcgccatctgaggatcttgtgaaaaggcagattctgatccatcagggctgaggcagggcctgggaatctgtatttctttcttttttttttttttttttttttgagatggtcttgctctgtctgccaggctgtagtgcagtggcgcgatctctgctcactgcaagctccgcctcccgggttcacgccattctcctgcctcagccgcccgagtagctgagactacaggcacctgccaccacgcctggctaatatttttttgtatttttagtagagacggggtttcaccgtgttagccaggaagatctccatctcctgacctcatgatccgcccgccttggcctcccaaagtgctgggattacaggggtgagccactgcgcccggccgagtctgcatttctgacaagcctcttggtgatttcagtgctgctggtctgagaacggcactcagtagcgagaggctagagattgccatggggcatcttggagaatatcccccagcagagagaaagataaaagaaggctcagccaagcaggcaccatgctgaggataagtaaggattggtcagatgagaagcagtgtttgggtgggcgggggtggcgatggcagaggtgacataatgtggagaccctgaggaaaggcaaagagaaagagcttcgactagaattgacaaggaattgctgtcattgccggagtgcagaaggagtagatgaaaatatcccgctcttggactgtggtttggattaaataagtcctgacctgcgacacattagatggtagacgctcagtcaacagtttctcttccgtgatgcttcctgtggatgatatatcttaccaaattattctgacattgattatccaaaatgactaacactcttctacattaaatagggaaagagcctgattacagtccctccaacagtctacacaaataccccccaacacacacatataattgagggtgaagtgttttctagatcattgcctaagtcccccatttgctttcagaatagacccaggcaagtaaaagggaatgtggctcttaacactagttcaatgttctgacctttgtccttcctgctcccaagcattgacacttgtgttagtatctttttctgaagtcagagacttggcagagacctccctatcatctaatctgaagaactctttgtttatagttctgaagaggcccattgtttctgactctccatattgtaaattcattgcagggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtgagtaaacagccttcctggcatcaaagctttgctttctgccacctggatagaattctgccccatcatcaaagtgaaaccccgcaaaacaacgtagggatcatgtgagagcattgttagtgacttataccactctgttcaaaagactctaatagtaaacccaagtgatgcctgattctgattctgggtctgaagttccagtcaaagctgtttccatttgaggactgggattagtggcagtgcccattacaccaaaaattacctggccacttggctactccattcttcagtgtctggctggaggagagaccctgccagagtcactggacctgcccctcatcccaggaaaggagaagtgagttgtagactgtgttggcagacacaaagtaaaataataatccagacaaatcaaccaaacccccttgtaatgcacttaccatcctctactttatatggttattttgaggattaaaagattgaggattaaaagagagattacgtataaagtgcctagtatctgcgctcagtaaacatatgcttacattcctcttccccttgtctgtatacatgtaaaggcgagcttagctaaacgttctaacttctcaaagatctcttggcacacggcccacgttaggacagtgacataaaaatatgaacgaagaagggccaggaagacagtgccttcctctacccaactagatatttctttctttagaaagaacaatacgttgtgaaccacagtttacctgctagtggaactgaaatgctgaggggaaaaaaaaaaaaaaaaaaaaaaaactcaagccatatattactgggcctaaaaaatgagtgaacccaaaggttggagtcaggggtgctccttgtacaggctctccccttcacttggagcagcacctcagcttcagcactggccatgagaaggttaatataaagtagatggtcaaattgctttagcagctgatcccagattcctaactttggaagacatttagaggagggaaaccccaggttcaccaaggagtcacttttccggactcatgttttttctgtctgtcctgttctaggtaaagtgtgaccattactggccagcggaccaggattccctctactatggggacctcatcctgcagatgctctcagagtccgtcctgcctgagtggaccatccgggagtttaagatatgcggtgtatgttagcttgcttgacttaacaaccgagcttggggagatgaatgagatctgtgaaccccactttcgctggttcctctcttgtagtttcagcccataggagttgctccatggctcagctgtcaagtttgaaggtttgcattggacagttcctcttttatcctgctctctgctcttacaggaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcaggtactaggaaacctagcagccaataaaatggcagccataagggggttgtgcctgggagtctggaaaaatacataagcatggggaatttggtgggtggaggatttgtctggaccaaccagcctgcctcgcccccagagggttttataacgttcctccccttctgccaacatcatttctcttccctgacttcttttccactttcttcccctgtagcctctctctcatcctcactctccagccttctctctccctcttgcttttttcctactttctgaaatgcaaagtcctgatgggaattccatgctttccatcatcaggcatatcaccttcaatctaagttcccaataactcccttcacattctagccaggaaagtgagcacacaagcttattcttgcctctggccattcttccattttggaatggctttatctctcttctccacctaagtcctacctatccttcaagatttattttctaatcttccctccaggtctagtagcatgtctttgtctatttgtgctgctaaaacaaaataccacagactggataataaataatagaaatttatctgtcatagtctagaggctggaagtccaaaatcaaggcactggcagcttcagtgtctgttgagagcttagtctctgcttccaagatggtgccttgttactgtgtcctccagagcagacaaaggctgtgtcctcacatagagggagggatggaagggcaaaagaacctagctagttccctccaactgtttcacaaggcaccagtcccgttcatgagggcagagccctcatgacctaatcacctcctccacctcttaatactgttgcattgaagattaagtttcaacatgaatttttggaggggacacaaacattcaaaccacagcacagcaattgccacctgtagcacctaattttttctcttaaatttgttctcttgatttctctttgcttcagtctgtccagaaaatcaacctaacaagtgaaatctctctctctctggcgagcctggtatctagcaaattaatgtttgcagcaacattttgatagccctaactgaatggcactaataaatatggagcagggaactgcagcagtaagagaaatgccaagtgtactcatctcctccctgtcagcccagcaccctaggagccctgctttcctatgtccttggaaccttgacacttttaataggaaggtgaggcactcacctcagagctttctgctttttgaaaaatggcaggcatttttgtccaggaccactggagaactgttatcttataaatgtgtgtatcaaaaatccccagatgacacaaccattttggggaggaatttggcaatccctagtgcagctgaaggtgttcatgcccatgaccaacccaagagttctgcttctaggtgttgacccctgagaaatctccacatatattcatgttctttgcaacacatgttttaatagagaaaaatttaaaatgatctcactgccactggattagcagtggtttatgaagagaattaattaaaagaaattagatcagctgggtgtggtatatcctgcctctaatcccagcactttggaggccaaagtggaaggatcacttgaggccaggagttcaagaccaagctgggcaactattagggagaccttatctctacaagtctttttttttaattagctgggagtagttacacatgcctgtggtcccagctactcaggaggctgaggtgagaggactgcttgaacctgggaggtcgaggctgcagtgagctatgcttgtgccactgcactccagcctgggcaacagagcaagaccctgtgaaggacggaaagagggagggaggaaggaaggagagagaaagaaagaaggaaggaaagaagaaacgagaagatctatatgtagcaatatagataaatctgaaaacataatattgagtaggaaagttgacaaaaagatacctaaagcacatatgttaccatttcagtagatttttcaaacataaatgtttatagatttacctgtatgtaggaaaagtattaaaaacatgcgtggaaatgatacacagtaagtgcagagcagtacttatccctggtagagtggaggagggacaggaagggagtggaaagagatagaaggctgtgggggggtggggttgggggactctaggttaaacttatttgagagaaagaaatattcctatcttctcccataactgggaagggaaaaaaaagattgtgccagagtctctagatgcaatcttgaaaggcaaatttaataaaaaggctcaatcttcctttgccatctcttctagtgctggtgtgggtaggactggaacctttattgcattggaccgaatcctccagcagttagactccaaagactctgtggacatttatggagcagtgcacgacctaagacttcacagggttcacatggtccagactgaggtaagagttatagactgaaagttacaggccaccctcctccccactgtattcccacaaaaaaatatccaggaccttaatctgacaaggggaaataactatgacacattaggaagagaaaaaaagaactgcatgtagatattttctaagacttgttattttaaaacaaatctcactggtcttgaaggtgaccatcttggggatcattttaagataggctggcagatgagcataagaacttcacttaggaaagaagaagatcccaatctcttctctcccccagccccactccctccacctacacccccatttcaggagaccccaagggagtgtatgtagatggtaaagaccacgtgcttccatttgtgcagcactttgacatttgcagggcatttttgaacatgttatctcattaaattttcacaataaccaagcgagacatattatattctacttccagactagaaaatgaaggtccaaaagcttaagggctttgcacaaagcccacagccatgaagtggctgaggtggcttggccactattctagagaaacctgggcccttgattgtgctataagcgtactagcctcagggtcagatctcttcctcaatagagaccaagcattcactcctctgcatcaatgccttctaaggctcaaattctcttaccctcgtgtttcacaagtttttctccaagtaactaagcaaaatcctctgtattaaaaaaaaaaaatccatggttggaaaagtaaaaagttctacatgcttctgtgtcccctcttagagccacagtacccaaggacaatgcacagacagcaatgctccataaaaagagagcttcctgcagccaaggccccctttgagctttattgaacccactaatcccaaaaccaccttgacccctgaattcttttcttgtgcagcacatattaatatcctgcattcaagccagtaacaattgaaccagagaaatgaaaataaaaattaaaaatattctgcagaactcacatttgacaaaacaatggcatcattgcctcctgcaggcaggaacctctgccaccactattgtcctgggctgggagtactttcattataacaatgattctaccatattttgaatgttttattatgaaattgttttgaaaaaatatacaaaacatggctgggtacagtggctcatgcctgtaatcctggtgctttgggaggcctggagaggggcagatcacttgaggccaggagtttgacaccagcctaggccacatagcaagagcccatctccacaaaaaatttttaaaaagaaaatacacaaaactaggaaaaatagtatagtgagtttccatgtacccaaacccctgcttctacaattatcagtattctgtgttcttttcccatctgtatcccacatttaatgttcccctaccccatgaccttatcccactgaaatattttaaagcaaatcccacttatcatattatctcatccttaaatacacatatacttatatacacatatgtatgtgtacacgtgtgtatgtatatatgtatgtgtgtaatacatgtcatattgcatatatgtgtacatgtgtatatgtgcatgtgtatatgtatacacctatatgtgtacatttgtatgcatatgtgatattacatatattgcatatatacatatgtacgggtatataagtgtgtacatgtgaacatgtatacatatatatgtatatttgagatactctttaaaactatgaccacaatgtcattatcacatctatgtctttcttaaccgttattcctaaatctcacctaatatccagtcagtatttaaatatccctaattatctcaaaaaattactttttataaaaaactatatttggttttcattagaatccagagtttacatatttcatttggttgaagtgtctctgaaatctttctataatctataatcctccctcccatttgttttccatgatatttatttgttaaagaagccagctgatttcttcggcagattttcccacattctagatgtggctgattgctttttcatggtggtaatatattcctctactccccatggatttttcctctactccccatggattttgtcagctggtggttagatctagaggcctgattaaactcaatgcttcatgggtggtgctgagggctttctgttgcatgacatcagaaggcagatcaccatgtctgtctctctttcagcgctgaggaaactgacagtgagttcaggcagtgtcagcctgaacccttcattatccccatcaacccttcacttaatggttttagcagccactgatgacctctgcctagcgctgttatttcatcaaaggttgcagaattatataaccctgtatcataattattaattattatccttcttattaattattatccttcagctttctccacaagactatgcattcctagagggtgggagcctgttttcctcctcttctatatcctcaatattttttaatcttttaaatgaatgaacaaatatcctacaattatgttgctaaaaagtcagcattaatattttgttagtttattgtcactttcacaaactcaaaccctaattaatttgtaacttgggaaagaggaggttatcatattgtaaatagtctcaaactgtgtgtatttgtgtgctctagtaattgtcaaaggattcttgggccatgtatcacctccatacacctgccccaaactcataatgcattttggcaactaggagggactctactgtcaatatcactggctgactttcagagcagaggtaacacaatgttcctcttcctccttctccttagaaataactccatcttttccctgttctgttctccttttcctcctgcctcactgaggacactgtggcatagttcctcagcttgccttcttaatgtttgagttccccaaggttttgtcctcaaggcaccaccctttctctcagtcttcattctttgtgatattctccattcctgtacatgctcatgttacccaaatctaatctcctgcctccgcatacatgtaaatgcctgcctaccagatggatccccccaaaagccttatagccatctaacttcaaaaagatcaaagtcaaactcattctctttctttcaaaacacaaaacaacaacaaaaaccttcctcctgcttttgcaccttccagtttcatttaatagtattgccatccatgtgtttgcccaagccagggagctgacttcttatattttttaagggatgcagtctcattatgttgcccagactggactcaaactctgtgctcaagcaatcttctacagatgtgcaccaccacacctggcatgcttacatgcatggatatgtgcatttatttattatttctattttttgtttgtttatttacgtggggagataagatctcactatgttgaccaggctagactcaaactcctgggctcaatggagtggatttcttttcctccagttcccacatccaagcagtcacgaagtcctttccttcccttggagctagcccctcatcccactgccactgcccttgatcaactctcattagccctgctaatgagtagcctcctaatgggtctcctgcctccagctctgccctaatgatccttcgccaccactgccaccatcaaagttcccttgctgactctgccagctccctgcaaaaaaatcgtgaaaagctcaccactgcttgtaaaatgaagttcaaacctcatcctgggtacaagcttctttataacctggcccctacttactcctccagcttcatgtcatcgtactagccaccaccagtgtttagggtctgccagattaaggaaggtttacccacctgggccagaatccactttcagtctttccatcataatgaaataaacattgcagtaagataaaattttctctctcccttttttctcaaacaaaattccaaatgctatccaggtattaggttggtgcaaaagtagtcacggtttttgccattacttttaatggcattaattgcattttaatggcatttaaatgcattacttttaatggcaaaaaccgtgattacttttgcatcaacctagtatcatctgccttgctttaagcctctgctgaagttgagttgtttctacaggctcagaaaccctggtgctagagctggcatttggtaatgggagtgggtgcagaggggtgtgatctgtggctgagcccctgtgggtgactatttcagcaaaagacagaggacatttggaccccttgtattatttttctgggtccatggtgacagtgaacttcaacttacctctgtctttatttgagatacaaagggatgcaggtcttcacaagtttccaaacagcaagcatttctaaacaaagaggcattggtcaggggatttgtgagtgtcccttcttcttttatgctgctttgagggaaatttgcagcctgaccctgagagacacattaagggagcaataacctgttaaagaacaatagatgatagtcacagtctcaatctcatttgcttctcctgggaaggaaacactgagatgttgtaggactaaggacctcaggttgcatttggggcattgttcgaggggtttcccatgacccatgcaaccagcattttagctgcactagacttctcatggtttccagaatatatgtgaaattgtatgttatgttgccttacttctttgcttgaattcttataaatatcaccttttctctttagcttgatagtttcctcccctcaaagtgagcctaatggctttctctcctgtatgaaaccttatacacaattgtatctgatgtttagcatcttataggtatttgttcactaaatactaagccatgcactcagggatcacaaagagactgtaatactataaataatatctaatactccaaatattgatgaaattgaatggaactgaatgtgtgaacactaagccaagccttcaccagttaacaaaaaattatcttttgtgatctgagattcatatattttgtctacttttcattaagaataaagtgagaagcacattaacaatctcaccgttttagtagtaatcattttcaaagggacgttctattgggaaaggaagaatttgtatttaaggcaaggcaaattaatagatattaacttgtttcaaagcccacggtgaatcattgttaaagaatttattaataggccatagcacagatgcactagagttcattcacagcttacctctaaagtcccaaagtaatgtaatatcccagtagaactgaaaagatgaattatgctttgggtgggaggaaacagggaggtgtcagcctataatttggtggatcctttttaaggtagcaaaaagagactgctttatactaacaaccattctcagattgtacctttctcagattttcaagattgagattgcatgtaacattcataataaatgacaaaggtctgtgagcagaaaagcagagaatagttatcaatattattgcaggcctcacttcttattgatttgtttaaaatgtccttttctaggctgggtacagtggcacacacctgtaatcctagcagtgtgggaggccaaggcaggaggatggcttgaggccaggagtttcagaccagcctgggcaacagagcaagatcctgtcgctaaaaaaatttttttttaatttatccaggcctgatggtccatacctataatcccaactactcaggagactgaggtgtgagaatcacttaagaccaggagttcaaagctgcagtgagctatgattgtgtcactgtactccagcttaggcgacagaacaagaccctgtttcttaaaaaataaataaattaattaaattaaatgttcttatctattgattataccagacctaccttatatagtcccatggatagctggccaagctaggttccaatcagggacagtatctagtgccaacccataaaaataagtacctgtttacttggaaagattgttagtgaggaaagagctaattgttctactttgtatctcaaacctctaaaatacttttaagactgactacactgattgccttaaacacaaggtctggaaatatttttcaatatctatctgtctgacatcaatctatatcctttaatagacaaaggatgttagctataaaagagacctttgcctccttgtttaataagtggggaaactgggatccccagaagcctgatggctcagcctggcctggctggaggctgctgagagcccagtctccttcactgctcacaactccctctgagcagttgctcagcaagggaagttatcagcaagggaaggttccgcagaaatcaatttccttataagagaactcagggagtataaggaagggggcccaatgcacaagcttggctgcctgtggctgagacacagtggcagtggaggtctttatggtcaccaaagcactgactcttctatatctatttatatttcaaaagtagtaaattcttaaatagccaacagatgggtctgtcctcgctatgtaacccttgtagttctctgcagttagccaacatctttgagattcttccacgtggcagacccagatgctgagagaacagaggtggataagacactgaccttgcactcaaagaactaacagtccagcggggcttattgtacacacctcctttttttcactatcttcctagaataaagggaacaaaccagcagagtatgcagtgaaatgattttctcattcagtaatgcaatgaaattgggattcatctaagaaaactggtgtagtgaaaaagacatgaactttgaggtcacatctccaagatcaaaccctagggccccatttcttagctgtgtgaccttggagaagttacttttgagtctcactttgtactgataattgtatttacttcacaaggtttttgaaatcattaaatgaggtaatttacgtaagctacataggagtgtccggcatttgttcatctactcaatttgtaaaggacctactacgtactagacacagttgtaggctctcacagaatattttatatatatatatacacacacacacacacacatatatacacatacatatatacacatatatatacatacatatacacacatatatacatacatatatacacatatatacacatatatacatatatacacacatatatacacacatatacacacatatatacacacatatatgcacacacacatatatatataaaaagaatgaaaaatgccacctctctgcccattaccattgttctcttttcagtggtaataaaagacagtcactcttttatttaccagagaccattagtgaagcgatgttcaagaaatttgctaactatataatcccatcattgtcaacagtttgtgagtttctcatctttcttatgcatgagaacaggccctcctctgacatgtttctgcttttccacagtgtcagtatgtctacctacatcagtgtgtaagagatgtcctcagagcaagaaagctacggagtgaacaagaaaaccccttgtttccaatctatgaaaatgtgaatccagagtatcacagaggtgggcacttacttcacttacttccccaagtttcttcatcaagatatggtcaatctggccaggcatagaggcttacacctgtaatcccagcactttgggaggctgaggcaggaggatcacttgagcctaagagtttgaaaccagcctgggcaacatagggagatcctatctctacaaaaaactaaaaaaaaaaaaaatagccagacatcatggtgcatgcccgtagtcccaattacttgggaggctgagggggaggatcacttgggcttgggaggtcaaggctacagtgagctgagatcgtaccactgcactccagcctgggtgacaaagcaagatcctgcctctaagaaaaaagaaagaaagaaaagattctagctgagtgcagtggctcatgcctgtaataccagcactttgggaggccaaggcgggcagatcacctcgagaccagcctggccaacatgatgaaaccccatctctactaaaagtacaaaagagccaggcatggtggctcacgcctgtaatcccagctactcgggaggctgaggcagaactgcttgaacctgggaggtagaagttgcagtgggccgagatcccaccactgcactccagactgggcaacaagagcgagactctgtctcaaaaaaaagaaaagaaaagaagaggagaggggaggggagaagaaaagagaaaaaagaaaaagattctggaaaccattaataacctaaagctcttccaatgtacaccacccatttcttctcctacccataaagagtggcaacggggaagagagggagggtagggagggggttcctgcagctgagcagcagtttcacaaggtatctcttccagcctagctgaggatgcctgctatgaaggactctgcttaacctttcttttccaagcaataagctttactacttggggaggattctttgaaatcacaactagttcaaattgtaaaatccctttggaaaataatttgtcaatcaaggtatcagggtccttcatatgttcttatcttgtgaccctgtatttctcctaccacactatatacaaaacaaaaaaaaaattatgcatgaagctttttgtagctaaaagtttgacaagcctgggcagcaaagtgagaccccttctctacaataaatttaaaaattaaccaggcatggtgtgcacctgtagtcccagctacttgggaggctgaggcaggagaatcacttgagcccaggagttgaaggctacagtgagctgtaattgtgccactgcactccacctgggtgatagagcaagattgtatctcaaaaaacaaacaggttgggcatagtggctcaagactgtaatcccagcactttgggaggccaaggtgggtgatcagctgaggtcaggagctcaagaccagcctggccaacatgacgaaaccccatctctactaaaaatacaaaaattagccgggcatggtgacgtgtgcctgtagttccagctacttgggaggctgaggcaggagaactgcttgaacccgagaggcgaaggttgcagtgagccaagatcatgccactgcactccagcatgggccacaaagcaagagtccatctcaaaaaaaaaaaaaaaaaaagaaaaaacaaacaaaagaatgctatttttgaggatgttataatagctaaataaagaaaagcaggatgtaaaacaaaaacaacgcataaggaaaaagactggagaaaatataaatttccctgaacattagaaaaattattatttttccttctatttttttgtattttataaatgttctagaataagcacataacacttttcaagtgggaaattcaatagaaaaaaaacacaaaccttacaaggcacagttctggtcaagcaataattaaatgactagaagggtcctcctgcgtcgtcttactctgggccatcgtgaagacctaagttatcacataggcaaactgcaaatgtgaaggaggattgtattagttatctattactgcctaacaaattaccccaacatttagcagtttaaatcagcatttattgtctcactggtggctctggcccagagtctttcaggaggttgcagtcaagacttagactggggctgccattatctgaaggtttgactggggctggaggactcgcttcataatggcttgttcacatggctgtgggcagatgcagccacaattccttgccatgtggactggtatctctctataaatcagataatctttctttgacaaacattatttcataccctcttatctccattctaaatgatcttcaacaggtagtgtctcctaaccttttacttagttctctctaccacccagcctagccagtatgttaatgagttagcatctgtaaagcacaaataaagagctactatttagaggagtcctttgtaaatcagataattattttgtattatgaataattacaaattacaccctaatttatctgtatagtaaattaaggtttttgcatgggagattccttaagaggcttcagtatgagcaagttctgagggatcttggaggttcctttgtcttgttttgacttaagaatctttttttagagtaatcttgagcactcctgaaagaagctaactatggtatagaaaaggataaccaccacgtagctgaaggctaagattcaggtccgaactctcgaactaactagctgtaacaagctgtgtaaccctgagtaagttactctgcctctctgggcctatggcttcatccataaaaacagaggcgatgggctagaatcactagtcccttccaagtctaataatctgtctttctaaatggaattacctggtcccaataggaatggtctcatcttaaactaggttgagctatatgtttctgctggtctttcacattggtaattttcataaacagcgcaaacaattatgacacaccctgcggcagtctctaattacagtgttcttcctttcagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaatctggaaatttttccaaggttatttgaagtttacaaaaatgtgaagcataatcataagcttcaaagattcacagtttcattgtgctcaatgctcttgtgaaatgacagtcttaagctctgattctgtatcaaggaactaagtgaatcttctggaaatgaaaaggaacaacatatgtgtaagtgcagtagatgtaccaccagcgagaaaatagaggtcagagatctacaacgtgtggcatccattagaaatcacctttcctacattgaaaagaaaaaagagaaaaagcagaattttacactaatgttgcttgatgcaaagcacattaatgcttggaaggatacattcattttcgacttttcattcactcagaaaacttctagtaagtatctgcaacctgctaggcactgttccagaatctacacatttctactcacataaagagaatcctcataaagttagga

SEQ ID NO: 12147 - DNA, 767677 bp, Human
  misc_feature (1)...(767677): n = A,T,C or G
ggttgcctgggaaggggatcctcagctgcatgttgcgaagcgttggctactcacagatgtgcttctcttatatttggcaccaaatcaccaagccctgtgtgcagacacccggagtggccgagtggggcccggaccagccaggctctgccatgccctgagctggccacgcacgtccaccccgggggtgcattttccaatgtgcgcaagaggccggggagctgcaggcagccggcaccgtcactgctctggggccggccgagagcgccttccttctgagggtggggagtgcagctcgcgggctccgcggctgagtggagccctgggcttctgagcctccctggcctcagggatcggaagaggccgccggccctggcctaggattaggtggtcactgacttgggccccgcttgggggtccaggaacctggcttttggttcttcctggcccgtggctcactccctcctctggggccccaggccttggtcctgaggcctaggattgttctgcattgtgagcacgggagctgggccgtctcgacgtgctgcccagttcctgcttgttgcctttctattttcaagatattttcattcgaaaagcagagtaggaacactgggtatgtttgaagtcgctccttattttccctctttgcccctttctccctcctcccccctttcccactcctgcttgcactgaatggtgcgtgtctgaggaaggcaaaggagcgggcacatctgcctgtgttcccgcctgtggtgcggcctgtccatcacggacggtggggggcgccgggctctgcagacgcgtccccgagagccctccgcctttgtgtggcctcgcaggcatctcgggccggctctcggacaggaggcagcgcggccgggctgcacggagggaaacggcgcgggcctggcgtctcctccttgccattgtccgcccgcccgcgcagctgccaggctgcctcccggattccctgggctttgcaaagtcccatagaaacccgcaggacgcttgcaatactcgaggttattttctgctaatcacccggccccgtcgtcgtgagcatatatgcaatatcagaccagcaattaccgtcagcctggccctgggcaaatgtgtttctgctaattacacttgttgcatttgaatggctttcttcagccaagctgcacggcgaaacctagtgaacaataagagagaccatttccccttccgccccgcccgaagctgcagatggccgccctgtgtggaagcagtagcgcctgaattaaccttttgtgtgcaccaaagaaggtaatttgaatgtttgaaaccccacaggaagcttgtctcaaagtgaacaattcgccgaataaagactaattggggactaaattaattagaaggtgtggttggaaaggatgttgatgagcagagtctgccatttcagacaaatggaatcgagctaaataaattagtccccattagtcccacaccgttcgccagccccgcgcctctcctgcgccgccggaaaggagcccgggaagccgtgcttgcctcccacgcagcccagggagaggcgtctccgccgatccttgtagctcctgcaaagtaatatttatatttcctgggtgttctgtttttcatctggaaaactggcctggaatgttattgactttgtttttttgttgtcactgagttgtcagaggcaagttttacataaaaaatgtgaaattacataaaaggagggctcggggggtatggaggaaagtggagtgacaacattgcagccacactggactttctctccaccttggcatttgtgttttccgtgatgctcggtttttatctcacaaaccagcatcctccgggtgctcccgggtcctaacagccctctggtgacgccgtgctccaaaacctcacggcggcacatgatcagaacgcattgcaaggacgtgtgtgacaccttcctgctctctgaaaatgaaacgtctcgttctgtcttatctccttcccttctcacagatggagtgtttggaaggtgccagaaggttccggcaatggacttttaccgctacgaggtgtcgcccgtggccctgcagcgcctgcgcgtggcgttgcagaagctttccggcacaggtagggcgggcgtgggccgaggctcggcggctgccgcactgagcgaccgcacgggcttggcttctcctcctgggcggtgaggagctgggacggactgaatccacgagtgtggtggtggaaggggcaggtgggagccgggcgctgggctcatgggtgcttcctactgggatcgtccgttcctgggtttggaggagcccaggcctgctgcctcctgtgtctgagggaggagatgccaggaggctgcagtggcccgcagctgggcctggcacaaagtaggcaggcgtcggctgcttatctgggcctggctgggtccagtgcaggcgtggctcggcctggagagaatcagcctctgcctgtcactgttgtgaaatttttgttgcaggtggtccctgcaggggtgatgagaagataatttttaaaattatgataatttaaaaattatatatggcaacatggtaggaccagggaattcccacagcaccggcccactgctgcccttctttgactgtgaagtgagggctcttggtcagaagcagtgctgtgtggacaccatggtgatggataaggcgttctgactccacggagggtagttctggcaggagcactgtgcgtagggaagggaaatccacatctggagtaagcgtctagtccagcaaggaccattccccaccccttccacaggggaagctgcctgcggaaccacctgccccccggcggctggctgatcacctcggggaatgatgtcatgttggggactcagggatggtctttgtggtggctgactggggactcaagggtggccacagcagggctggccttgttgagtgggagcccaggcatcacctccaactctgccaccgcgaccaccttgttcatgggcccatggggcaacggcagggtggctggggaaagaggctgactggtgtccacagaacaggtcaccctatccacttggttattaaaatcctcctctgctgaggtcactctttggagaacattcacacgggacattcatatcttagtacttcataccacttcatagacgtctatctaatatgtctcttcctcagttgcccttgtcaacaatgtttccaaccatattctctccgagtccctggccctccagccaaaccactggccacagcccattaattcataagtaatcacacatctggccgtttctccttccaggcggaatcaccagccaggtgcactgctggagattctgctcacaggagggtttccaatcacctctgtccttcaggggtcccgggttcacctctgtccttcaggggtcccgggttcacctctgtccttgagggcgtcccgggttcacctctatccttcagggggtcccgggttcacctctgtccttcatggggtcctgggttcacctctgtccttgagggcgtcctgggttcacctctgtccttcaaggggtcccgggttcacctctgtccttgagggcgtcccgggttcacctctgtccttcagggggtcccgggttcacctctgtccttgagggcgtcccgggttcacctctgtccttcagggggtcctgggttcacctctgtccttcagggggtcccgggttcacctctgtcctttagggggtcccgggttcacctctgtccttgagggcgtcccgggttcacctctgtccttcagggggtcccgggttcacctctgtccttcagggggtcccgggttcacctctgtcctttagggggtcccgggttcacctctgtccttgagggcgtcccgggttcacctctgtccttcagggggtcccgggttcacctctgtccttcagggggtcccgggttcacctctgtcctttagggggtcccgggttcacctctgtccttgagggcgtcccgggttcacctctgtccttgagggcgtcccgggttcacctctgtccttcagggggtcccgggttcacctctgtcctttagggggtcctgggttcacctctgtccttgagggcgtcctgggttcacctctgtccttcagggggtcccgggttcacctctgtccttgagggcgtcccgggttcacctctgtccttcagggggtcccgggttcacctctgtccttcagggggtcccgggttcacctctgtcctttagggggtcccgggttcacctctgtccttgagggcgtcccgggttcacctctgtccttcagggggtcccgggttcacctctgtccttcagggggtcccgggttcacctctgtcctttagggggtcccgggttcacctctgtccttgagggcgtcctgggttcacctctgtccttaagggggtcccgggttcacctctgtcctacaggggttccgggttcacctctgtccttcagggggtcccagcatgggtggtgtgtagtgctacacgtgtctgcttttgggtggtgcctgtgcattacacagaaccacccacaaacaaagcccaagtcacctgagcccaaagtccatggggaaccctccacaaagccaaactgcgggttgagagggagaaacgcgtgtggcggtgtgggccagggcgccgggcagctccctgatgcacactccaggccacactggactcctgagccctttccccacgggagcctccagggcggcttgggcccagctcctgctccatatgtgccactgtcgtttggcgatggggtgctgtgcgcaggccagtgccaggcttggcagggcacgtagatatgggtatcaatgtagatgacacagacggaatgctgcccacgcagggacaaacatggagcgagccatattgaaggaaggttgtgtaaatattcaactgtgtcacattttctgagtttgcttgtcttgtgagccttactctgtgtttcacccttcactttattatcttgagaagagggaaaagcctcatttaaggagcaaacagatgagcttttgccactctgatggctggacgtgcgagtggaggccaggggtctttcaatgagaatgggcgtgactctttcagaacttcccctgagcgtaatttcagcccggctctaggtatgtatgtagctatcaccatgtgttggcaactggcactgaacatcatcacgtttctgtgctatcctgtgctgagatgtggcgggggcagcgtgccggagttcacctgagctcccttgtcatgggagctagtgccacaagggctccggggccctgcctgggtgggcgtcctgggatgaaatgaaaccagagaatgcacaagactctcagcctgacaaactagaaaaaaaccaagaaatttaaggtgagtttcaaaaggagggatagaaaaatatctagtggccccgaattccccaacagagatgagttttctcacctatgattttaaagcaatagctttttctagtttgtctcatatatccatgaatttaaattacatgacaataatctaaccaaataatggcaaaaggtaactcctaaggaaaaccatctcagagaaaattaatattgtgccgagtgtcaggctatgtccacattcctggcacctgttcttgaggataagagcatctttatggagatggagtcccaggcagccccacatggggataggggggtcccaggcagccccatgtggagatggggggtcgtaggtatccttgcatagagacagaggtcccaggcagccctgcatctccagtcttgctcaggccctggctgagcgtctgcccaggtgtatcagaactgcccatggcctgggcagctggagccctctgcccagctccatccccagggactgtgtgtcctgggctgttggactctctagacagtgaaaagtcatcttctgcattgtggggacacagaattgctgacaccttcccagctggttctgacacagctgtggggtgtgtcctggggtgggcatttccagcaaaccctggggatgaccccgtggcaggaggacgaccctgtggcaggaggcctctttggttgccagggccattggtgtgtctagtccaggatgcaggcttctggaaggtgggcatgctgcgaaggcacacgtacctgcacatgcattcacatgctcacgtgtagacacagacacatttgcacacacacttgcacactcatacacatgctcacatgtagatacccacacgcagacaaacctgcacacacattcacgtgctcatgtgtatatacccacacacgcacacacctgcacactcacctgcacacacacatgctcacatgtagacatgcacacacgcacacacccctgcacactcattgacatgctgacatgtagacatccccacacatgcatgcacacctgcacacacacatgctcatgtgtagacatccacacacatgcacacacacccatgctcacgtgtaggggatatctacacgtgagcacgtgaatgagtgtgcaggtgtgtgtgcgtgtgtgggtatctacacatgagcacgtgaatgagtgtgcaggtgtgtgtgtgtgggtatctatatgtgagcacgtgaatgagtgtgcaggtgtgcatgcatgtgtgcaggcaggcacacatggtcttatttgaaggaaagaatctcaaatcctggtgtcttcctgagttttgtcagcctcacatggggggagtgtttgagtagggaggttttgcgtgtgggtgtctacactggagcacatgtgtgtgcaggtgtctgtgcgtgtgtgtgggtgtctacacgtgagcacgtgtgtgtacatgtgtgggtatccacgtgagcatgtgaatgagtgcgcaggggtgtgtgcatgtgtgtgtatgtctacatgtgagcatgtgagtgcatgtacaggtatgtgtgcatgtgtgcatgtgtgtgtgtctacacctgagcacgtgagtgcatgtgcagatgtgtgtgggtgtctatgtgtgagcacatgtgtgtgcatgtgtgtgggtgtcctgtgagcacgtgtgtgttggtgtgtgtgcatgtgagtgtctacacatgagcatgtgagtgcatgtgcaggtgtgtgtgcatgtgtggctgtctacacgtgagcacatgtgtgtttgccttgtgtgggcgtctacatgtgagcatgtgaatgagtgcacgtgtgtctacatgtgagcacgtgtgtgcatgtgtgtgtctctacacgtgagcatgtgaatgtgcaggtgtgtgtgcatgtgtgtgggtgtctacatgtgagcacgtgagtgcatgtacaggtatgtgggtgtctacacgtgagcacatgtgtgtgcaggtgtgtgcgtgtgtgggtgtctacacgtgcaggtgtgtgggtgtctacacatgagcatgtgagtgtgtgtgcaggtgtgtgtgcatgtgtgtgggtgtctacacgtgagcatgttcatatgcaggtttttcaggattccagaaatgattctgtcttggtaactgcgcttgaaacagagttgatcctgtgcttctgcctgtcgtcttcatccaggccacttcttgcaggtgcagttgtcagattcattgacagacagctgcttgcgcggccttcagagtcttctgcacgaagaggagggtaaatgggagttaatttcacaaccttcttcctccaggtagatgtgtacatcacagaacaaaatacgttcactgtgtttttaccattcttgtctactacaggcagcattatttcatgggcagacacactgctctctcatgtatgatttttttttaaatacatttcactttttctgacaagccattaaaattcagcatttaaatgtcactcgttggcatgcaatttgctgtcatgaaaacgactgtggattcatttcctggtaagaatcttctgacttattgagctgcatgtcagaagcaaaaagcaaaaaaaccaaatatgtacataaaacagtgttatcattccttaaaagagaaggaaaataaatccctaaataatgtggactggaacacagaaatccaaggctggccgcacgggtcctggctgggatggcatccggggagctgctgctggggacgtgcttgccggcacaggtcaggggagccgggttctgcctcctccttgcccactctctttgcgccctccctgtgctcgcctgtcttgttttacctcccatcctgggcccttggagcttggaggctttccttcttgctgagaggagctgagatccaccccctacccgacctccaggcagatgtgtggtgtggggttggggagggagaacgtctggctcacgtctggtgagcacaggtgggtgtgttggagtcacgcgtggtgctcaccctccgtgtgactcgcgctctgtccggctcagggctcgccctccgtgggacttgcgctctgtccggctcagggctcgccctccgtgggacttgcgctctgtccggctcagggctcgccctccgtgggacttgcgctctgtccggctcagggctcgccctccgtgggacttgcgctctgtccggctcagggctcgccctccgtgggacttgcgctctgtccggctcagggctcgccctccgtgggatttgcgctctgtctggctcaggctgcgcagggcaatggaggaacctcccgagcaggcccagcggctccttccacccagcccccatctccggccggccatttgtgaggccctctgccactgaggtgcactgtttccaattcctcattcacaagctctaccttccacaggagcccagagcatgaacgcattcggccatggtcctcaccactctgcgaggagcacagcctcttctccaccgtccgatagcgtgttcctcctttcccaggcctcacagaatgctctgtctgcatcctcccagcattccattcatgatggccgagctgttctctaagagatactgctttgtcttccttttgatctctcaacacaagcacttttaaaaattcatccatggcgaaggaggcttgttccagcacacacctcaagactcagcctcaacaagtttcccagacccaaagttgcttctgcatttttaggaatttgtcacagccgtgccgctacttcccggtgccaatttttctcttgtttgagttgctgtcacaaaaatcacatggcgtgggtggctgaaacagcaaacattgatttctcagagctctggaggctcccccatatttggtgtctggtggtgggtggcttcctggttcatgggtggcatcttccccccgtgtcctcatgtggcagacggggcaagggagcgctctgggatctctttcgtatggacactaatcccacctgcatgggcgccgtcttcatgacctaattacccccaaagccttcacctcctaatgctgtcacactggggatcagaattccagcacgtacgtttggggaggatgtcaacattcagtctgtatcatagcatgtgtattctatgaccatagtgtatctcattggttagtttttatatttgaactaatcttatattcctgggataagtcttacttgaccatgctgtataattctttttatatgtttctggatttagtatcttagtgtttcgttgagaatttttatgtccgtatttataaaggatatctcttaatcttttgatatctttggttttggtattatagtaatacataacttgtcaaatgcattagtcagggttctctagaaggacagaactaataggatagatgtgtatataaaggggagtattttaaggagtattgactcacaatcacagggtgaggtcccataataggccctgaggagcaaggaagccagtctgagtcctaaagctgaataacttgaggtccgaggttcgaaggcaggaagcatcccgcaggggagtagcgtgtaggctggaagactaaactacttttgtgttcttctgcctgcttttattctggccatgctggaagctgattagatggtgcccacccacatgctggaagctgattagatggtgcccacccagactgagggtgggtctgcctctcccagtccactgactcaaatgtgaatctcctttggaaatgccctcacagacacacccaggatcaatactttgcatccttcaatccaatcaggttgacactcaatattaaccatcacatcaagttaattgaagagtattctttctttattttttttggaagactgtgaaagaatgatgttaattcttccttaaacatttgaagtgaagctattgcaaatggaagccatctgaccatgggcttttctttatgaggttttaaattactcattgaatttccttaattattataggcatattcaaattttctatttcttcttgagtcagtttcagtagttcatgtcttcataggaatttgtcaatttcacctaggttatctagtttgttggcatatgattacttatagtatttctgtatagtccttgtaatttttatgtctgtaagatcagtaataatgtcttttcattcctgattattttttgagttgctttcttagtgtttgctagaagattaatattatttaattttattaacaccaagttaatattaatttattaattcaaattaacattaagatctttataataatctagttgaattaataccaacttaattttcaaacactctctgtcattttttctctttccctcctttgtgctgttattgtcatgaaaattatatctttatagattgtatgtttatcaacatggatttataattattgctttatgtaggttttttaaagaaaattaggagaaaataaatgttacatactcaaatatttgttctgtctttcatatttactaaataatgacctttactggtgctgtttatttcttcatctggatacaactcactgtctaatgtcctttcatttttgcctaaagtactccatttagaacttgctagggaagggttgttggaaaaaattctctttgttttttgtttgggaatgtattgatttctcctttagttttgaaggatcgattttctgaatatagaattcttggttgatagacttttttcttttaggactttgaatatatcattccactgcctcttggccttcatagtctcagatgagaaattagttgttaatattattgaggatcattgcctattttctgttgcttatcacagaatatctgaaactgggtaatttataaagaaaaggaatttatttattacaggtatctgggctgagaagttcaaggttgaggggcagaatcaggtaagggtcttcttgctgttggggactctctgcagagtcctgaggtggcacagggtatcacatgatgaggaggctgagcatgctagtgtgctagctcaggtctcccttcctcttcttagaaagtcaccaggtcccctcttgtgataacccacatgaattaattcattaattcatgagtggattaatccattcatgagggcagagccctcatgacccagtttcctcctccctcctgatactcccaaattagggattaaacttcaacatgagttttggaggggacaaatatctagtccataacatgtgtgacaagttgcttctctcttactgctttcattagatttactttgtctttgggttttgaaggtctgattttgatgtatctaggtgtggctgtcttagagtttattctacttggagttcattgagtgtcttagatatgtagattcatgttttccatctagttttgggaattttgggtcattatttcttcaaatattctttctacctcattcttcctctcctacatctgggacttcctttacgtgtatctcagtacattggatggtctctcacaggtttctaattttttattattctttttttttctgttcctcagactggataatttcagttgacctatcctgaagtttgctgattctttcttctgctgctaagatctgctgttgagctgctgtactgaatttttcaattatttttgaaatataatttctatctttttattcatattctctatttgatgagacactattttcctacttttatttagctctttagacattgttcttacagtttttggagcacattaaaaatagctcatttagtctgggcacagtggctcatgcctataatcccagcactttgggaggccgaggcgggtggatcacttgaggtcaggagttcaagactagtctgcccaacatggtgaaaccccgtctctactaaaaatacaaaaattagctgggcatggtggtgcatgcctgtaatcccagttacttgggaggctgaggcaggggaatcaattgaacttgggaggcagaagttgcagtaggctgggatcacaccactgcactccagcctggatgacagagcaagactctgtctaaaaaaaaaaaaacaaaaaaaaaaaaaacaaaaaacagctcatttaaagtctttgtcttgtaagccatttggcttccccaagaacagcttctattgttttcctgtggaagaggcacatttgcatgtttctttgaatgcctcaaaaatttttagtaaaactcaatattttaaataacatagtgtggcaactttgaaaaccagaatttccctctccttaggtgttgttgttgttgttgttgctgtttattgttggttgcttgcttagtgactattctgaactaattctgtaaagtttgtgttttttcatcatgtgtggccaccaagtctctgctcagtttggttagtggtcagatgatgaccagacagattgccttaaatgcctagaaacaagcctcagtctctgctgagggttctgtgtgagtgtggggcataccttcagccatcagacaggcagttcacagctctgttgtagccttcacttcatgctggcccagagcctctacatcagccagtggtgagagcttagagcctcatgtcttccctgagtgtgcacagcctgggcaggcacacagccctccatgtgttgtggccatccatattccaaggatcgtgtcagagctttgcaaagcacctgtgcacatctcattttccagcttttccttcaagctttctggttagcctattgtttgtcccaaccattatcctctacctcaggtggctggtaagtaaaacattgtctctaaatgttttcaacaaatgcccccagggaaagacttttcacatatgtgagctttgagttggatgaaataaagacagcctttccagtgggtcctccagggaacaaccagacaggtcaagtagtgacaattctctgggaatggggctttgaaggcactctaaccccaccctgtgctttctggtggcttccaggctgttggtttttactgccattgtgggctgctcattttcaagcctgtggcagagctgaggagagggagctggaaatagggtgagttaagatgccaggaagttcgctgttcttgctgagattcagccatttctttctttttctttctttctttttttttttttttgagtaaattgctctgatttctgctagcctttagttaatttccagagttctgtaaaagttgattctgatatttttgggtggttttctcattgcttttatgaaggagggaatgtttaaggttctttgccattttcactgatgtctacagctacttcctaaggctgcttttctctggtcctctcctcaacgttcatctggacattgccttggggatcactagctggggacagcttcacttcagtttgatttaagtgtgatcttggtttgttgatttccttgtctagttgctccgtctgttttatgtgggaattggggaatacccaaaaacaatgctgccatggccacatccatctttttttctctttctctctccacctccctccaccactgtctccctccctccctctctccctctatctttagctctatgttttgtctaatataaaaatgaatccctattttttctgttgtcctttccttgttaaaaatatccgttggattcctctgcactgaaggaaagaagccactcttggctttagagtataaaccaaaaataaaattctaagtcccccagccagctgaatggacccttcctcttggccaagggcactctaaagtaaacctgaaacactagttcaggccatgatgggaaggggtgtttggacacaccttatcctaccctcctcccttggtgtccaggcacagctgaccagcgttaacattggaacagaggcgtgaagacagacaaagcagaccttttgcagctataaggtaccaacatggcagattgcaggccctgaaagaaatggaagtattttaccccaaaatatatttctgcgatatatttaaatggcttgcaaagctgtctctcctgggaaatgtctacattctgtagagaatcccttttcctttccaggtcttttccctgatccaagagggaattaattaagagtctggcaccttttcaagtctgataaacattgaccatctattctctctgaagcctgcaacctggaggcttcatctgcataataaaaaccttggtctccacagtcccttatcttaacccagacactctttctaccgattcccagtccttggataaactcaaccaattgccattcagaaatctttgaattcacctatgccctggaagaccctgcttagtgttttcccatctttctggaccaagcctgtgtacatcttagggtattgatgggtgtcttatgcctctctagcatgtagaaatccaagcctgtgtacgtcttagcctattgacgggtgtcttatgcctccctagaatgtagaaatccaagcctgtgtacatcttagtgtattgacgggtgtcttatgcctccctagcatgtagaaatccaagcctgtgtacgtcttagcatattgacggatgtcttatgcctccctagaatgtagaaatccaagcctgtgtacatcttagcatattgacgggtgtctgatgcctccctagcatgtagaaatccaagcctgtgtacatcttagtgtattgacgggtgttttatgcctccctagcatgtagaaatccaagcctgtgtacgtcttatgtgtattgatggatgtcttatgcctccctagcatgtagaaatccaagcctgtgtacatcttatgtgtattgatggatgtcttatgcctccctagcatgtagaaatccaagcctgtgtacatcttatgtgtattgatgggtgtcttatgcctccctagcatgtagaaatccaagcctgtgcacatcttagtgtattgttggatgtcttatgcctccctagtgtgtagaaatccaagctgaagcccatccaccttgggcacatgatcttaggctctcctggggctgtggcctgggccattggtcacccacatgtggctcagaatacatttcttcaaatagttttcagagtttgaccctcttcatcaacaggagcagtagttgtcagccctgacgttatattaaaataacttgggagcctcggaaaccatggtgtctggggcttacccttcaaagattctgaattgatttgtctcatatgaggcctgccatcagcatctcctaaaaattctccaggtgatttcagtgtcttcatatttattttcttccatgaataaaatgggactaacactctctgaagcttgttttatataccaacaatatgaatggctttcttcttattcctgtcttaaatttttatccagctgttttaaggtttacacattgcaagcttaatgacattttaatcctgtatggtaaattagtataatgcattttgttaaaattttcatagaataatggagaagggaatactggatatagtatagagcagtaaaattttaaaagtagttttaacttacagaattctactggtgctttccttttgctgtagggaagttacatctctttatttagcagattaaagagacggaatcacagagggattacagggtgttcctggggtccttcggctggtgtggaatggagagcggaattccaaactcccagcagcagagtgcagagccgtgatttttaaaatgttgttctcaggatcacatcctattattgaaaattactgaagattccaaagaatttttttttttttttttggtgggttagtgctatccacatttgttaccttagaaattaaaattgccaacactttagaaaagctgtttattaattcactttaaaataaatcataaaattatttcattataaacacagtagctatattttccaaaacataaaaaagtgctaagtgtgacatttttgttttacatttttacattcttgtttcacgcttttgcatatctcattgtttcatttaacagaaaacacttggattctcatctctgcctcccactcattctgtgtcatttcctgccacatagcctctggactgttccaagttctctcataaaagagtacacgtgagaaaggcaaagtatgtcttagtattttatgaaaatagttttggcctcatggaccacttgaaagagcttaggggcctcttacagttgcaggctgtgctctgagcattgattgtggagagacaacagggtggccttggagtccggatggagtttaagttccagctgcggcacgtgtgagtcgtgtcatcttgcgcacatcacgtaactgccctgttttggttgtttatcgtgaaacgagggtggtcctacatgccctaggttgaatgtgctgggaccaaactctgagacagagatttgcatgcagtcggtgactgggggtgatctggggtaacccccgtacaggtgagggaagctgaattgggcagagggagaaggtgagctggaatgcagtttaagaggaccgagctgatcctgtgaggtgctctgcagccggagctggggttccccttcagggttgacccaaccaaggctgggggctaggcctttgtgtcccacatgagggatcactgatggtggttcacctccagggagcaagagactgtaacttagggagtggctgttcccttgggctcaggtggtgatggggagggattcagcggctaacccctagccctcaacagctggtgtctggggagaggatgcagagtccccaggaagcagcagtgtggctgtcacagtacccaccaccctgaatgtcatcatttctcaggtgtgtattgttttcccatcactgaaattaggaggcatcttttataaatagcacatcatagtttaactgccagcgggtttgtttttccttagcagtactagagtaatggtctgtcttgcaatcaatagcttcctagattggaggaggtcataccatctcatgggacaggggattgctttttttgagacaggctcttactctattgcccaggctggaatacagcggcacaatctcggcttactgcaacctctgcctcctggactcaagtgatcctcccacctcagcctcccaagtagttgaaactacaggtgcaaaccaccatgcccagctaattttcgtattttttggcagagatggggttttgccatgttgcccaggctggtctcaaactcctgggctcaagcaatgcacctgccttggcctcccaaagttctgggattataggaatgggccaccacgcccagcaaatgggattgttcttaagattaatttagatggtgccactcattaaatcctcaggaagtgtgaatgcactttgcttatcagtactaagtgtggtagaagcttccctaatgatgttgaaggttcacataactcaaaccagcaagagctggggagtggtgtgtaggttaaccgggaagctgataaatacagagcattctgctaagcacctcgggagctaagacgatgactcagaattgggagttctagttagctgcttgggaattctgaataaatacatctgttcagcttcttacaattgagcgcatattaatgcaaacagatcagaacagggaggaggggagtgtgtcaggagccgttaacacagagcctcgggacagctgagttggtcgtggttcgtctgtgttcatgccctgcaatgctgtctgtttaatttgcacggcccgtgcaaagtgcaaatacaggtccttagttcagaaatcaaggaaaagtgcccctaaaggaactagttatagtataagatgtttcctttcacaatctccgtcttgacttgtcatgggatttttatttgctattcagcatcattctaaaaacattaagatttttgaattattaacatgaaggttaccattcatctgtatatcgtgcgttgctggtttcaaatgcaaatgaaagaacatttaattcacatgcagaatctgaacaactacatagttcatctgtcacagctcaaacatgcatatgtatttcattctcattacagcggtggaaatgctgtgtgaaactcactcggctgtgtttatttcccttcatgaaacagcccctgtccaccgagattctccacctttgctcacacatgagaaggactgtgggctgcccacctcccctccctccacacggccacgttcagcataaatggtggcttatgtgggaaagcaatgtgagtgggagagagggtgggacccttggtcgtttgtgtttcttagaacactgttgcactttgtggtttgcagcaagctctgggtaagcagaggagtggcctcttagggccacatgagcacagacagacacgtggggggcgaggcgctgcgggactgggtggcgggcgaggcgctgcgggactgggtggcgggcgaggcgctgtgggcgtgcagattggggtgtcttctctgcaggtgcgcgcaccacgtcgcctcatgggatgtctcacacaaaatataggttgggagataaaatctttgagaatttcaagacagcaacagcagcgtgtcaaagcaaatgagaaatttttctgcacacaggcccctggcgactacctaggtccatgctcccgtgaggctgcccaccttccaaccctagccgtcggatcagacgatacgaggggacctttggccgtttgctttatggccttgactccaagggctaggggtagagcctgactgtcaccattgggaaatgccacagtgggcccatccctcataattacaatcatttccgcatttgtttctatgaaatggacttcagttaagaaactttgcttcttcattgacccatattatcatttcagaggcattctctgtggttcaaagtgacataaattgcttgctgccaaaacatcctaggtttctacaaagtaaacaaatattttcaactgtcagacagtgggaaaaatgtgtttcttgggaggaaatggtgctcgttttgcctgctctgaccccatgaaccattcagtggtgttaaccggaaaaggcctttccagaacctgcccctgagctgctaatactgtccaagggcctttcagggacgttctcctcccagaccaaggtgctcattttgctgggttctggggtaaagacccaaccccagcaagcacctgccagggcttccctggggggcctgggaaccgccaactgctctgccacttcctgagggaggtgagggagctctgtggcagtgaaggatgaatgcagccagcagctctaggactgaggaatccatgtctgctgaaaactgtcagagaggtgagaagctcatttacagctctcagaaggccctggctatctgtctttgccatgttaatgagctaaaaaaaattgcttcctggtcaggcgtggtggctcacacatgtaatcccagcactctgggaggctgaggccagcggatcaagaggtcaggagtttacgaccagcctggccaacatggtgaaaccccatctctactaaaaatacaaaaattagccgggtgtggtggcatgcacctgtagtcccagctactcctgaggctgaggcaggagaattgcttgaacctgggaggcagaggttgcagtgagccaagaccatgccattgcactccagcctgggcaacagagtgagactccatctcaaaaaaaaaaaaaaaattgcttcctgagagccctgcgtgcatctgcagaaaggtgggaaggacagacttgcatggcagtttccccagggcagcccaggtctgcaagctattcagtaaccactgagatttgtctcgggaatatgccagtcttgggtgggataaaaagcattgattagtgtcaaaacttcccctccagtttgaatttaataatgcactgacatcatcgctcaccagactgctgtgacgttctgtccattagtgtctgcagggaggtcatgaacatcctgctggatttgaaaacgggctgagctgcaccctccttcctgtgcggttccctgaaggcccctcccaggacaatcggcagtggctgtcagggccacagaggcatcgtgttcctgtggctcaggaggtatttgggtgctggcccaggaagaagtgatgacatgaattttacccctgggtctgggctgtgctgtttttacttttttgaaggtgggaggtccttggacccaggggctcagcaggaagaggagagaggacaggcaaccccaggaggtgcttggaggtgacattgtggggcctgatttcctcctgatgtgcccgagcacaactttggcacatcctgctgggcccttgcgccctcctccaatctgaagcctcacagctttttcacttgggaagtttctcggccattccttcagaggtggcctcccccgcaagctcttcattcttttcttccagattcacggcacataaactttgttatgtgcacaaaattattaaaaattacataacattaccttcaggccttctatataaggtataaggaaacacaagtaatttcatgtttcgacttgggtcctgtccccaagatatttcattatgtacatgcaaatattccagaataaatccaaacatatctgaaatccaaagcacttctagtcccaaacatttcagatgagggatattcaacctgtgtcatattattttattcctttttgtgtgcctgaaacgtttcataataagaataaaaggacgaacaaagcaagcaaaagacattaaaaagaagaaaataatgaagacaagagcagaaaatactgaaataggtacgaagaaatgagggcaagcatcaagaacacaaacagcagaaatatctctgggtctttgaaaagacttacagagctctttttaccgacaatgacaaaaaagggcataagtacacaattaatgagaggaaaaagggaattccaccataggtaaattgaattcaagaatcgtaagaaaacactactaatgactttgttctaagaaatttgaaaaggcaattagaaaaaaaacctgtaagttgataaaagtgactcaaaaagtaaagaaaacttgagttagtctatattcattaaaacatgcattccttaaattttcagtcaacttgttttgtaacttcagtaagagtagtccacattcacaataggaaattcattctgtccacaaaccatcctattgtgatattctccaaaatatatgtggagaggtgagggaacagcataactggggtgtgtggttaggtaggatgggggttagttattttaaacataggcacgtgtggtgtgcacctgtagcactcttaacctctaaacattggccattctctgttttacaagaaacctgattatattttttactaagtccatatttctttgggacctgtccttaatgactctgaaagacccctccttactgctgggttttgtagtcaaaggagaaatgagggctgtacgtgaagacccttcccaagacaagatgcttctgtgtctgatgaagaatgaagcctcaagtcaagctcaccaggtcatgggctgagggttgctgaaccacaaggagataccgtatcacaaatgaacggactttgcagtgtcatcactgtggctccaggggcgtcttcccttcccaaagggtttctggcagatccctttgaacagagagtttctctggtacatttcagaataggttcccagattgttaacaccaggacagaacggctgaaagccagagagttagcagctctctctgaatgatgatcaatctgaaatgaagagaaagtcattctgtagctaggaaacatgatcagtttttaaaagcttatgcccagccattggcagaagctgtatatgtgctgtgctggtccctccgggactggatcctgagagctcccaggattttcaccgttaccgcttcagaagcagaggaactagtaaggcgcacgtttgtgtttggatggaatgctatccatggacattccaaatgttgcccccggccacatctgctggtctctcctgccccaccaccccaactgctccaccacccaagctccacctcccttagagttccctgagtgccgggcgtgtccacctgtggtcttcccatggtcttcctgtgggccaggtggccatgtgcctctgtgaccacagcctacatgcttggctccatctgctgcctcagaaaggccaactgccgcccagaagagagtgggtcaggagggttgagatgaagtgaaacaggaaaagttcccttattcccctcacagggcgtgcgatggaggagtgggttgcttcttcagtgccccactgctcccacctgcaggggagcatacagacgggcaggctgtgggctcagaccccacggccgtgtctaggggtgaatgcttacagctcctaaagccccagtgggcgtgtgttacagggtgcttttttagtttcgccgtctgtgggcggcttgtgttaaccagctcaattagaccctctgccttattgcaaggacagggggctttctgtgtcctggagtttcttgccttggtgtactggaagaatcagatcgcacatgggcttggagaatgagcgcaaggttttatagagtggaagtaactctcagcaggagccagagggagatggactgggaaggcagttttcccctggagtcgggccgctcagcagccaggctctcctccaactacctcgtctgctggtgcctgtcagtgagttcttctgccggtgtgctcctcttgacatccagcccttgtgtctttgcccgctagggtcttggggagctgcttgtgtctctgcctgctagggtctcagggtttttataggcacaggatagaggcgtggtggaccagggtggtcttgggaaatgcaacatttgggcacaaaaacaaaaatgcctgtcctcgcctaggcccatgggaaaggtccaggggtagagcccttgccagagacccgcccttctccacccagcacttccctgcccatctcccgtatcagaagcaatccaaactcatctttctgtttatttaactaagcaaccatctcagacaaggtgcctgatgatgtgaaaatgaaaagtgagaaaatgaggattcgacagctcacctcagctgctagtgcacaactgggtgctatggagatgtggggcagcatctgggcagacaggcagggtcagcgggcgccgtgggcttggaccctcagaaaggcgggtgaaccgcgcgcatggagagtggtgcagtgtttgggcagacaggcagggtcagcaggcaccgtgggcttagaccctcagaaaggcaggtgaaccacgatgtggtgcagtgtctgggcagacaggcagggtcagcgggccccatgggcttagaccctcataaagatgggtgaaccacgcacatggagagtggtgcagtgtctgggcagacaggcagggtcagcgggctccatgggcttagaccctcggaaaggtgggtgaaccacgcgcatggagagtggtgcagtgtctgggcagacaggcagggtcagcgggccccatgggcttagaccctcagaaaggcaggtgaaccacgatgtggtgcagtgtctgggcagacaggcagggtcagcgggtgccatgggctctgaccctcggaaaggcgggtgaaccacgatgtggtgcaatgtctgggcagacaggcagggtcagcgggcgccatgggcttggaccctcagaaaggtgggtgaaccatgcgcgtggaaggtggtgcggtgtctgggcagacaggcagggtcagcgggcgccgtgggcttggaccctcagaaaggtgggtgaaccacgcgcgtggaaagtggcgcagtgtctgggcagacaggcagggtcagcgggccccatgggcttagaccctcagaaaggcaggtgaaccacgatgtggtgcagtgtctgggcagacaggcagggtcagcgggtgccgtgggcttggaccctcagaaaggtgggtgaaccatgagcgtggaaatagaagcacactgaattctgggcgacccgtgctcccaggtctccttgtggctggatgtctttcctgcctctcactctcccccgggaacactcctccctccccgcttgctcctgcctggcctggctcagccctgcctctcgcatcctcctgtgtcagaggcacacgcatgtctgatgctgttgctcagggatatcagttgaggagctgagggccgggaattacgtgacttattcccaaatgagtagatggaagaaatggaacgtctgtgattccaggccaggagggaatagttgacgccagagtaaacctttaatttacatgaaaaacttacaaaaaatatgggagccagacatgaaaacaacaaactctcatgtaatttcatcactttgggggaaaacaaaaatccttcttatttttatgtatttgagaatcaagcttttgtgtctcagaaggtccttagatattcttgtaggttcaagtgatgttgagaaactgtaaacagcaagcacaacataacaatgtttccaccagcagcagatcgcgtacatgatggtggtcccatatggttgtagtggagctgaaaacccctgtcaccgactgaccttgtggccctcatgatgtcacagtgcagtgaattacatgtttgtggtgatgctggtgtagacgagccaactgcactcccacttgtatgaaagtctagtctagctgtgcacggtacatgtgtatttgctgtacttttatcattattttagaatgcactctttttacttattaaaaagcaaaactaacactcacacagactcaggcaggtccttcaggagatatgccggcagaaggcattcttctcataggagatgatggccccacatgtgctattgcccctgaagaccttcctgtgggacaagatgtggaggtggaagacagtgatattgatgagcctgccctgtgtaggcctaggctagggtgtgtgtttgtgtcttagttttttttttttttaacaaaaaagttttaaaagtggaagaaaagtgtaaataggaaaaagcttatagaataaggatataaagagactatttttatactgctgtactatgtgtttgttttaagctaagtgttataagaaaaagttaaaagtagttaaaacatttataaagtacacaagttactatttttttttttcgagacagagtcttgctctgtcacctaggctggagaacagtggtgcgatctcagctcactgcaacctctgcctcctaggtttgaacgattctcctgcctcagcctcccgagtacctgggattacatgtgcacactaccacacctggctaatttttgtatttttagtagagacggggtttaaccatgttggccaggctggtcttgaattcctgacttcaggtgatcacctgtctcagcttcccaaactgctgggattataggcgtgagtcaccgtgcccagcccaaagttactatttaaaggtaatttattattgaagaaaaaacatttttataaatttagtgtagcctaagtatacagtgttgatagtctagagtggtgtacagtaatgtcctcggccttcacactcacccaccccaccctcactgatgcactcagagcaaatttcagtcctgcaggctccattcatggtcagtgctctatatagctgcaccattttaatcttcttttttagactgaatgtcactctgttgcccaggctggagtgcagtgacgtgatcttgactcactgcaacctctgcctccgtggttcaagtgattctcctgactcagcctccctagtagctgggattacaggtgcctgctgcctcgccaggctaatttttgtatttttagtagagacagggtttcaccatgttggccaggctgaactcaaactcctgacctcaactgatccacccaccttgacctcccaaagtgctgggattacaggcgtgagccaccatgcccggcccatttttatcttttataccatatttttactgcaccttttaatgtatagatgatacacagatacttaaccttgtgttacaattgcctgtagcattcagcacagtaacttgtaggacagatttgtagcctaggcacaatgggctttaccatccagcccaggtgtgtggcgggctgtcccatctgggggtgcgtaagtgcacccgtgatgtttgcacagtgacaggatcacctaatgaggaattactcagaatgtacccctaccattaagcaatgcaactgtactactcttaggattaaaactacatggcttacctgtgaatgctttaaaagcttgcattttcttttctgatgcaacccacagtttttaccttttaattttaaagtatgaggtcagttagacttcatccctatttaaaactgaaaagcttgatttagggcattctttagtgttaatggaaaagcctcaccaggaggcgggctccatctgcttttgaacatcctggaataggggcagtctttgtttaatagaagcttcatttcagacaaggaagaaccgtcaccctcaggagaattagatgtctcaacagaggaggaaattgagacctatcggaactggaagcttaccagatggcagcacagaaaaccctggcatttctgaaagaagcaggaaggtggggagaggagggatccatttgcgggctgtatggaatgtaatcttgtcttaagcctcactaaaagctagacaggtcatggagacaatcaggcttttattctttgaaataattcacattacaggcttgtgtattactggccttatcaaataaaagcctttagactcatgtgggcagataattacaaattgatgtctgggcctcttgttttggaaatggcttttacactcccctcttctttctctccctctttcatctctctcttcttgagttaaactttcttgtgattttgttagggttctggtagtgttagctggctctaagagtaaatggcaaagctatatgaagaagtcacttttatttgaagtcaagaatcgagttacaaagtgcaggaacattggtgcagacagggaatttcatttaacactgtattcagcctcagaaattattacaaatcagaagtaataagtcagacaaccaaagacagcagcactgtccagggtcagtttcatctgtcagggttgtttcttgccacagaactctattttactttacccagtgaatcttaactttaaagacaaaaaccaatgaataaacactttttggaaaacattagaaatcaaccaaaatctagttaatttataacaattgggggaggggaagctcctagagcttagactaaaaaaacccaaacaaaatataaattccaataaatgatatcctcatatccctattgtttctccagatcaacaaatatgtgtgattctgtatcatatgactttgtatatcaagggaagagtggatagtatcagaaaaatccctagaaccctcaagtgtgaaaatgattagacatcttgaataatacaaagcaacacagctagatccacatcaaaagagtcatgaagaccaagtgggttgatcctggtgagtacattttgaaaactgtgaaacacaaatggaagctgttacatcatcaccaagtggggtggaatgaaggcaagccttggaaactcctcctgccatgaggttctcaactccccaccccagagcagaaatgccccatctctgcatcctgctcttggctcagcagacctcctcctcctctgtcaaagagcatccacattttatctgctgacttcttaaagaatcagatgctcctttccctgaatattttaaagagagtcacatagtcaacattcgtcagagatggacatcagcaaggcagcaggagaggactctccattgctcatccatcacagaaacaacaatttgaacatctatctgtgtgcaaaaataccttcacaagtgctaaggaaaccaggtgagaggtgatagcacctgggcatggcacagaaataagatgcactgaaaaggcagaaaaaacagttttgcatgactgggtcccctctcacccaggcctagcagcatgttgtggtgagagatgccctctatgtgggggaaggaaagagaagtgagtaccagactttgcttctaactctaaaactgcctcctgatcccccaccaaccaagttaaacccagcaccagacatgcccccatagcttcctactccaggctggtacccaaggacggaggcttcaggcctgccccaataccaggtaggatcatgcaggcccaggccccacacctgcccagtggacttagtctctgggcccactccgcatacaggttgaccccattggcctcaggctccacatcatctctggcaccaggctggccctgcagctccatggttagcagacaggacccaggcctatcctggtaggccccagcactgaaccagccctcactgacctgggctccaggagtgtccctgtggactcaggatccaggctggtccccagtgctccaggctccagaactcagagtccaggcccactccaatagacccctggtgccaggccagcccctttggacagaggctccaagaccacttctgcagacttaggctccaggccaacccttgtggatccaggacccaggctcacccccacaaattcaagctctgggcccaccttagccccaggacagccccttcagactcaggtatatggcctaccctagcaccagtcctgccttaacggatgccaggctctaagttcacccttgcagactcaatcaacaggtccactccagtggatccaggccaaggctcactcacctgctaacccaggcattggaccagcctgcgtgaggaccccaatagcaagcctacctatggagcatgccagatgacgcccagaatctgcatgggcttattgatgaagggcttacccaggcgaagccattctacaaagaatagaataagtccctacttcccaaaatgtgcagacatcaacgtaaggcaacaacaacaacaacaacaacaaacatgaaaaaccaaggagacacaacaccaccaaaaacacaataatctcccagcagcagactccaaagaaatggagataaacaaatggcccgataattcaaagtaagtgtttgaaggaagttcatgaacttcaagaaaatatagaaaaacaattcaataaaatcaggaaaacagtaaatgactgcaattagaaattccacagagaggtataaattattttttaaaaattctagaaattctggatgtggaaaacacaataaatgaaatgaaaaatgcagtagagagtgtcaactgcagaattgatgaaacagaatccgtgaacttaaagacaggttatttgaaaacatacagtcagaggagaaaaagagtaaacgggaatgaagaaagcttatgggatttgtgagataacaccaaaagatcaaatatttgagttacaggtattcaagaaggagaagagagaccaagggactgaaagcatatttaaataatatgagaaaacattccaattctggggaaatatataaatatctaggtacaggaagatcaaaagtctccgattagattgaatccaaataagactatactgagatatattataatcaaactgtcaaaaatcaaagacaaagaggatcttaaaagcagtgagagaaaagaagcaaatcacatataaaggagttacaggaaggtttatagcagacttctcagcagaaaccctataggcaagagagagtagaatgatatattcaaggtgctgaaggaaaaaaatggccaaccaagaatactgtacttggcaaagctgttcttcagaaatgaaggagaggaaaagaccttcctagccaaccaaaagctgagggattaatcaccaccagagctgtcctacaagaaattctaaagagagttcttcaagctgaaagaaaagaatgctaactagcaacatgaaaacatacaaaagtatagaactcactgataaaaataagtatacagtcaaattcagaataatactgtaatggtggtgtacaaatcacttaagtctttagcatgaaggtaaaaagagaaaactatcacagtgatagctatgaaatttcttaaataatagctacaacaaaaagatatgaattgtgacattaaagtttatgcgtggggtgggtggagtaaatgtgtagagattttaaaaatgtgatcaaagttaagctgttaccaacttagaaaagcttgctataactgtaagatatttttatgtaagcctcatggtaactacaaagcaaaaaccttagtagatatgccaaagatagaaagtaaggaatcaaagcatatcactagagaaaatcacccaatcataagggaagacagacacagaggatgaaaggaaaaaggatttagaaaataccagaaaacaatgaacaaaatggcattagtaagaccctgcctgtcaataattactgtgaatgtaaatggattacattttctaatcaaaagacagagtggctgaatggctgaaaaataggacccaactatatgctacctacaagagattcccttcacttttaaggacatagactgaaagcgaagggatgaaaaagatatttcatgcaaatgaagaccaaaagagagtagaagtgctatacttaaataaaatagacttcatgtcataaactgtaaaataaagtcattatacagtgataaaggggtcaattcatcaagaagatataataattataaatatgggctaaaaactggagaacctaagtatgtaaagcaaatattaatatgtctgaagaaagagagatggactgtaatgtagcagtaggggacttcaatacccactttcggcaatggacagatcattcagacagaaaatcaataaggaaacatcagtcttaaactatacttttagaccaaatggacataacagatatatacagaatataccatataatggtagcaaatacacattcttctgaaacacagagaacattctccaggatagatcacattatgccacaaaacacattaataaatttaagaagattcaaatcacattaagcatcttttctgaacatcctggtatgagactagaaattaataacaggaggaatttcagaaaattgacaaatatatggaaattgaacaacatgcttctgaaccaccaatatgtcaaagaagaaattaaaaagagaattaaaagatctcttgagataaataaaaataaaaacaaagcataccaaaacctatgggatgcagcagaagcaggtctaagagggatgtttatagtgataaatgcctacatcagaaaagaagaaagaatccaaataaacaacctaatattacacctcaaggtactataaaaagaactaactaagcctaaatctaataggaaagaaataataaagatcagaacagaaagagattacatcgaaactagaaaaacaatagaaaagatcaatggaactaagagtttgtttgttgaaatgataaacaaaattgaaaacctttagactaagaaaaaagagaaaagtcaagtggaatgagaaatgaaggaggaaacattacaacaaataccacagaaatgtaagggaccatgagactatgaacaattatatgccaaaaattggataacccagaagaaatggaaaatccctaagcatatgatacctaccaagaaaaattatggagaaacagaaaatctgaacagaccaataacaaatatggagatttgattagtaataaaaagtctcccataaaaagagttcaggacctgatggctttactgctgatcttacctaacatttaaagaaggactaatactcatccttctcaaactcttccaaaaaactgaagaagaggaatacttccacactcattttacgaggtcagcactaccgtgataccaaagctgacaaaggcactataagaaaagaaaattacaggccaaaatccctgatgaacatagatgcaaaaaccctcgaaagaataccagcagactgaattcaacagctcatgaaaaggatcattcaccacgatcaactgggatttatccctggtatgcaaggatggttcaatatatgcaactctattaatgtgatatgccacattgagggaaggataaaaaccatatatcatctcattagatgtataaaaaacatacaacaaaacacaacatcctctcataataaaaacactcaataaattagatatactgtagaagggatgtgcttcaacataataaagaccatatatgacaaactcacagataacatcatacgcaatggtgaaaagctgaaagcttttcctctaagatcaggaaccagataaggatgctaactctcgccacttctttcaacactgtattgcaaaacctagccagggcaattaggcaaaaggaagaaacaaaaggcatccaaattggaacaaaagaagttaaaattgtccctgtttgcagatgacatgatcttacatatagaatcctaaagatgccaccaaaaacactgttagagctaataaattcagtaaatttgcaggatacaaaatccacagacaaaaataaagagcatttttatacactgagaatgaactgtctgaaaaagaaatcagataataatcccatttatagtagctcaaaaaatataaaatacttaggactccatttgcccagggagcctggagaacatgtgagagctggagggcatgtttcccgatggctgttgataaatgttcattctcgtggtctgccctgctgcttgttaatcccaacaccaggaattggttgtgtttagcttgctgcatagcagacacctctgtgtggctggatccaacctcagaggtgtgtggagctctctctgtgaaacctttggtgtcctctgaggggtgtggacacaggtatagagcatctctacttccctagctcagaggcgaatggggttgtcacctgtctccctaacccaaggactgaggttttgccggagttagccggtgtagctgacatagacagcccgcgctctacgctgttccactcctcattccaccctgatcagacaaggttgagagcataagggctcttcacacctggcctcttacagcagcatgctctgtggtgtgggaatggcaggcctgatgaggagaagctgtggaggcagggctgggacacaggatgctggtgtcagaggagggggctcagctgcctgctgtacccaggcaagagcaggtccagcctcctggggcccgcctgcaggagcagcatggatggaggaggacctgagcgctcagctctgcttgtgctggggttgggcgggagagttgaagccggcgtgggcacatccctgtccttctgaggagagtggctattgtcatttgctggtctctcctgcagccttgcattagttagcaatgcttggcctttggaatgtcttgttcaccaggagtcctggcaccttctcctgtcccttcatagcacaggatcccccagaccactcttttgtttggcccatgggaccgcgagtgcccttttcttcccacacattctgggcaggagcgcagtgaaggtcatttcacaatggcaggatacatttgcagcatggcccaaagcctgggcacgtcagaaatattgtatgttttccactgagagcaacagcaagacagatgcagggagaaaaacaaaacaaaaaacaaacaaaagctcccagggaattactgagatgacgagcgtgatgaggagggttcctgtcatcctttttgtacccagtggaggataacgtcagcatatgggcacagccgggctcgtgggggcacaggcagactgctcaccctatgcaatctaggcaggcggcgtgtgccagccaggccaggcatattgaggcactgctgctttaaaagtccagctcaacgagctcaggcagcatgtggtagatacacatatgtagtagaagttccaaaattattggtgatagtacattcatcgcctgcacctgctcactccattggatgcgggcagaggagctgggtgggaatgccttcctgcgggaggtgtgggtagaggggacagaggtgggatggcagggagggtcaggaataagcggagtccgtacgccaaactatggagtgggacaggaaggggcacctgagagcctcctaaattctcattaggaagttcagaaagagtccataatttctgtcaaaaccaccgacagtggctctgcctgagctcaaattctcactcttcctattaccagagtggcactgggcaagggtttgcagagtggatctctgtctcagctttagtacctgtgaaatgggtgtgtcccagcagcacttactcatagagcatcaagagggccaagtgcattcatgtacactgactcggagagtgcctggcacacacacagtgcccagtgcccggctgacttggagagtgcccagcccacaacagtgcccagtgcctggctgactcggagagttcctggcacacaacagtgcccagtgcccaccagctgtttgtctggattctctctaaatgtaggacgctgccaatactgagtcttgtgagtccggtgcacacttggattgcacctgtgcacgacacacattggacacataaacacacaggcaaacaagtgtgtgtgtaaacgcgcttgagagaattgaagagcatcagtccatgttggaaaatccaacgacatcgaatatagctatgaacatgtctttcaggcgttcttaaacgtgtgattgattaacgtgtgatctgatcttgatgcccgaaccctggaaatgttttaggagcaggacacagccctcctgaggaaaaggctcctacgctggctgcctttgggtttgcttctctgtgaggtggcgattctgaacgacgtggtgattctaggtctgtgctcacagtgtgttctgagacatgctgtcacccctctgcatttctggtgctcaggaggccattagggaggggctggtggctttgagtggcctgaggagtggtggtggcctgtctctgtggctgccacggcactgctgatcacctgcatgggcgtgtccactagggctgcgggtggggtgaggtccggtcattatgccattggcggccaacaccgttgatgattaaagcttccatcagggtgccgtggacatgctgtgaccccggcgggtggccacagcaaggtccctatgtccttgtcacctgcatgccattccctccaccatgggcagctgcagactccacgacgtggccagtcagagctcccgtccctgcggcaagcccctggttctactgagaagcctggttaccctctcagtggtggtctcagtggttttgctctgtctcctgccccgtcttggctacaagaggctgggctctgggacggatggcagacggtgtgaactgcagacggggcctgctcggtcactgctccctctcctcttgggggtctggggagctgcctgaggctcacagcctcggttcatttcccacataggagtttgtttacctgtgacggctgccgcctgactgaagtacttgcttggttttcttattgtggcgaatacaaaagcatggcatgaacgtaacaagaagtgttttttttcatgcgtgttgtcgaatgcgtcttcccctgacatcagcgctacctttcctcagttctcttctctcaagagtgtcttcctcctgagagctgaggcccctgcatgtgggagcacgaggagggatcagccatctgtgtccggctgctgtgcgtgtgggagcatgaggagggacgagccgtctatgtcctgctgctgcgtgggagcacgaggagggaccaccgtctgtatcccgctgctgtgtgggagcatgaggagggatgagccctctgtgtcccgctgctgtgtgtgggagcacagggagggacaagccatctgtgtccggctgctgtgtgtgtgggagcacgaggagggatcagctgtctgtccggctgctgtgtgtgggagcacgaggagggatgagccgtctgtgtctggctgctgcatgtgggagcacgaggagggatcagccgtctgtccggctgctgtgtgtggagcaccaggagggacgagccgtttgtgtctcgctgctgtgtgtgggagcacaaggagggatcagccgtctgtcctgctgctgtgctcacttcagcagtgctgtctccttcaggactcaacatgccctgcagagtaagtatggctgccacagctcacaaactcagccgcagcctcgaccccgctgctctgcccgcggcttcctggctgtggacatctgagccaggccagactcctgatctgcgtctcctagacccacacacctctgacgcatggccccgcagtacttctacattcactggcaagttcccacattgtgtagtcaaagacagttgcttcattatagagtttaacaataaaatactcttttttcatcttacttttgataagctactttcccaagacagacggaaaagaccagttactcaattgttggtttttatatcttgggtttactatgctgagtgacgatttgtctgaaaatagaaaggaaaaaaaaaaaaaaaaggcagagccactcctgagacagttgggttcttagcggcaaaggaccctgttaacacaggctcagtttgacttgagttcagggcttctcaggagaggatcctgaggcctgactgtcccttctgggaacacagtgttctctaaccctagacaggaggccaggtctcttaagaggcagatttccatgcgacccaaaatgtctgggagacgatggctgggctttgagctgggagcctctggaaggagaaatggcttttgaccctgtaaatcctgctcctctggtgaccaaagtgagttatgcggggctcagagtagctgagactgttcacacctcaaaagaactagcagggtttattctggctttacccatggttgactcagacctttgtcaagaaacttcctttctaggagcatggatggggattttgggctctcctggctcctggactccttggggtttggggcgtggcaggaggtgggtgcaaagccagcaccaatgcaaagggccccaggcatgccacacacctgagcgtttgcacgggacgtggcaggaggggggtgcaaagccagcacaaatgcgcagggcaccacgcacaccacacacccgagcatttccacgcacctctgtgctcttagccagtctggatctgtgtcttcatagcagactgtgggcatatgacaatgtctcttatactgtaaagttacatgcaaatggctgtgcccatccgcttggattttggtgactatgttcttgatgaaaacacacaaagcatgcactcctggtattcctatttgcctttgttatttaggagtatgtgtatgactctactactgttttatatgcttttaaaccatacacaaaatgtatttgcttattttcatttttattttttgagacggagtcttgctctgtcacccagactggagtgcagtggcatgatcccagctcattgcaacctctgcctccccggttcaagtgattctcctgcctcactctcccaagcagctgggattataagcgcggctaacttttgtatttttagtagaggtggggttcactatgttgatcaggctggtcttgaactcctgatctcaagagatctgcccgactcggcctcccaaagtggtgggattagaggcgtgagccactgcgcccagccctcaagatttaaatggaagctgtgatgacgagcacatggctttgagcctgcaccacctctttagactctcgctagcctatgtttccagagcaccgtgtagccgtgggccggcgcagggcctggcgcctgttcacagcgtgctggttctgggcacagctgccgtgaggcctcccctcccgctttccatctttgtcatttcagtctcgggagaccttctatttctctactttagacagttgagctctctctgcaaacaacacttccattgttcaacatttgggaaaattttaaaattgataacacgttcctcagcaaaaaaggggtttaatgacggtggagaaactccacggccgcgtctctacgcagtgtcgggccgcacccgtccggctcccccaggctctctcggctcctcctttcatctcctggttctctctccatctgccctctccacccggtatctcagggctgctatgaaaggtcttcaaagacctagtttcaaaaaacatcccctggagaggaccaattaaacgcagaaggatggtttgtgtgcagaggctgagccgtcagagtagagatgatcctgcgttcccaggtagagccgcggctcctgccctcgtcgctgtccctccctgccggtgtcagaccaaagccagcgtccttaccgacccccaggcaggctctgccggcctcccctaggcagccatggcccccgacggggttagccaccttctcatggctgctgcctctcttcgcagcttcaggccggagaggacctgctttccgattgggcccgggaaaaccagatgtgcttgaaggctgtggatttaggatttggtgttccagatatggaagggacacaattcatattatgcggtctgtggaacaatgatttgacaggccagttaaagcattagacgagtttaaactgcttgagagcaaactgctgtgtcttggtgcagtttgggggcagcggtggggcgtgggggccgccgcggggctctgtgggttcgggggcagcggtggggcgtgggggccgtccggggctctggattaagtgcacagacctcgactgtcttcacggaactaaggagacctttattttacctggcacactgtggggtcaagtccacattgagaggtgataacgtgctagcagccctcgctcactctgggcgccttctctgcctcggtgtctgctctggccgggctcgaagagcccctcagcccgctgctgcactgtgggggcccctctctggggcttgctgaggccggagccggctccctctgcttgcggggaggtgtggagggagaagcgcggatgggagccggggctgcacacggggcttgtgggccggcgcaggttccgggtgggcacgggcttagcgggcctggcactccgtgggactggccggcacctgctgggcttgattggaggctggatcccgtgagaggactgccattccctcttccctgggtcgttggccatgatggtgggtctctgtctctttctcgcttcccctctttttctcttggttgtctgggacgagctcccattgggctgcctggagtgcccgggctaggggccacaaagtcctgcagcgagtaccagtgagaggtgaagctggctgggctgctgggagggtggggacttggagaagttttctgtctagctaaaggattgtaaatgcacccatcagtgctctgtgtctagctaaaggattgtaaatgcacaaatcagcactctgtgtctagctaaaggtttgtaaatgcaccaaccagcactctgtcaaaacggaccagttagcctctgtaaaatggaccaatcaactctctgtaaaatggaccaatcagcaggatgtaggtgcggccagatatggggataaaagcaggctgccagagccagcagcagcaaaccggttgggtcccattccacagtgtggagggtttgtttttttgctgttcacagtaagttttgctggtgctcactctttgggtcctcactacgtctgtgagctgtaacactcacctcgaaggtctgcagcttcactcctgaggccagtgagaccacaaatccaccacgaggaatgaacaactccggatatgctacctttatgagctgtaacactcactgtgagggtcttcagcttcactcttgaagccatagagaccacgaacccactgggaggaatgaacaattctggatgcgctgtgtttatgagctgtgacacccactgcaaaggtctgcagcttcactcctgaagtcagggagaccatgaacccaccggaagaaagaaactctggacacacctgaaggaacaaactctggacacaccatctttaaaaactgtaacactcaccgcgagggtccgcggcttcattcttgaagtcagcgagaccaagaacccaccaattccggacacaacatgtccatctacatcaggaagttgtgggttctgggcttattggtttgtattgattgttggtttcgagagagaatttcagtttgttgcccaaatggtgcgatctcagctcactgctaccggttcaagcaattctcctgctgcagcctcccacgtagctgggattacaggcgcccaccttcacccgcagcctcccgcgtagctgggattacaggcgcccaccttcacgtccagctgaattttttttttttttgtattttagtagagacggggtttcatcatgttgcacaggctggtcttgggatttgaccttgtttcctcctccctggggtcagaggtcccctggcaggtggtgggtggtccctgcattcgattcccatttccctgtccactgggaagtgtattctggaaggaagttcctacatccttctggctctaggaatgttctagacatgttacgtgctgaggctggtggggcaggctcaggcctcctgcagacgcctgttttctcataggagccatacttggtccccggccaccccgggccttggatctgatgattctctgggtgtgtcagacaaggacctggcctccctgttatgtgctggaggtcagggaggtcaggagcagggctggcacctctaactcccatcccccccttgtgtgcctggtggtcctgcccggctgagagcctttctcttagactctgccgcagccgtgatgccagacaggagaagccagggagggcatgggctgctccctgaaggcggattcctctccccaggtgggaggaggagcctctgtagctgccctgggctgctcctctttcccagggtggcctgaccacaaccccggccgggcaagggagtagggaggaccgtacagagtttctcttccccagctcattgttttggagacagacttggaggcaaggccagagctgtacgtcccagcccctgcgtgtgcacctcgtgcagcagtgtggcaaggccctgacagtgccttcaaggggtgcttctggcaggccccgggagctgtgtgatgaggaggagacttgggagagcgcgggttaggtcctggcactgtagccgcctcctcttgctgatttcaggggtcagtgttttcagggttcatctcctttatagggcagacttgagggcttcaggtacaaacgtccgtgtctccatcaggcctgggcccagcctcctccgtctggagcacattcctctgtggtcttcagcattggtgcccgtggagtggctgaagccctgactgcccgttgtggctgaggtgtgggaccgaatggcgaacagagtgggcaggaccccgaggaggctggaggccgattcgcacaggctgccgtcatctcaccgctctgacagttcttaaagcaacagtgcaagagaaatccactgcgacgtgagaagagcatgtttatgtgcacgtgtatgtgcgcgtgtgtgcgtgtgcgggcacgtgtgtgtgtgtgtgcacgtgtgtgagaggatggcttctgacgaaggggctgttcatggagctctgatcagccactcttgcccgtggggatcttgcagggtccgaccagtcagtgccccccaccccaccctgttagaggggacggagcccggtcctcaccccgctgtgggctgcctgagagtttggcttctccctccagagctgatagacagcacctgagcatatggccccctcggccccagctcacagtggcatgcctcgcaccctccgcccctgcctccactacgaggaggccgcccgcacacctggggaggcatatcctgccagctgagcgtccccaggccgacgtccttcccagccatggcatcagggccccgcagcagctggtgtcatagcacccacatccatcagcttccctggagcccctggcacagtgctgtgtgggcctggaaacgctggaagcatggtttcatccctcaggaagctggtggttaataaatggggccaagttaataaagaaggaagctaccaacaaggccatgcggtcaccacaactgcccagggccagggtgtgggggtgctgccttacagcctgtcggggccggggtgtgggggtgctgccttacagcctgtcggggccggggtgtgggggtgatacattacagcctgttggggccggggtgtgggggtgctaccttacagcctgccggggccggggcaggagctgtgcttcaagggcagagaggctttccaggtggacaagggacgaacacttggggagggagggaaggttcagatggaagaggaagctgagaggagacgcacccctggaggcagctggctgaccggtgggctcccaggagactgtaggatttgtgcagataaaagtcaggcagcagagtcagagggcagccatagcacgtgtaaggcggcggggatgctgacagcaagacgttttctggagaatctgggttttactgcaaatacaaattcactgttctcaggatggcggagggaccagctccttgggaaggtcacccccttggccacctgttgtccctgaggggctgatggagggaggaggccaccttatgaactgcaccaggtccgtggctttggcggtggaggccccatcactgcaactcttcttctgggagttcggctctgcctgccacacgtggaggtgcgcagggtgggggccagccctggcaaacccaccccacataacgtagtacctcgattctcaccaaagaacaaaaattacttgcgattacgtgcaattagcaattttaaattattaatggtggtgaaagaatgtgtctattcaacaagtaatttattgcaatttttgtaattgaaagtaatttctagcaattaaatcctaatttagagcattttctgggcgacgcctttattcatggggtgcacgccagttttattgttggctgctttgttccaggcactttgtccagtaaaatttgctgggtaggctctttgggaagagaaaaatagccgaactctaggcaatgtagaaaaaacagagtgggtctgccagcacagtgaagctgtggcttccctggagaggcgtgaggaggtgcgcgccttcccatggagacagccctgcagcttgttcagaggccctccgaggaagtgggcaggcacctgggccaacgtccagggagcacgtctctgtggccccgaggcgctgtccccactgtccccacagccacggtgctgtccctgctggaggctggtccaggcttggccactggcttgagctcttccccggggctcctcggcactgctgccggcccctggggacttcattgttctgtctcctctttcctggtaagaacaccctttaccctcagaaggcagctttttgaaccccacaatcagaaagtgctccctattttggggggagacaggactctgctacgccccaggagttgatctgtggtggatttgaatataaaaggcagccaggagatggtctttgtcgagatcttatccctgatgaagtctcttctttgtcaagtagcaaataaatattcggaatgaattcttcagaaacaaaatgacctgtgtttctatgtgaaatgcaaccacgttctcctccagaaagctgcagtcaggctccctgtgtgtggccacagcgtgattcctggtcatggggtgactccccccgtagggtacctgagcccctctgggccccacacctcaaatgcagatgcagtaatgtcgtcccaggcagcaggaagccacgcggcccctccacacatttccacagcgttcccaggaaggctgctgacaagctgggccgagcgcctcgggctcgtccacacacgctagatcccggagtgtgagggtgtctgtggctccccctgtgcctgcggctcccccgtgcctgtggctccccctgtgcctgcggctcctcgtgtgtctcctcctgtgtctgcggctccccgtgtctgcggctcctcccatgtctgtctgcggctccccctgtgcctgtggctccccctgtgcctgcggctccccctgtgtctgcggctcctcccgcgtctgtggctccccctgtgcctgcggctccttgtgtgtctcctcctgtgtctgcgtctccccctgtgtctgcggctccccgtgtctgcggctcccgtgtctgtggctcctcccatgtctgtctgcggctccccctgtgtctgcggctcctcgtgtgtctcctcctgtgtctgcggctccccctgtgtctgcggctccctgtgtctgcggctccccgtgtctgcggctcctcccatgtctgtctgcagctccccctgtgtctgcggctccccctgtgcctgcggctcctcgtgtgtctcctcctgtgtctgcggctccccctgtgtctgcggctccctgtgtctgcggctccctgtgtctgcggctcctcccatgtctgtctgcagctccccctgtgtctgcggctccccctgtgtctgcggctcctcccgcgtctgtctgcggctcctcctgcgtctgcggctcctcgtgtgtctcctcctgtgtctgcggctccccctgtgtctgcggctcccccatgcctgcggctccccctgtgtctgcggctccccgtgtctgcggctcctcccatgtctgtctgtggctccccctgtgtctgcggctccttgtgtgtctcctcctgtgtctgcagctccccctgtgtctgcggctccctgtgtctgcggctcctcccatgtctgtctgcggctcccccatgcctgtggctccccctgtgtctgtggctccccgtgtctgcggctcctcccatgtctgtctgcggctccccctgtgtctgcggctccccctgtgcctgtggctccccttgtgcctgtggctccccctgcgtctgcggctcctcccgcgtctgtctgcggctcctcctgcgtctgcgcggctcctcccgtgtctgcatccacgacgctgggacagggctgcaggcagtgcttctgcccttggttctgcatctcctggcctccccggcaggcaaggagctcacagtgtgggcttgtggtgggtgctcactggccataaacgttcggtgtcattttcaagacagagaaacagcacacgcagggccctggagaggctgcctggagctccacgtgccctgtcctaggagggttcctcccctgcgagctcactcccgaagggcactcgaatcctgcagctggggcctgagtcctctctccccttcgtcccacagccctgggtcttgtcttccttgtggctggagttgcagctacagcacagagctcttcccctttacattctgagctgtttggaggtccatggccactttcatattccctgatgctcaataaatgatgaatgagtgaaacgagagtcccaaaccgtgggactgtcagcagagtctgcatgcaccgggctggggggcaacacagccaagccccatcagctattgactgtagcttcctcctggtcattcctgatccttccatccactcagccttcccacctctccttctgccggcggcacctccccgatggccctcacacctatgaggccctggtttcacctcactctgcagtctggtgaaagggatctggcagatgcgactgtctccatcctgagggcttatcccggcagtggcgctgagacctcccctcacctggtgctccgagatttgactctgtgaggttggctcctgcctggactcaggctttcaaccctggtgtctggggtgcaaggcaggtgggccgcgtgcggtgtctttgaggtgggctgccgttctggtagagagtgaggggatgtggaagttccatgcagactgtattttctgggcaaacctgctcagtgtttttggtaagtaatgcctaaaattcaggactctaattgaaggtatatccctacttctgactcaaaccacttgaaaaactcagtcaatagacagtgacgttgggacccaagtctttaaagctctgctgcaattctcatccttgaccgttggtaccgggcagttgcaaaaggctgagcaagtacagcccaggcagggagaccacagggcctgcccgggccccggagacgcggctctccgaagacaagacgtcccggggggctgtttttccatttggaccagttccacttggcttgagatgggcttcactctagaccctcctctgccagctcagcacgaagtgtgcatagtcacctgatggcaccctgtggtcattttcacgttgtaggaggaaaaatcgttttaaaattggcttaaatgaggagggaacaacctgaccgtcttttgatggtgcagcttttaaccctaaaagaatgtcaaacgaattcatttttgtatataagtacaaattacttattagtcacaattgccatagcgactgaaggtttgtgtccgcctaccccacgcctccagttcctacatggaaatcctcacccaaggccatggtgttaggggcctttgcaaggcgctgaggccctgaggaagagcctcacggatgggctaatgcgcttctgaaagaggcctcaggacgcttcttcaccccttctgctgtgagatgacaggggaaggcccaaccaaaaagtgggcgctcaccgacaccgaatctgtgggtatctccagaactgtgagaaagaaacctctgttgtttatcaattacccaagctatggtattttcttatagcagcctgcatgggctgagacacctatcaagtgagttattaacgtttattaaaatttggcacaaactaaaagccagcagtgtctgcagagaagctggattgccccatggggcttggctgtgttgcccccgtcccgtgcatgtggactctgctgagagtcccacagttttgggaaggaccctgatgaattgtgaccattggtattgcttagcgttgattgtggcttttcattataaattatgtaattgaatactttaatgataagttgtggctagtccagcttcaacagtatggatctgccgattgtcggatattcagttaattatgcagtgtgtggagaggatatatgtgcatcaaaagcatttaatccaagaattccagtgactgggtgtcatttggtgttttgcggctgaccgctgcattcacaacacaagagaagcagcacgtgacctctcctggccacccactagagtcgaattttgtttccatcccacagttactccctctggcacaccccaggtggagggggtggtccaggtggagggggcagcccaggtggagggggtcgtccaggtggagggggtggcccaggttggggggaggcccaggtggagggggccgtccaggtggaggggtggtccaggtggatggggaggcccaggtggagggggtggtccaggtgggggggtggtccaggtgggggggggtggtccaggtggggggggtggtccaggtggggggcggctttcaggtggaggggctcatcaggtgtgaggggcgctcaagtggggggccactcaagttgaggggtcatcaagtggagggggcgatcaggtgagggggtgtcaagtggagtggtggtcaggtgaacgagtggtccagttgagatacgcctcaagtagaaaagcacccagggaaagnnnnnnnnnnnnnnnnnnnngtccaggtggaggggtggtccaggtggacggggtggtccaggtggagaagacggctcaggtagagaaggcaccccagggagaggggcagcccagtagaggggtggcccagcaagctcccagggagagggacagccaggtaaaggggttggcccttctgcagctaacagtggtcgaaaccttcccttattactgccctgaaaggactcagtttcccctggggtgttcagccctcaattgtgatagcagcacccactgcagggggcctggcctggtcataggcagagggagccagggggtcgggggcacgttatggccagtgagtgaggctcatctgtctccggtaggatcaccctctgtgaaggtagcagcttgcaccttgttgaccagtcaccagtgacatggagtggggccaaggaggcgtcctcaccccgagaaccatgcctgtgctcccagtgcccccgcctggctcccgctctgcacctataaagctggcctttgtgctggcccttctgccttctggccatgacttgccttgctgacctgcccttggccggtggagccttccaggcagcctctgcccacggggctctccaggccctgagtcactgctggcctgaccagttcaggtgtcctggcttttgctgtggggcgtctgtcctgggtctcctgatggtccagctctgggctcccctccacagtgagcagcccctcctgcaaaagctctggttggggcacatccaaggtcagaagaggcagattgcaggtcaggcagagagtggacgggcaactgctgggactctgtctctgctgttctctggctatctctgtctctgattctttctctctgtctccctgtgtctctctatctctgtctctctgtttctctgtctctatgtctctgtctctctgtctctctctgtctctttctgtctctctctgtctctgtgtctccgactccctatccctctgtctctttctatctctgtctctgtccctctcctgctccctttgtctctctctctgtctctgttcctctgtctctgtctctctctgtctctgtctctctgtttctgtctcttggtcccagccgtcagctgactttgctgtcctcctgggccctggcagaaccacctggcaggctcccgtcctgtgccatcctggacccttcaccattgttcctactctggctcagagcactttcttcttgaagcatcctttacccaccccagggacttgaaaactggatttgaaaatgccaaatagttttaaaattagagctgcagaatgtcttccccagagcccagacttcccaggtgtctgggaagcaaagacagccagcctgggctgcaggtatgccccggggactgggcacaggatggcagctgctcacatttattggcagcaaaggtcaaagcagaaaccaggtgtgatgacggggatggccgcgcctcctgaggctggtgtttgggcctttctgcaccaggcatggccttggcattcagggttacactgctaggtgagggccgtctccttgttctccttccatagatgaggagacgaggtttggcgatgggagggagcatctggggcggggtcgggcaggggctcctaggaggcccctttggggcattttccctgaaggccactccaacagaaggtgggggtgaccggaggcaacagtggcgactcctgaggggccttggagctcctcctgtgctcctccgttcaaagttgggcagcagccgccacgtccttcctagaaaacaaagccggggaggttcagtgtgtgcgttcaaaaagctgcgattttcaggcccggcaacggctttcaacaacaatgtggctgcgatatttcacacccgccctgtgtgcacgcggctgggatatttcacaccccactctgtgtgcgtgcggctgggatatttcacacccgccctgtgtgtgtgcggctgggatatttcacacccaccctgtgtgcgtgcggctgggatatttcacacccgccctgtgtgtgtgcggctgggatatttcacacccgccctgtgtgcggctgggctgggatatttcacaccctctctgtgtgcggctgggctgggatatttcacaccctctctgtgtgcacacggctgggatatttcacacccgccctgtgtgtgtgcggctgggatatttcacacccgccctgtgtgcctgcggctgggatatttcacacccgccctgtgtgcgtgcggctgggatattacacacccgccctgtgtgcgtgtggctgggatatttcacacccgccctgtttgtggctgggctgggatatttcacacccaccctgtgtgtgtgcagctgggatatttcacacctgccctgtgtgcatgcggctgggatattacacactcgccctgtgtgcgtgcggctgggatatttcacaccccactctgtgtgcgtgcagctgggatatttcacacccgccctgtgtgcgtgcggctgggatatttcacacccgccccgtgtgcacgcgtctgggctgggatatttcacaccccgctctgtgtgtgtgcggctgggatatctcacaccccgctctgtgtgcgtgcggccgcggctctgatgcttttgcaggcggcattgtgtcactgattcacttaggggctctctaattagctggcggctcaatgagctgtgattgcaggtgagacacagacttgttgacggtgctgaggatctcgtgccttgaagagcgctcaaatgggctgtcacaccacgagggtgaaacagttacccaaatacagtcactggggcagcatctctgtgcacataacccagtgtgcgtttaaatggcaagctgggaagagtcaactgcatcagcttctctctaaattacgggctggaggtggcagggaggtgaggtgaaggaggtaggaaacagtgttcctaagtccgtggtcacagctggtcacgtggagagatgcccagagctcttgctgtagagtcaggaagaacagaagctcagcctggcatagaggttgggttttttgctgcccttggtttgtacacagcactaaaaatgtttctgagtttaatctacttaaatgatggaaggatatgagagaggtgagagagaaggcctgcagaagcttaggctgtgcccacaacggctctaaccaggagctctcaggggcgaggggcaggcccccaggccacggtgatcccgctcagatgctcagtcacccccgtgtaagggttcccactgccacctccttgaggtggaaggtggggtgtggagcccacgtccatcatctccctgaattcctatcgctttgacacctggaattcctctgtgctgcaggcagggtctgggcgttgtccacaatcaacactcacacaaaaacatgctccctggcttccaggcggctccagatggagagagcacacaccctccccagtgtcctttctaacagggttgctgtgagcaccacgcccccggggtccccgcgggaaccagctctgccgggccagccggtcaactccagcacccagcacccatcatcccgtgtgctcacagtgcctcgctgctcggctaacaagcaggttggcaggtcccttttcctgactggctccttcctgattaagcagcttttaaaattccacgcaaagtgtcaacatttctagatctcttaaatgcaagagcttcccgagtgccaggcgggacctgccgcgggtgtggggctgtctgaggtgccagtcactggacaggacgctgcagatgaggcacctcccctgcagcttccccgccctttagtgacacggaaagtggaagccagacatcttggatgcagacgtgggagggagctggggtggaggcagctgggccaccccaccacccctgaaggccggccccacagcggcatctgaaccaccagccagggccactggagcccactttcctgtttgtgcagccaatggatgaagttttaaaaatttggcatatttgaactccattttttaatggggtcaggcaatgtactttgaattatttatcagactgaattcaatcttcaaaaattacagaactctcatctctctgcccaggttaaagccgggaagtggctctcgtctctctgcccaggttaagccgggaagtggccgttgtgcctgtcctgaggccgctgctgctgggtccctctgtcaggctgttcctcagttcacggaattcaggcctgatgctcacagccacactggccccggctctttctgccagacatcacaccgcagcagacaccgtccccagcctcactgccagacatcacactgcagcggacaccgtccccagcttcactgccagacaacaccccgcagcagacaccatccccagcctcactgccagacaataccccgcagcagacaccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacatcacaccgcagcagacactgtccccactggtcctccagaccaggggtccccaacccctggggaggcgaaggagccctgcgcctctgtggggtctgagcatgctagagagagaagctgggcaaacagatggggtggacgcagcccccacgcagactctgattctgtgttccatggcggggctctgtgggcctccacccaaaggcagggctgaagctcctgctgatggggagccaggcggcctctggccaccgcctttgatgtgtgcctggaccatgtcctcatggtgcctctgctcattcatttccagctgtactcatcaaatgccacgctgtgtacccggggctgtgctgctgggcagcctcacacagttctgccaggcctcctgctgaggcacttctctgagggctggtgatagactgatgatggcaccaggtgatcccttcacccagagtctgggaccaaacagaaatgtgcagagggcagcctggcaagggggctgtgcagagggtggacatggggggatatatgcacctgtgggtgggtgcctgcaggtgggtgcctacctccaggtgtgtcccgtcggtgtgtacctgcctgcaggtgtgcccacaggtgtgtgcccacaggtgtgtgcccgcaggtgggtgcctgcctgcaagtatgtgcccataggtatgtacctgcctgcaggtgtgcatccacaagtgtgcccctgcaggtgtgtgcctgcaggtatgtgctcgtgtctgtgtcaggggcctctggggaccactctgagccacatgggggtgtttccagcaccaggagcatagtggatggcaggtggggagccaggtcagtgggaggccactaccgagaggccttgctagtttctgagcaagtcactgctccaccgggccaggggcctgcggaacacatacgaagcatgcactaccttgggggctgggaggtagcctacctggagcagatagaaagtgacctgggggaatgtcaccaggcttgggggctgtggggcctggagtaggagagcccatggccaggagggctgttgtgaacaggcggacctcgactgctctagcaggtgagggtcagggggctcttcgtgtaaaggcagaaaagggagggaagaggaggaggaccccaaaactccatgggacagctcctcccgggcatcaaggaaagtgccagcaaggaccagggaccccacgtgagaagcagcatcgctgttctggaaccctaccaggaacaagaaggtgcaagctggcttttcggaatggggcagttttcagtgcacacttgaggcagtcctggagcctgggcatggaggaagagcattaggagagagcccacggctcccggctcccggcctttggtccccgcaagggacctgagaccatttggagtctcgaggtgaatctggggcagtgagtctcttcctagactgttgcaagggccatctcgatggtccccactgtcacctgctgccaccggctgctgcaggtacccatgcacatgtcacgtgtggcccatggcgatctgtcgtatggacaggagtgtggcttaggcggtgaacttcaggctgtgtgtgtccagcatgtaggaagagctcagcacgatctttggaccgtgtgtgtccagcacgcaggaagagctcagcaaactgccctgggaagctaccttcactccacggtgctttgagtggtaaatgattgtctaacttgagatgtcagtgtgccagcgtctcagtgcagttccatctggatatgtattttatttcccctactgaattgcatggttttatttctaccacgacattttcaggcggtcgttaccaactctaaacagaggctcattctgcctgacgcgctgctgcggctgttcgttagggacaatgttatcagcaagccttgactagaaggtgaggaggcttggactttcaccatgtgacctccttctaaataataaccgtttgccgctccaaagtcctgcactggaagatgaaggtgggaagcgtgagagtggcaggggtagagttggacttgaatttagggagcccagtggctctagatgaagttggtcagctggcccacatcaccgtggagtttgctgagtgacgcgggtgttcagccacctccgctgggtgcagggtgtgctagggaggtgctgctctctggctcggccgtcattgcagccttgctttcacattttcaagtgcctctcactcagtgtcccatgcagggaggtgtccacaactggcaggaggttctccccaggtgccacgggtgctttggaggggtccctggtgggaaaagggccgttgaggtgctgggcgcccacccatggctgtgccttccccttagccagcaggccacagaagccaggagctggaatgcccgggagaggaatttggaagtagaccctcacccagcacccagaggctctgtggcagagcgatgggaaatacacaaacaacggtggggcaaagtcctccagagcaagctgagcagatgctgatgggcctgccccaaacccaggcagcatggggtgaggaagcccctcctgtgggatgcggtcgggagaagatggctgtgtgtgtgtgcctgtgtgtgtgtgtgcatgtgtttgtgcattgtggatgaatgtggatgtgcacgtgtgtgtacagtgtgcatgtgtgtgctcatatgtgtacacatgtacatgtgcagtaggtacagctgtgtgtacacccacacacggtgtgcacatgtgactgtgagtgcaacacgtgcagtgcatgcacaagtgtgtaaatgcatgcatacagtaggcacatgcgggtgcacacaggtaccgcatgtgcagtgtgtgtgaatgtgtgtgcagtgtgtgtgaatgtgtgactgtgtgcagtgtgtgaatgtgtgtatatgtgtatatgtgtgtgcagtgtgtgaatgtgtgtggtgtgtgtgatgtgtgtgtgcaatgtgaatgtatatgtgcattttgtgaatatgtgtgcactgtgtgtgaatgtgtgtgtgcaatgtgtgtgaatctatgtgtgcagtgtgtgaatgtgtgtatgtgtgtgaatgtgtgtgtgcagtgtgtgaatgtgtgtgcagtgtgaatgtttgcagtgtgtgtgaatgtgtgtgcagtgtgtgaatgtgtgtgaatgtatgtatgtgtgtgtagtgtgtgaatgtgtgcagtgtgaatgtgtgtagtgtgtgaatgtgtatgtgtgtagtgtgtgtgaatgtgtgtgtgcagtgtgtgtatatgtgcagtgtgtgaatgtatgtgtgcgcaatgtgtgtgaatctgtgcagtgtgtgtgaatgtgtgtatgtgaatgtgcgtgcagtgtgtcagtgtgtgcagtgaatgtttgcagtgtgaatgtatgtgtgtgtgcagtgtgtgtgaatgtgtgtgaatgtgtgtgctgtgtgtgaatgtgtgtgtagtgtgtgcagtgtgtgaatgtgtgtatgtgtgcagtgtgtgaatgtgtgtgcagtgtgtgtgcatgtatgtgtgtgcagcgtgaatgtttgcagtgtgtgaatctgcgtgtgcagtgtgtgtgaatgtgtgtatgtgtgtgaatgtatgtatgtgtgtgtgcagtgtgtgtgaatgtgtgtatgtgtgtgcagtgaatgtttgcagtgtgtgtgaatatgtgtgcagtgtgtgtgaatgtgtgtgcagtgtgtgaatgtgtgtgcggtgtgtgtgaatgtgtgtatatgtgttgcagtgtgcatctgtgagtgtgagtgcctgtgtgtccatgcaagtgtgtatgcttgtgtctgtgtttacatcaggaaagcaggggagggaggcaggagtgaaccggggaggcctcagactttggggcagtcactgtggcctcgagggtgtgacccttaacatcccctgctggacgtaggagctcttcgtgctctgggaaccgtaggtggcctccgtgctgcagccaccggcacctgggaaccaggggctcagggcggctgtggcccctcctgttgtcacagtcaccgcgggaggaggggcagaagtacggcgcagccaccacgggctttagggccaagtgagctcctagattcctccctcctgagcactaactgtgtggggaattagcttctcctgaaataacgggaagccccgtcagaatattcgaaatgcaacagacacaggtttcctaaaatcgtccgtagtgcctggagctcaggttctgagggtggctcatggcggtgccctgaagaggcttctgcatggcgtcttccacagagctgctgtgtcctggcggtgtgcatgcccagacagggacccatgtgtgctggggggagcctgcggtcccggagtgcaccctgctgttttatcctcttcgtgtgctctatggagtggacgtccacattctggctcaggatgggtggctggagtcccccaggcaccaagcctctgtctctaactggcaggggagccatcccttcccttctcacctgtgcaggacagggctcagtttgcagggagtcgctgggccctgaagcccttccttggcccatcgctgcctgtgagcccctgaggcttgggctgggtccctgccaggatcacacagttgggaatctggggaagggattgtgtctcacaagttcgtgtgctttattatttcccaggggctgttacctccctccccctgactccttgccctgtccaagctccatgtggcctggtgctcccatctttccgggagcctcttcccgctgcccggcctgcttgtctgcatgcaggccgaccctggcctctgccacctgctctctgagctgcccgtaggcagggtcttccaccttccaccatgtcctggggtgcgctgggaaagagctcgggatgggcactgttgctgacgctgacacagactcagccagtcggagcctcacgccccccttgctggataccccaggtcccatcacagtgcagcttctcagaggagtcactgtatctattgtgcccagacctcctacaagtggctctgagggctgagctgaccctggagggacaggccccctcctgcccgtctgcctcctctctcctcccctgtctctcctgagacattaggagctcacactcctgcctgaggacctgccagagtggcagggcatgctgggtcccggcctgtgcgactgatcagctttctctcctggcttctgggtcaggaggaaggagccgtctctgccagtcttccccttgtgtaggcgtggcagcgagggtgttttctggaaatgccagcctgaggcttggggtcttgccatcttcagccccacggagcgctagtggcaacagccagtttgtgtttgtgtgtgggtgtgttatgtggacggggattttaaccttactatcagcattagaatgtccgtaggataaatgtcatggttgttttgcttttgttttggggtattgtgggagtgcatactttggattctataggccctctgggctttattcaaatagactctttttctaggccttctgaaaaagtcgtatccggttgtgtctctgcttctgttaaccatgatttatgaatgcatgcattactatacattactgacaaattatttataaagcaaacttttgtgtataaagtcttatttccccatggaattatttaataacatttgagctgtgtgctgagaaggtgtttttgcaggcactgatatgaaagcttttgtcaagctagctgacttgggaaggcagcctagggcggcatcctggcctgagagtcctcagcattgctaattggctttgctttgtcgtgttttaggcagcctggtgactgtactgatgtgcttctccaaaccccacagagagacagcaggcatcttgtctgctaggcatgcaggcgttctggttctcatgtgcagaatatgcacacagacgtgcacgcacatacacacaaatatgtgcatgcacacacatgtacacacaaacgcacatacatgtacaccagggacacatggacacacaaacacattcacatatgtgtacacaaagggacacgtggacaaatacgtgtataccagagacacatggacacaaacacatgcacatatgtgtactcatggacacatggacacacaaacacacatacctgtacacccggggacacaaggacacacaaacacatgcatatatacatgtacacacagggacacatggacacagccatgctgctccctggtgaggagtgggagcaggtgggatccccgggaagagtgagtcccactcttgggctcttgttataaatccacctttggcagacacgccctcctctaatttcccaaggaacatgccagccgttggtgccgacggtctttggtggagcctccagagcctcctttaggcttttcccaggggctctgaggggtgtctgtgatgtcactcttccctgcagcacagcagcagctgcgggttgtgacgtgggatgagaggccgcttgccctgcccggaagggtggctctgtgccctgcatgggccacctgcttccctggctcttctccgtgtcctgcgtggcctgcctgctcccatggcccttctctgtggcctgtgcctgtggccctttagcattgtgttggttatcaagctgccatttgtcatttatttgtgcatctgccttgagcaaccttccacttccggtgtctagaagttctgctccttgtcactccatttggaaactgagctctcactcaagagacgtttgcagcatcaggcagcagaggcatcaggggtcctcacggggacatgcacgaggggtttcacaggcgttgctggtgctgctgcctcaacccgtcctgctcctgcttcctgcctccctgtaccgacgctgcacctccctcaccccactctggatcctttagttgaaatcaactcttccacattcgtctcctagccggtgtgtctacccagcacgaccacgcagtgcaggcctcgtggacagacctcgcgtggctgcaggagacttctggcttcctgggaccttgtgaaaccagatccccaaacgttcctccctaaagcttaacaatatgaacaacaaataggccaaaacaaacagatacagaagcaacaaggaaaaccctggatgccattccagcagagccaacggctggtggttgctgaaaaagcaagagaatccaccttccaggaaaggcttcagggaaggccctgaaatctctgaaatctcccccaaagctgtgactggggggcaggggaggagacacagacccttccacagaggtggtatctgatgtggtcgcccccatcctaccagaggctggatgcagaggatcagcagggcggccacccaggcagctccctccgtggagaagcacatgcacatggagtgcgtactcacagggtcgtctcgcggcgattcatagaaatttaaattaaatgcagacaacagaaaagacaagaacttaagaactggagcaggaaggaggctgatgatagcagagtgtgagacgcaccagagccctttccacgccagtcgcgcagggcaggggctgcacgtggagatgccgggggaggcgtcagcggctgattcaggacggcctgtgttcaccctggagcaggctctgcagcagacagagcggaggaaatgtggtgtgtggacgtcgggaatgctccaggagaaatcccaggtgagaaggagccggggcagccatgctgtgagctgttcttacgtgcccgcttgaagattagttctatttgggtctcttaaactgtcaggctcccgcccagttatcttacctgaagcagagtaggattcaggctgcaaagtgaaaactgcctctcaagaaagccttaggtaaaaaagaatggatagaaggtagctatgatgagacccatcccactctcagctcatgtgatgagctgaggcagcgctcagaggaagagctgctgtcaccgcgaagccagggtactgtcagctgacagcaaggagcccagcaggggagggcatgggctgtggccctcaccagctcctctgcaggcgggctcacccctggcacgcacgccatccctgtgattctcatcatcagggcagttccaggtcagcgccgtggggctgggcgggggcggtcaccgccgcaggtcttggtcagtcctccaggagcggagctgcagggttggatcctttgtacagtgggtgagacccaggctgagcgaagtgggcttgaagcctgggggctcagacatttctcgctgctgcacgcttgctcacccaactgggggctcggggtcgtccagcaccacagtcctctcatcctatgattcccagagcttgagggcccaccagaaggaagagcagagttccagattgaatacaggatgcctgactggattcgaatgtcagagtaacaagaaaaagacatttagcgcacgtacagcaggtcctcaaatcacgccatctcattgtaatgctgaggagaaaagaatcagccaaatctgggacgtagactctctgaacatttggttcctgtgtaagtttttaatttaaaggaaggatcctaccccagaaacacgccacaggtttctgtgatcaaacctgaggggtcgggttccgcgtctgactgcgtcctgagcagccgtgtgcccgggtctctccacacgctggtccagggcaaaccccgcctgctgacctgggtggtagacagaggatactcgaaacctctttgagcatgattctggttgtccgggtccctcattcaactccatttcaacccagatcccagggaaagcagggatctgactgggctctcagtctgccttagcaggttgtctcatgcctgttccagggaactaggggtccggaatttacaggggatcttctgaaacccaagctcccagacggcaaaaagctggtagcttgaaggaccttattcctcgttttggcagaataaactcacatccatgtttctttttgcataagtttaggttatagatagatttgattattccacaatttcttagagactatattttttgggaaaaatactcttttctactccaagaaagataaattttattacagatggtgaatcattccataaacttcctattagggctgagtttaattttaaactcgggcaaattctattgctctcaagccaccagggtagtgcatggttgtccaacatggagcttctgctgggcgcccagctgcttgagtcctgccctcttctctgccgtcatcacttgtcctcacgggagctgcctaggttcccccccgcccccgccagcttctgtctcctccaccacctttcctcaggtacctgaaccaataggtaggtcttccggggccttagtgtatttctaaaactgccaatggtccaccatctaaaactttttaaaattccacatggcgcggaccagaataatggccctgcacttgtgactggctggtgaccttgctccaagggtgcacgtgacaactcctctcagagtgaggagaagcctcggtgccctcttgtccccctcagcagaggcagccgcggggtccctgccacgtccactttcctcagccagtcggcatcagactctgagtcccaagaggtcagtccattgtgtgggggacagagcttggtccaaagctgtgcctatgggagacaacagaagaggaccatcaaagcatcgtcgtcaacactccctgcccacatcacctttgcacagagattctgcaggcaggcctcccccgaaggtcctgcagtagacacgggacatccctggatgagacagaacacacagcacctgcagggttctgatcacggcatccaaaatcaaacccgctgagaagctggagtcagcactggctctcccagcaaggggtttcctgtggcatctaagtctgaggacagaggtagttctgaggctgggtagttctgagcatcgtctggtttagaaggttttgctcagtgggtccagctggaacaggcagagaaaggtagtcaggcagtgaggacgggtgccctgaggcttagtgccaagccccagggacaggagggcccattggcctcatcagctggcgagcccagggcagccagaaaagagtggccaggagcttggtgcatggggtgggagggtgggtcagggcccactgcaagggtgcggcggacagcacagccccagcgggaatggagtcctcgaaactgtgagactcatagtttggtaaaaacatttccaaagcatcctgaatggacagagggcaccctcactccacaaaaagctacatgattgtgtaattctctgtacacacatactgtcctctgcagttccccaaatccgtgaaccacttttaatcctgaagctgtcgtgctgaggcaagttcaggttaaatttcagcaaggtggttcggccgcggatctttggtggtggagtggccgatcctcttgttccccacaggaaggcagcattccctgttccctgtggccgtggactcctgccctgggcctactttcttccagagcccggcccctggaggctgaaccaggccttttggtttcctctgtggtgtgatttgagagatgcttgtagaaacggtcagataagccccaaacatcttcctcagctgtgctcgcgtgaagtcttgcccttggtgatcttgttgggtagatcattgccttgtctgggtctttagccaaagaacctcccttgctcacacgtcgtgaagcctgcaggggcttctgcgagggagcttttgggttgctctgtgtcactcaacaccagaagacaggaacctctatacaaagaacaggtcctggacgtgggtgagcagagaagggatgtcctaggaaagacagcaggggagggacatgaatttctccttttctgcagcttcttcctgggcctgggccatgcctcaggattttccctgtaacaccatgcttcgcatttattattcgtgtccagatctattttgctatagaaagtagacatgtctaagaagtaaactgcaggatgagaaagtttaaataatttgtttcttcaggtgcaaagatgactgtcgtagtttcctgtcctgtagggaggtgaaactcatgccctctgctcctgaacgcagagagggagggctgtacatttttactgctgtgtgcagcggtggctctgtgccactgtccagttacagggatgctcctgaacgtggagatggagggcgggtcgtgccgtgggcagtggctctgtgccactgtgcagttacagggatgcttcctctgctcgataaatatggatgccagcggctcgagaatctgttgcccagctcgacttctgcgagcctgctcttaaaaagagttattccgctcttctaatgaatcattttctcaatttccttcctcaccattagagtatttttaaagcactggacaccttgttattcaaggaagtccccagtcttgcctcgcctgtgtgccgcattctgcagattctcatggaagactcaaggccaacctgaccaccgccgaggggaggggacagattcctgtggggcgtggtcctggcctgggtttcgggagtctggcgtgtgctctggagacccggggctgcccctgccctagatggttttgcagtgggttccttgtggaagcaacaggcgcggcaatcacccggtgactggaaacggaaggttctgttgagtgcttcctcctttctacgaaacgcagcataaaacacttctgtgaaaggagcacgttgttaaaagaaacacacgaaagtgtatttaatgggcagagccccgcccgctgtgctggccccggtcagtcctcgagtcctcaggcccccgcccgctgtgctggccccggtcagtcctccagtcctcaggcagcttcagttatgcacatccaggctcagtcgcctggaaaatgagactggcccaggtagatctggtggatctgccagtttattagaagaaaaggctcatgtatttatttaagtcctcccagcattagtgcttgacacatatttaaagcacttggctaaaaaacagattggaactgtggttgggtttggtctggacaacgaggtctggtccggggaaaccacaccctccgcatgccagcctcagttctgagtgccgtgggcatgacaggaggaacctcgggccacagggactctcactccgccagcccaagggtgagggaagattaaggtctcctttgagaaaccaggctctgctttgtgatatggggtcgttttccggcatgttaatctccccatcaatcgggggtggtgggggtggctcatgttggggaggattggatttggggagtgagaggttcgttctctggctttgcatgtgatgcggctgattgtcgggatgtgctgtgtgattttgctgcttggactcgatctaactgggctgtcagcctcctccttgggcttcagcactggggtgcctgtcacgcgtctgtgcagctggcgtggtggcttccctgaaagccaggtgcctggagatggggtggtggggccttcctaccctgtcctgtcctgccatcctttggagaaacgtgtctcttgtttgtctttggtaactggtgcagggctggggctgggggttagtgagggatagggctccgggctatcaggtccgcctggagtgctcaccaacccacacactaattcaggagcagtatgcttgggtctgcctgcctagaaaggctccattcccgctgcccagttggccgccttcatctgagccatccgaacggtgacaccactcaccaccctgggcacggggatgattccatttttcctccaagtaattggcactgagagattatgggagtggtgtggcaggagcttctgcgactgctctgattctcgccgcagaggtgatggggacgaggcagagttgtcaggccactggtgctcaagtgctctcgcgttcccacccactccgagcagctgaggcttgaggctgtgcggcaaccagagcagagttgccatggcaactggagaggcaggctgcttaggcgaaggatggatggagggaccaactttgtgtttctggtaaaatgggcgtgtcccacagacgatgaggaggccagagccaagaaggggctttgctgggacctgccctgagcctggggcaggtatgtggtggctctcgtttccctgacctccccttagggagccctgcttgtgtgtccccaacaatggaatggaggcttcaagtcacaggtccagttttacagcgtttcaggatttgcacacttactgtgctgagcatactctgggctttattaaggtgtgtgtctgtgctctatacgcatgtgaggtaatgagggggacacacacatgcatacgtgcaccatatacatccattgcacacctgtgcacaccacacgtgcaccatagacatccattgcacacctgcacacaccacacgtgcaccatagacatccattgcacacctgtgcacaccacacgtgcaccatagacatccattgcacacctgcacacgccccacatgcaccatagacatccattgcacacctgcacacaccccacaggcaccatagacatccattgcacaccccccacatgcaccatatacatccattgcacacctgcacacaccacacgtgcaccatatacatccattgcacacctgcacacaccccacatgcaccatatacatccattgcacacctgcacacgccccacatgcactgtatacatccattgcacacctgcacacgccccacatgcacacataccgcatgcacatgtatcatatccgtgcagtaaggaggacatctgatctctgctgggagaaaggcgaggttctcctcggctcaccaatgagggttccaaagcaccccagggacctcagcaggcaggacgggagcccagttctttgaccctgagcacttgttcccattctcctgaagatgagcacattattaccgtcatgctgtgtggttcttgagagcctgctaagtaacagtacgctttgtgcgtgtcccattaccctttctatgcattaggatttcatgccagcctagatagggaattgtctcctagagtctactttatgtgatttccaccgagatttccagggggctttaacttccgtacttgttacaatcaagtaaaaatgtgctcatctcactgtgcgtaatttcaccttttttcttttggaaaatttccccacaaacactttaagaataagcgaattgttaattttttctctaccagatagcaaagcatctggaattgtcttttgtggcaacatggttaggaggacacatttatgactggttgaaaatgatatgaaatagtgatagcacagtgctgctaagagtcagctgatgttgatttgaaggaatcaggactacggcgcaacattcaaacatgttttgcatcacgtcaaaaaacagacgagagagaaaccacaacaattcgggggtttgagattttgcaaagaaaatatacctgtcttataaaaatcgttgttttctatcacttctgtttctgtgtggatgtgggggggatgtgtgtgtacgtgtgtgtgtgcatatgtatggaatgtgtgtgtacatgggtgtgtacatgtatgcagaaaagcaaaacctgagtctgggttaagagcagatggagaggggatgaggatggggaggccggttcccttttgctgttctgtgcaatttctgccttgttttgataccatttcaattttcttaaataggcatgcattatgctataaatgtataacaataaataacctatatgcattagaaagaatctgaaaattatgcaacagtaggaatgagagaatatccacattcatacatcctaaaaatgagggcttaagtgtcctactttatctgagctcaggttagaggcagggaccaccccatagatccgattgtgggtcctgttgttcggctttccttgatagtataagtattttctttattataatatttccataaatatgtgaagcatttagagctgatgtaccatacttcaacaattcatctgttgctttttactttggtaagagtagaccataaatgcatctgagtgtcaagtgtaggaaactcgtgtgtgtgttgtgcatccactgagtgtccagtgtgggaaactcgtgtgtgtgtcgtgcatccaacacgtgttctctcacttgcattacactcagatgcatttatgacacaatgacactgcacgggtcgttgtgcacacacactgggggagggacgtggcgtcttgctggagcacaggagaagcagtttaaatgggaatgcattcagtgcatgtctgtcaaagttatgagtgaatgatgcttggcaatgatgtcacagagggcatctgaccgctgagataaagccctctgcagtccccaggggatggggcttttctggtcctaaagcctcactgaccataggaaacccctcttccacattttattggctgcatagacgtcacaactgggagactcatcagccaatccaactcacaggtatggtgcatgtgtgtgatgcgtgtgcatgcagggtgtgtgtgtgcaggtgtggtagatatgtgtatgtatgcatgtatggtgtgcatgtgtgtgatgcatgtgcatgcagggtgtgtgtgtgcaggtgtggtagatatgtgtatgtatgcatgtatgtatggtgtgcatgtgtgtgatgcgtgtgcatgcagggtgtgtgcgtgcaggtgtggtagatatgtgtatgtatgcatgtatgtatggtgtgcatgtgtgtgatgtgtgtgcatgcagggtgtgtgcatgcaggtgtggtagatatgcatatgtatgcatgtgtgtatggtgtgcatgtgtgtgatgcgtgtgcatgcaggatgtgtggtagatacgtgtatgtatgcatttatgtatggtgtgcatgtgtgtgatgtgtgttcgtgtgtgtgctgtgtgcacgtgtgtggtgatatgaatatgtgattcacgtgtggtgtgtgtggcatgttcatgtgtgtgtgtgatgtgtgcatatgtgtggtgtgtgtggtgtatgtgtgtgatgtgggtgcacgtgtgtggcatgtgtgcacgtgtgtttatgtatgcacatatgtgctgcatgtgtgatgtgtgcatatgtgtggtgtgcacgtgtatgtgcatgtatgtgatgtgggtgcatgtgtgtggcatgtgtgcactgtgtggtgtatatatgcacatatgtgctgcgtgtgatgcgtgcatatgtgtggtgtgtgcatgtgtatgtgcatgtatgtgacgtgggtgcatgcgtgtggcatgtgtgcacgtgtgtcatctatatgcacatatgtgatgtgtgcgatgtgcacatatgtgtgatgtgtgtgcgtgtgtaggggcatgcatgtgatgtgggtgcatgtgtgtggcgtgtgtgcacgtgtgtggtgtatatatgcacatatgtgctgtgtgggtgtgatgtgtgcatatgtgtggtgtgtgtgcgtgtgtatgtgcatgtatgtgatgtgggtccgtgtgtggcatgtgtgcactgtgtggtgtatatatgcacatatgtgatatgtgtgcatggggtgtgtgtgggagtgttttgttttgttcagtcctacacagtattttgaaaattttgaatttattgcaaacattttaagatttgaattcaagtaaatgagaaacaagcttcctggcctcagttccttcagggaaacactggctgccccttgggagggctgtgtccccacgtggtcggggtaccccactccttcctggctgcatcttggggtacgcaggtgcttgctgcatagctggcagctcagcggcttcttacaggagagctgggagaaaagcaaaggcttttctcctctgacatttgcctccagcccgatggtttgagtgtcaagacggaaggggtggggccgctcctggaaggacagcatgacccgcctggccttagtgggctctgagcaaagccccagctttaggatttcatcttagaagcttgttaaagcatcactcattctctcccattttcaaggagtctctaattctttaccctcagaaacgatgtgctgtgattttatgagacaagcctttgggatctccctaataatggggggataaaggcctccccctcccgctcctctctccaggctggggtcttgtgcgaggtatggttaagaacacagatggtaggctgggcgcggtggatcatgcctgtaatcccagcactttgggaggccaaggtgggtggatcacctgaggtgaggagttcgagaccagcctggccaacatggggaaaacccatctctactaaaattacaaagttacccaggcatggtggtgcatgcctgtaatcccacctactcaggaggctgaggcaggagaatcgcttgaacccgggaggcggagattgcagtgagccaagatcgcaccatagcactccagcctgggccacaagaatgaaactccatcttaaaaacaaacaaacaaaaaaaccgcagacacccaagtcccctttgctgtgtttgctgtgtggctggagagggagcaagttacctgtgtggagtgtttaggacggtgtctgagtggcccagtgcccagctgcccacgagccgtggacatgggcgtggtggggaagcaggggcgccgtgaagaagagcacacctgggacgggcacccctggccactccttccctttgcgcccctgtatcctttgcttagacacgcagacacggtcaagagcgccctcctccccacttccccacctcccatcacggccttctcctgtgagaccccacgtgggttggaaatctccttccagatcctggcgcctgcccccttcctccacccctcttggccagggggcgtctcagagcccagcgtgcgcctcggtgctcctggccatgctggggggtgccacccacgggccacgctctgtgtagtgagatgcaggggctatgtgcagatatggggatgggcagccgggaagcccacacctcctcattccttgaggcagcccgtgccagggatggtttctcaggctgcctaaccccatcgtgcgtcctcacacatgtctcccagcccaggcctggcatggctgcacgcttgctctgggaagctccatgcgctctatgagaagtgcgtggagatggcttctgatggcctcatcacagaaactcaacaggccgcgcattcctggtgtagcccctctcagtcctgtttgaccagctctgaagctgtcttgtgacttttcccatcgtgggtcacgtgcaccatcagtggattccggcatgaccacggattccggcatggccatgggaagcacacgcctgggggacgtcacccctggattcactgtcgtcgttgctgtcatcagagccctcccacacattggtcggccttgcctgtcagctctgtaaggttgaattagcaataaaaccatatgcttttggttgcagtcactttctgcataagtctttaaaaaggtcaaaaaggaagaaaacgcaacttctttaaaatacagattgtcctactttgaaaaatcccgtggacaaggacaatgaccacccacggtgacttgtgaaacgctcacattttcttatcgtcagcagccccagcatcctccttctcccgtgtgggacttcctgtcctgtggaccacacggagttagagctgggggcagtgagagccgtcttcttccttcttggtagagagacgcgtctcgactccaaatctttaagcctctgtttctctctccatctctcacctcccaggatgtctttggtcaccaggagacccacccattacgctgccatttccataacatggatttttccccctcttccttcaagtgatgagttttttcaagtgataattttattcatgtggggtatttatattttgccgtatgtgccgagaagcttacgagaaaggtgtattttaaataaatcaaattatcaatcaatcaatcaatcaattagtgaatgcagcctggcccagaatattcatttttaatgaattttggtttcacacaatcctgggtcatccctggagggtaacatcatgcggtgtttattgtcgcaggtggggagggcaccctgacggtctcgctgctgccaaccaggccctgatttgtgtctcagtgactgaaagttagtagggtaagagcagctttccagtgtgcctgcgagccagactgatgtccagctccatgcctgtgagtcagcagccccatgcctgtgagtcagcatagggataaccatggcaccggggttggcggatagcatggtggccacgcacaagcgacctactgtgtgccggccctgagccggctgcttccacatccccactcacctgttcacacagccacgtcatgagacgctgtgcctgactcctggggaaactgccagaggggcctagaaggcagctcccatccatgcgaatttggatgtgcagagttgcctttgtatcaacccaaacaaacccagtctggaaaactccctccacctagtaatggatcagggtgcaggtcccactctcggcaaggagacctgactctacgtcaagaggtcggctcggatgaaaggcccctggtttgactcaggccagggcggcccatgcgctctatgagaagtgcgtggagatggcttctgatggcctcatcactgaaactcaacaggccgcgcattcctggtgcagcccctctcagtcccgtttgaccagctctgaagctgtcttgtgacttttcccatcgtgggtcacgtgcaccatcagtggattccggcatgaccacggattctggcatgaccacggattctggcatggccatgggttccggcatgaccgtggattccagcatgaccacggattccggcatggccatggattccggcatggccacggattctggcatgaccacggattccggcatgaccatggatgtcagcctctgtgctgaccacgctgcagatgcagggctggacgcctcatctcatttcatgcccaccgccgcctcacgaggccatcctcaagacgacgtcacttgtccacatgacacagccagggagcaggggcttcgaactgctggcctcgctcaggcctgtcgcttctcccacggcccccaccccggggcactggggctctgtcacactgggagacactgagctcagagaaaaagtttaatattttatataacacacgccccccatacactcacatgtgcacaactcacactcatacacactctcacacacaactcacactcacacaactcacacacacccacacatactctgacgctaaccacacaactcacacacacacacactttcactctaacacaactcacaaccacacacactcacaacttacacagcttacagaactcacacaactgacacacaaaacaatcacaagtcagctcacacaaaacacatacatagcttgtacacacaactcagacaaaactcacgctcacacactcattttcacacaaaacacacacaaaaaacatgctcattcacacacaccctcacacacagctcacacaaaaactcataaacactcatagcttatgcacagctcacacacaaaacacgctcattcacactcacgcaaaacacacagctcactgtctacagacactctgtgtatctgttcctttttcatgaatacctgaaaggtgtgtttttgaggcttgttcagcctttttcttcaggacactgccttgacctttcaccttttaatttgcgtttccaacttctgtgctactaccccctctgaagcattaatgggaaggtcagtttcctgcacttctgagtgaagaagcaggagctagctggaaggacttcagagcctggcctttcccttctggctgagcaggaaccaccatggaagtcctgggggaaggaggcagcttgttctcttcccagggactgggtgctgcattggtggtcagtggggaaaatgggccacattgtgaggaaggagggaggacaggaagtgatgtcagtgactcggggtgggagggatcagcactaagtagagactgttgcttaggaggtattagatacgaagtagggactgtgacttaggaagtacttagtatttagcagtacttagaactaagcaaagactgctacttaggaggtagtttgtaattatcattaatagtactttgtactaaacagactgctatttaggaggtacttagtgcttagcagtagttagtactaagtagacactgatacttaggagatatatagtagtgactagtgcttagtacttagcagagactatgactcaggaggtacctagtactaagcagagactacaacttaggaggtacttagtacttagcactaagtagagactactgccaaggagcagagcctgctctctgtgtggatggatctggtttgtaggatgttgcttcttccaaatcaacctttgtgggcttcctgcagctcctggccaactctgaaggtggtatctgtggtggagtttggctgggacagcgttctggggtccacagaaccatctggaaaacacgagtaaccatctctccactgagcatttcttctcatgaaaccagacagatctttttttcctctcactacagtgaccagacttttaaaccacaatgtccaggctgttgtgctcacatgggaatcatttttactagggttgggcaagagaaacaaggtgagaagtgccagtgtgaagcagtgaaatggtctgctcctcttgcattgattaattttgggagagaagactttctttgcctcttttcagctctgagtctggtatatggaaatgaaagctttcctgctttcctgctgtgtctgctctgatcacaggttgaggctgaagtgaaggcgtctgtgctttctagctggaatcttctcactccagcttcctgggttagcttattttgttttctaatcaacctaacattacaccccaaggcactaggaaatgaagaacaaactaagcccaaagttagtggaaggaaggaaataacaatgattagagaagaaacaagtcaaatagcctagaaaaacaataggaaagatcatcaaaattgggagttgttttgttgaaaagacacaaaatggacagatcttcagctagactgagaaatgagagaagactcaaataaatagaatcagaaatgaaagaagaggcgttacaatggataccacagaaacaccaagggtcatgagaccactgtggacatttatacgccaagacattggacaatctggaagaaatggagcccttcctagacacatacaacctaccaagactgaatcatgaagaaacagaaaaacagactgtaacgagtaaggagattgaatcagtaataaaatgtctcagccaaaataatgcccacgaacggatgttttcattgctgaatcctaccagacacttccagaagaactaatacccatcttctcaaactcttccaaaacactgaagaggaggaaacacttccaaacagattttacgaggccatcattaccctgatgccaaagccagacaaacactccagggaaagaagactacaggccagtattcccgacgaacacagatgttttctgaaaggagttgaactttgtgaattccctccctcactcttggccactgattgcaatctttagaggagattctcatcttttgaatctctccactttgcagacacgcttttgatttagaattctctctaattgaaaagaagcggaactaagaggttggagaagtccatgcctaggcaggtggaaagtggagcttgagatagaagactggagatggaaatgaaaataaacgatgggagaggaaggtgcagaggacggggcggggaggaggttgtactggaaactttaggttcagctcctttccctccagggatgaatggttacaggctgggctcttgggctgctaggagccactagcatggctctaccgggtgggtgaacctgccttataggccaagtcagagtcagttaagatttggacaataacagaagcaagcaaacaaggctccacagcaaaagcaaagctagtttagtgaagataaggacccctcggtttgcgactgtgctgtctagaaatatgggcctgagggggtttcagatggcagctttggtagagctgtggtctcccttctccaggaccatatgcactttgtgggaacattcgagccatctgtatcatttccttgacttaaaaaaggtcccaagatgttttcttactcagtgatcatttggggaggacctcagagctgtgattaggagaacggggagctgtagaacgttagctgtaaaatcaatcataagattcaggtaggatatgagaaaacagaacagaacactgcctcctttcctggtatgcccaaaacagggcgtgaacacttcagaaaacaatgtcttcagagctgaatttgggtgtgatgattcgtactttaaagtctgtgtcaggggaagtgaaggatttttttaaaatttaaatttaaattttatttatttattaattctttttttgagatagagtcttactctgtcacccaggctggaatgcagtggtgtgatcttggctcactgcaacctttgcctcctgggttcaagccattctcctgcctcaacctcctgggtagctgggattacaggcacctgccatcatgcccggctaattttgtattttttgtagagatagggttttgccatgttggccaggctggtcttgaactcctaacctcaggtgatcctcccccttggcctcccaaaatgctaggattacaggtgtaagccaccacgcccggccgaaagtgaaggattctaattaaagtccgtcagcaaatatgttatgaaaggaaactatagccgaactggagaaagggaagagtcacctggtaactgaaggaatttctaaaatgggttaaccaagaacactttgatgcttccaccatgaagctggaactggatgctggctggcccaagaccatgatccacgttcacagggggccctgggcctgagggcacctgcccacggggctgccttggggcatctttattcagaagtgggctcctgacatggttcctgggcaccacagcagaggcctctgcctggaaagccaggctcagcttctgcttccacttcctgtccacaaacagtttgatggccttagactgagaattgtatctcaattattcaatgatgtttttcttctttgctgttagcaaaatatgcctccccattgaatcaatattaagatctagcaagggtaaagttcgaaggaagccttttgccattagaaagaccaaacacctgcccaggcacagtggccacacctgtaatcccagcactttgggagtcccaggcaggtgaatcacctgaggtcaggagttcaagaccaacctggccaacatggtgaaaccctgtctctactaaaaatacaaaaattagccgggtgtggtggcacacacctataatcccatctacttgggaggccgaggcaggagaatcacttgaccccaggaggcagtggttgcactgagctgagatcacgctactgcactccagcctgggggacagagtgagagtccatctcgaaagaaaacaaaaacaaaacaaaagcccacacacctggtctttctgctgtggcaggctgtcctggtcgtattcgaggtctggactaatattgggtagtattcttttccttccctatcttcctctgcatttttatttaaaagactaatgtgctagttttatgttcttttggctttctctctctctctctttttttggtatattccccattgttttactgagacctgttaataggagagagaaattaaattatactaagccaacttcctccacacttatcaaaaagataaaaatggccatcctaagaaacaaagacactgcttgttccatcaaataatgcacataagccccaagtgcccgtctgacctgcctggaggttccagtggtatttttctccctctctctcctttaactagtaggagaggcgctggaggccacctcccctcctttcctttatgcttgggattatagctcacttcgccagttcccactcttagtctgtgtattgcccgcaccacaccctcaacgtgtcatctacgttcccttcatccacctgctcagatccgtgattgtttatagcatcctccagtgccccggccaggattagcaaggatttcgtgacccaatgggcgtggaggaagcgtggctttctttcatttcaccaggaaatgactgacgtcttgtcttggcgtgcatccagatgtgggaagtgcagcgttgcttgataacagaatcttattttgtgcagcttcccaggcactgaagcggggctgctgggagaagggcgtgaagtggtgtgacatcatttgatgtgtccttgagctccgagaggagaagcttttgatggtggcgagtgcagtggcaggggccgcagggatgcagacaaagccacgtccccattggtcctgctgctgtgagaatggggaggaaagtgactgcacaccctctggaaccttctgacggccaggggactttgaatagtttgccccacacggcaggagggtgggggccgcgctacggagcgttggcttgtggactgaaacaaagcgccccaggaaagaacaagctccgggataccagctccgggctccttgctggctgcaacttgaacgtggtctgagagtcttggttagagctggaggtcgcgtctgctccaacagagagaactgctgactcttccctgcacagagagacagtgccccaaggggaatagctgacgggttttaccctcctgaggtttctgcaccatcctgctgtttggaaaaggcgcagaggaacatcgaccctctggctggcctcagagaaggccctcggtcctcagggcatggtggtggcccccaccccggggtgatgggggctgtggcaccttgaccgagcaaacaccaggctcgggtggcagctgcctgcctggctttccgctcccctccacggccctcacgagagcctctgaggccagcaccctcttctccattcaggagtctggggagccgcgtggcttagcataggccagcctgtcctgggggcgtcctgggggctgcgtggccttcacacctctgctctcacctctgcccttgtagccaccgtgtcagggtccctggttttgtctcccttcatggggccttgttgctccagacttgcaggggagtcctccttgctgtacctaccaggacctggtctgcccctcaggactgaatccgtcggtccctggaatcctgctgagctgtcatgacctagagccagtcccaggtcccaggagcctctgtccgtgtggagctgcgacccgtgcttcctgggcacccacttcttaataacatgacctgggaagttcccgtttaagacaaggaaagtaaagcatcctggagcaatggttaacaagacctgaatctaaaataaaataagttccaacaaacatgatgttttgggtgatacagaaaccgtgaatgtggctggattaagagggacagtggctgagggcggaagaaaggtttctgatgagcggcagagaccagaagccttgctgtggcttccttccttcctgtgccccgcgtctcgcctgctgtgcttttggtgccacccacaccccccgctttattttatagtaactggcaggacctgcttggcccagggcaggagggaggggaggacggtttcctgatctgcgatggccatcaggtgtgctgggctcctctccaggcccagctgtagggagggatgccccccagagctgagcttttcccctgtggaccctctggcctttcctcccagccaagcccagggcgtccttttccaatcagagccggacacgggcgtgacttagcgacttagccgccccgagaggcaggacggggcggacgttcccagcaggaggccgcggctgcactgtggagattgtgtgtgtgccccagccctgccggaacagctggcctccagggacgtcgggagcagccagcacaggtgtggccacagaaatcacagacacttgtgtcctgtgtgtatctccatggcagccgccgggctgcgggcaactcctgcaggctctgtgctgagctcagcgtgagggaagggtgtccttcgtgcactcccatgtaagcgctgtgtctgccggggggtgttcagaaagagggggagcaggaaacgagaagccagcatcagtgcaatggcagcatgggtggcggcgaagtggcagagtgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcgaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccattcaactctgagttgacacagcacatgtttcagagagcacggggttgggggtaaggttatagattaacagaatctcaaggcagaagaatttttcttagtacataacaaaatggagtctcctatgtctacttctttctacacagacacagtaacaatctgatctctcttgcttttccccacagcagagtggtcgggcagggacaggttctacctggtaacagagtggctgggtggggacgggttccaccaggtaactgggtgaccaggcggggacaggttgcaccgggtaactgggtaactggggggccaggcagggacaggttccactggccctgtggggagtcccactgagtgccatcacgtcttcacggcggctccatgaagacatacttgaggcatctcgaggctcacagctggtgcatgtcagactgggatcagactgtgtgcccccaccccacagacgccagggcagaccccaccttcgggcagctttgcttgaggttctgagggcccagggcccaggcagccttacccacccctcaacgtttgtctggtgtggcttctgaatgagcacggtggctagaggggtggcctgcgtgaagtttttccttcatgccccaagggagcacaagcggccctacctagatctgaggaggagaagggagaggagaagctggggctcctctgaagacattgcctgcctgtgtggcaggcaccacgtagcaatgtcagcagcatcttcatttagccaagcgtttccaccccatcccctaacgtaccgtaaggggctctgtttgcgatgaccagagatgacggccagcaatggcaaggacgatggtgatggtgcctgggatctactcacagctcacccagccccttcaacaacgctgtgggctctgcactgtcgtccttgggggagttctgggattctccttcttcagtcaccctgcagtttcccccacgacgtctccgtgtcctagaatgctaagcagcccgtaatggtggttttgggaggtgtggtcacaccggctgcttcctgcttgttgtggaggtgccgagtgtagaaaaatgggctctctagaaagcttttctatattgatacagaatcgatgtacatattttcagggtacatgtgataatttaataccattgtataatttgtaaagatcaaatcagggtgattgggatcttcacctaaaatattcatcttttctttgtgccaggaacagtcaagctgttctcttttggctaatttgaaacatacatacattattgttaactctagtcaccctgttgatctatcaaacactaggttttatttcttctgtctatttgtagccattagtcaatgtctctccttccttcctcccagctccccttcccatcctctggtaaccaccaatctcaacggaggcaccctcatgagatccatttgttagctcccacatatgagtgagaacatgcagtatttgtctttctatgtttggcttatttcacttcacataatgacttccagtttcccatgttggtgcctatgacaggcttgcacccttttttatggcagaatactattccattgtgtatatattctgcattttctatatccattcatccattgatggacacttaggtcgactccatatttttgctattgtgactagtcctgcaataaacacaggcatgcagatatctctttgatatattgatttcctttcttttggatacaaacccggtagtggaatttctggatcatatgttagttctagtttcacttttttctgagcaacctccatactattctctatagtggctgcgctaatttacattcccacccacagtgtccgagggctcctctccacatccgtgccagccatttgttattttctgtcttttcaataagagccattttgggccaggcccggtggctcatgcctgtaatcccatcactttgggaggctgaggcaggcagatcatgaggtcaggagatcgagaccagcctggccaacatggtgaaaccccgtctctactaaaaatacaaaaaattagccgggtgtggtggcaggtgcctgtaatcccagctactcgggaggctgaggcaggagaatcgcttgaatccaggaggtggaggttgcagtgagcggagattgtgccattgcactccagcctgggagacagagcaagactccgtctcaaaagaaaaaaaaagccattttaacgggagtgggatgatatctcattgtgattttgatttgtatttctctgatgactatatctgttggccatttgtaagtttttatttgatgactatatctgtttaccacctatatgtttttatttgatgactatacctgttggccatttgtatgtttttatttgatgactatacctgttggccatttgtatgtttttatttgatgactatatctgttttaccatttgtatgtttttatttgatgactatatctgttggccatttgtatgtttttatttgatgactatatctgtttaccatttgtgtgtttttatttgatgactatatctgttggccatttgtgtgtttttatttgatgactatatctgtttgccatttgtatgtttttatttgatgactgtacctgttggccatttatatgtttttatttgaaaaatgtctattcagatcttttgcccatttttaaattagaggtttgttttttttttgctgttgagtgttttgagctctttatatattctggttattaatcccttgtcagatggatcgtttacatatattttctccattctgtgggttgtttcttcacttttttgtttcctttgctgtgcagaagccttttagcttgatgtgatctcattttatctttatttgctttggttatctgtgcttttgaggccttaccaaaaaaatctttgccctgatcaatgtcctggagtgtttccttagtgttttcttttagcggtttcatagtttcgggtcttatatttaagcctttaatccattttgattcgatttttgtatatggtgagacataggagtcttgtttcattcttctgtgtatggaaatccagttttctcagcaacatttattgaagagattgtcctttccccaatatctgctcttggtgcctttgtgaaaaatgagttggttataaacgtgtgaatttatacctggattctctattctgttccattggtctgtgtgtctgtttttatgccagtactatgcttatttggatactatagctttgaagcatatttcgaagtcaggtcatatgagacctccatgtttgttatttttgctcaggattgctttgggtatttggggtcttttgtgagcttatgtaaattttagagatttttctttctgtgaagagtgtcattggcattttgatagggactacactgatgtctacagccatgcccaccctgaacaagccccatctcatctaatagggactgcattgaatctgtcaattgctttgggtagtatcgacattttaacagtattagttatttggatacatgagcatggaatatctttccagttttttgtgtcgtcttcaattgttttcttcagtgttgtatcgttttccttgtatagatcttttacttctttggttaaattaatttctaggtatcttatattatgtttagctattggaaatagggttactttattgttttttagattgtttgctgttggcatatataaatgctgctgatttttgtatgttgattttgtatcctgcaactttactgaatttgtcagttctgacagtgttttgaagtctttggtgttttataaatatgataagatcatgatgtctgcaaataaggctaatttgactttttcctttccaatttgggtgcctgtatttctttctcttgcctaattgctgtggtcaggacttcagtgctatgttgtataaaaatggtgaaagtgaacatccttgtcttgctccaaatgttagagaaaaggctttcagtgtttccccattcattatggtgttagctgtggatttgtcatatatagcgtttattattttgaggtatgttctttctatacccattttgatgagtgttttatcataaagggatgttgaattttatcaaatgcttttttagcatctattgaaatgatcatgtagttttgttcttaattctgttaatgtgatgtattatgtttattgatatgcatattttgaatcgtcattgtatccctgggatgaatcccactcgatcatgttgaatgatctttttaatgtgttcttgaattcagtttgctaatattttgttgaagatttttgtgtctatgcctatagtcctcctttttttttgtcttgtcttttcagcttttggtttcagggtaacactgacctcatagaatgagtttggaggtattccctcctcttcaattttttgaagagtttgagtagaattggtattatttcttcaaatgtttggtagaattcatcagtgaaggcatcaggtcctgggcttttctttgatggtaaatttttttattatggctttgatctaattacttgttattggtttgttgaagttttctatttcttcatggttcaatcttggtagtgtccaggaatgtacctatttcttctaggttttcccatttcttagcatgcagttgtttataattgtctctaatgatcctttttattcctgtgatctgagttgttacatctcctttttcatttctgactttatttatttggatcttctttccttttttcttagtctagctaaaggtttgtcaattttgtttaccttttcaaaaaactttttgttttattgatttttctgtatattttatcttaatttcatttatttctgctctgatttgtattatttctttccttctactcattttaggtttggcttgttcttgctttccttggtccttgaggtgcatggttaggttgtttatttgaagtctttctatgtttttgatgtaggcatttattattatacacttgcctcttagtattgcttttattgtatcccatagattgtagtatatttcaattttcatttgtttcaagacatttttaaatttccttcttaacttcttcattgactcattggccatttagaaggaggtttaattcccatgtgtttatgtagtttctggggttcttcttgttattgatttctagttttagtctatggtggtcagaaaagatacttgatatgatttctgctgctttgaatttgttgagacttgttttgtggcctaagatgtggtgtattctggagagtgcttcatgctctgatgaaaagaatgggtattctgtagcagtcgggtgaaatgatataaatgtcagtcaagcctatttggtgtagtgtatagtttaactctaaagtttctttgttgatttcttgcctgaatgatctgtccattactgagaatggggtgttgaagtgccctgccattattgtattgcgggctatctcttcctttggatctattaatgtctgttttatatacttcagtgttccattgttgggtgcatatatatttataattttatatcctcttgctgattgacccttttatcactatatagtgatgttctttgttgctttttgcagtctttgacttgcagtctattttatctgatataagcacagccgcttctgcccatttttggtttccacttgcatggaatatcttttttgttgtttctgagacagggtcacattctcttatctcagctgagtgcagtggtgtgatcatggctcactgcaggcttgaccttccatgctcaagtgatcctcccacctcagcatcccaagtagctgagaccacaggcacatgccaccatgcccggctaatttttgatttttttatagagatggagtctcactgtattgcccaggctggccttgaactcccagacacaagcaattctctcaacttggcctgtcaaagtgctgagattacaggtgtgagcctctgtgcccagcctgaaatatatttttctattcctttcagtcaatgtccatctttatagatatggctggtttattgtgggcagcttatagttgggtcttaattctttatccatacagccattctatatcttttaattggagaattgagtacatttaaattcaatgttattattgatgagtaaggactgactactgctatttnnnnnnnnnnnnnnnnnnnntcttgttgccttgcttgctttctgtcttactttgtggtaaagtgattttctctgctagtatgttttaattcattgctttttatttttagtgcatgtgttacagtttttttttattgtagttgccatgagacttataaaaaacaacttaaacatataacaagttatcttaaagagataactgagatcacaaaagaatagaaacaaagaaaaaaatgaaaaaaaacccctctgtattttaagtccatccccccacactttgacttcctattgtctcaatctacatatttgtatgctgcctatctcttaataggttgctgcagctattattgtttttgacagatttgtcttttgggcttcattctacggttatgagtggattgcaccccacaattacagtattggagtattctgggttagtttgagtgcttacttttaccggtgtgttttataccttcaaatattttctttttgcatgttacttttttttctttcagactgaagaactctctttagcatgatttgtaacacaggactagtagtggtgaattatctcagcttttgtttgtatgggtaagactttatctctcctttatagttgaaggaatgctttgctggatatagtattcttgggtgacaggtttttcatttttttctccttccagcactttgcaaatgtcatcctactctctcctggcctgtatggtttctgttgagtagttggttgccagacaaatgagagctgctttaaatattccttgcttcttttctcttgctgcttttaggatctctctttgtccttgacttttgagagtttgattattatatgccttacagtagtcttatttgggtcaaatctgtttggtgttctctgaccttcctgtacctagatgtttatgtctttctcaagttttgagaagttttctgttattgtttctttgagtaagctttctaccccttgttcttgctcagcttccccttgaacatcaatcattcttatatttgatgttttgaggtaattttctgtcttgcaagtggtcttcatccctcttcattctttgttctttttccatccctgattgtgtattttcaaatagcctgtctttgagctcactgattccttcctctgcttgatccattctgcttttgagaggctataatgaatttttcagttcagcaaatgtatttctcagttccaagatttctgtttgaatttttaaaaattgtttcaatctctttgttaaatttctgaattgcttttctgtgttatcttggaaatcactgagtttccttaaaactgctattttgaattcttggtccgagaactcacatattgccatcttattagggccaatcgctagttccttactttgtccatttgagaaggccatggtttcccatttgctgctgtttcttgttgatgtgtgtctgtgtccttgcactgaaggattatttatttactccagtcttgtctcctggcttgttttagtttttattggatacatttgcttagagagtcacataatttacctgtggaatttctttttctcccccttctaggtccctgtctccttttcggcactagatggcaccttaagcccaggtttaccttggctctggttaaagatctgagtgctgcctgtactgaaggttaaagatctgagtgctgcctgtactgaatgggagaggtctcaaaggggatatgccagcagtgtgagaaggctggctggggcctcgtgctgaggggacctgtggagcattcctgctacagggtggtgctgtgagcagccactctgatggagtgcctctttgaccgagttgcagagtagagtttgtggggctggggactatagtcccacctcccccttttatctctggctgtcctcagggatgtttcccttcacacatttgcagcgcttcccatgggttgaagcaggaacaggtctccagccagggcccccaagaggttggagaagctgattgtccacctcaccctcactttttccagcatagaagctatgagttgaggggaaatttcccatactcttgatgccaaacagattatgaggagggatggtgcagacatggtggtctgatgcttttgctgtctgcttggggtgttttcaattttctgtgttcctgggaactgtctccttttgtatttgagtgtgtggccattgctgggattgtgtcagtgctgtgtgtgtttttgcttctctgtggagcagagtgaagtcaccttgcttctactgcaccaccattttgggaccagaagtccctcctagtagaaatttccaacaggtgtagtggaatatgaaatgtatctggagaaaatattttcttttcaaaaatttcaccttggaaagcttctgatgttgctcagaaaagtttaaaattcttctttgggatcttccttcagtaacctggtagagggcgatctctgaacattctcagtaatggtgactcttctttttgaaggcagatgcatgaggatgtggcataaagttagttgataccaggtgggataaataagttatttgcatcccagtcattgactaagttgattgtcacactgttttcaatgtaaaagtgaagtgtgaacatataacaacaagactgatttattgtctggtttctaaactgtctttgtaaatgtgttccaaagagacataaaatatcaccaacaatgctaccacctttgaatacgcatagagctttttaatgtcttgaatgtataggttccatttctatttgatatacatgtaaagccttaactactttatagaaatgctttgcatttttccagggattgtgaaaatgtgagttaaaaccatgtcaaggagtctgtgctggccctgaccaggcctgggacaggcacccccactgtgcacagttgagcagcccaggaatggaactatgaccctgtcttctctgattgggaaggagagcccacctgatccctttaattgacttcacgtcatcttcttaaggagtgtttcctctcagttcacaaagcctacaggcttcctgcatgggatcatccttcacactctgctcaccagccctttccttgctgatgcgagggcaagctgcacattcatcttccgtaaagagcattttgagcatgagtttactgctgattagagtgccactgtatttttttatatagtcgtgaattctactcataaaatctagatcctgcaatgtgctgaccaccgcctttccccgacacttcttcctcgccacctggggtcttcccgtcacacgtcaggggctcctcctcagccccatttcaaccctgaccacgttcatattttgaaatcagcctctcatttacagctttcctgtaggcaaaataaaatgctaatagatttcatttctgattcttatcactctgatttatctctcagtattaccgcgtttgaaatgaataccgcctctctctcacccttgaagctctctcttctcctggctcctgagcacatgaccttgggctgtctgtctttattgtcgattttgctcctctgctcagcacctcttttttattgtttttctcctaaaacagatggaggatctatcccatcctctttactttgacagattttctactgttccattttctcacaccttctcccaactgacctccctcctcccatttatccacgcacagtgcactctctgatgagtagctctgaggcctccattcgtcctgtgacccagggtcctctcctggagctggtgccactggagcctagcttggcagtcagtcatcttcagcttcacccccaaacctttgcatctctgttcctcagcctggctccctcctccctccaaacagcctgtcgcctggatccagtgtgtttgaaactgcaagccacagcccattaatgaccctgagagagttttagggtgttgcagccagaaattttaaaaagtgagacagaagagaataaatatgatataataggacacagtgatacgtgagaggctcccacgcgattagggtaagtgctgtgttgtgggacttccccaggtctcacttcaagatgcatatcttactcttggataccaccggaaaaaaaaaaaaaaaaaagggaagcgctgtcttcgttcctcatatgcagcgtgcaccttggtttctgtccttgctatgcccttgcctgcttaagtgttgacgtgttgcatgcaagccgggaccaccatgcacgctgccaccacttgctctgccgcctccgtttccctctcagcagtctgtccctggcattctccacctgcccctcccacggggatctcctctgccacacagttcagcctgcagaagaaacaaacgtcgtccccacccacaaacctggtgtgttcccagccttccttctttgtgatttcctcttccccagtgacctagccaacctctcttgcagttaaccttgacaccttgttctcctttaatcctgcatatactgattatttttaccaattctgcttctcaaactatccacactagtgttctctgagtttacaaccttatcatctctctaatgaaccgtttttgtaactcttattgaatgccttcccttctccctattatctttaattcattattcacaaatcctgaggattaaaataggaaggacttagaatagtgctggctcatagttaaggctcagcaaatagaaactgctatgtatctttaaatttttaattttaatattgttacttttatcctccttctgggacacagttggatgatatttctgtccgatgcagagcttttactgctccccactgtgcacagatgcaccggtgcttcctgatgtagctttgacgtcctcctgtgactatgcaactcccctccctctgttcctgcactgcccccacctccctccccatgtcatacaccatcccctgagtgcaccactcagtgccacagccccaagtcccttcccatgctactccgttatcttagagttcctcccctaatccatccccacctgttagaattctatttatctttccagtcttagttcaaataccacttgtttctatgaaactttcttaactttccaacacaaattcacctcttcatttctctattcccttagcagtttgctcataactttattatataatgattgcactccaacttggatcttagctaattacgtacctgcattccacactagactgcaaacttgaggaagatgggtgctgtggctgccctcaaaccgtatgtgcctcccataggacacaagagttggttatgcaggtgttgtctagatgaaattatatagcatctatccttcttgaattggctttttgcctcagcacagttccggggagattcagcgaggctgtggtgtgtactaatcgttctttccttcataaccaagtggtgctccgtggtgcagaggtgctgcatggtaaccatccacctgctgagggactcggtggttcccagtttggggctattctaaataaaactggtgaacattcatacacaagattttgtttgaacataagtcttcatttctttgggatgaatggtcaggggttcaatttttgtgtcttatgataagtatatgtttagtttttaaaggaactctcaaaccattttccagaacaaaatttgacattcacagtaaaaaagaaaaaaaaaagtaacagtgatacagtttttctgaatccaaatcctttccagcatttgatgttgtccctattttttattttagcctttctgataggtgtgtggtggcatctcattgtgggtgtaattgacatttccctgatgagatgatggtcagcatctcttcgtgtggttatttgccatcagtagatcctctttgtcgaaatgtcttttcatctctcaccctttttctaattgaatgtttttaatgtttagttttgagagttctgtgtatattcctgatactagtcctttgtcagatacgtggtttgccaatatttctccaactctgcgctcattgtttcagctcttaagagggcctttccacagagcaaaagtttttaattttgatgaaggccaatttgtcaatttttctttttatggaagatgtttgatgtcaagtctaagaactttttgcctagctctagcttccaaagattttctgttgtttttttctaaaagttttatagttttgcatttttacatttatgtccatgagttgcttttgtgtagactgtgaagcttacatagaggttcctgtttttgcctgtggatgtccaatcactccaggaccatttgttgaaaaggcaaattttcctaccattaaattgtttatgcatctttgtcaaaaataacttggacatatttttatggatctatttctgggttttctattctattgtattatttgtatctgttcatcagtactacacagtcttgattattgtacctatataagacttgaaattatatatgatcactccttccactttatttttattttcccaaattgttttagctactctagttcctttgctcttccatataacttgcttttctgtatctacaaagtatttccctgggattttttataggaattatgtgaaacctctgtatcaatctggggagagttgacatcattattatgttgaatcttctgatctaccaacatggtatgtctgtcatttattttgatctttggtttctttcatcaccattgtttgtgtttcagcacataggtcctgtacgtggtttgttaaatttacacctaggtattctttgagtggttttaaatagtattttaatttcagttttcatgccttcattgttagtatatagtacaagaacttattaggtttgagaggtttttatattttttgtagagtccttggggctttctgtgtagataatcaggaaataggacataggtacagtttaatttcttcctttgtgtctgcatatcttttattttttttttatcttgccctattgcactggctggaacttccagctttatgttgaataagattggtgagagcaaacatccttgctttgttcctagtcttcagtgaaagcttttgatggttactcaccattaagtacagtgaaatgtggggttttgtagatgtttattgttagcttgataaagtgccccttgatttctatttttctgaaagttttcttcatgaatgagtgttgaattttttaaatgtcttttctgcatcgattgctgtaatcatgtgatttttttcttctttagcctattaatatggtggattacattgatttgttttgaaatagtgaaccagcctttcattcctggaataaacctcatgatgtatcattattttcatatattgctggattttatttgctaatattttgtaaaggatttttgtgtctacatttgtgagggattttggtctgtaggtttctttttactgtctttgtttgcttttggtatcgggttaatattagctacataaaataaattgggaactgtttcctcgccttctattttctggaagatatttatggaatttgttttaattcctctttaaatgtttggtataattctttggtgaaaccatctgggcctgattatttctttctgggtagatatttaattattaattcaagttccttaatagtgtagaagtattcaaattattgatttcacattggatgaattgaggtaacttgtggatttcaaggagtcgatccatttcatctatgttgtcaggtttatgtgtgtagagttgtttattccctgattatccttttgatgtttgcagagtctgtagtgacttcccctgtttctttgcttatattgataatttgtgtcttctctcttgttttttgttagtcttgatagagatttgtcaattttactgatttttttcaaggaaccagctttcattgtcatttatcttctctatttttttctcacttaaattacattgatttcttttcttatccttattatttattttcttctactttatttgggtttattgtgttctcctttattacagattcttaaagaattcagattattgatttgagactttctcttttatttttcttttgacttttgttttcggtttgagggtacatatgcatgggtgaattgtgtgttgttacagtttggtgtgataacaatcctgccacccaggtagtgaacctagtcccttatagcttttcaacccacgtcttcctcccaccctctgccttttgtagtcctcggcgtctgtcatcctcatttttgtgtctgtgtgtactccgtgtttagtttccacttataagtgagaacacgcagtatttggttttctgttcctatattaatttgattaggatgatggcctacagctgcatctatgttgctgcaaaggacatgatttcattatttttatggctgtgtagtattccatggtgtatgtgtaccgtattttctttttccagtccatcatcagtgggtatctaggttgattccatgtctttgctattgtgaataataccgtgatgaatgtacaggtgcttgtgtctttttggtaggatgatttattttcctttggctatatgcccatactgggattgctgggtcgaatggtagttctgtgttaagttctctgagaaatttccaaactgctttctacaccagctgaactactttacattcccaccagcagtgtataagcattccctgttctctgcaaccttgtcaacatctgttattttttgactttttaaaaatattcattctggctcatgtgaaatagtatctcattttggttttggtttgcatttctctgatgattactaatgatgaacatttttcctacgtttcttggccgcttctatgtcttcttttaagaagtgtctgttcatgtctcctacccattttttaatggggctgcttttttcttgttgaataatttaagttccttacagattctggatattaaatttcttttggatgctgatatggtttggctgtgtccccacccacatctcatcttgaattgtagcttccataatttccacgtcttgtgggaggggacctggtaggagataattgactcatggggcagtttcccccatattattctcatgttagtgaataagtctcatgagatctgatggatccgaaggaaaccctttccgcttggcattcattctctcttttgcctgctgccatgtaagacgtgcttttcaccttccatcatgattgtgaggcctccccagccacatggaactgtgggtccattaaacctcttgctcttttagtttacccagtctcaagtgtgtctttatcagcagtgtgaaaatggactaatgcagatgcatagtttgcaaatattttttcctaccctataggttgtctatttacctgttaatagttgcttttgttgttcagaagcgctttggtttaattaggtccctcttgtctttttttttttcttgcagttgcttttggagatgtcatcattaaatctttgctaaggcctgtgtccagagtggtgtgtcctacattttcttctagggtttttatggttttaggtcttacatttaaatctttaagccatcttaaattgatttttgtatatggtaaaaggaaggagtcaagtttcaatcttctgcatacggctaaccagctatcctagcaccatttattgaatagggagtcctttctccatttcttgtttttgttgactttgttgaagatcagatgtttgtaggtgtgtggctttatttctggtttctctaacctgttccattggtctatgtgtctgtttttgtaccagtaccatgctgttttggttactatggccttatagtatattttgaagtcaggtagtgtgattcctccagctttgttctttttgcttagggttgctttggctattcagcctttttttttttttggatccatatgaattttataattcttttttttttctaattctgtgaaaaatgatgctggtggtttgataggaatagcattgagtctgtaaattgctttgggtaatgtcaccattttaacaatattgattcttcctatccatgagcgtggaatgttgttccatttgtttgtattatctctgcagtgttttttaattcttgtagagatctttcactttcttggttagctataaccttaggtattttattctttttgtacatgttgtaaatgggattgcattcttgatttggatttcagcttggaaattattgatgtgtagaaatgatattagttttttagtttttgttttggtttgctaagggtaagtgaattgtatgctactggtttttatacattgatatttttttcctgaaactttactgaagtcatttattagttctagaagtcttttggcagagtttttaggggtttctatgtatagtatatcatctatgaagagagataatttgacttcctcttttcctatttggataccttttatttctttcccttgcctgactgctctggctaggaattccaatactatgttgaataggagtgatgagagtgggcattttgtttcattccagttctcacaggaaatgcttccaacttttgcctgttcaatatgatgttgcctttgggtttgtaattgatggatcttattattttgaggcatattccttttatctttgtcctttgatgcctaatttgttgaaggtttttaacatgaagggatgttgaattttattgaaagcccttcctgtatctattaagatgatcatatggtttctgttttcaattctgtttagtgtcatagaatgatttagggaggagttcctactttttggttttttgaagtaattttagtaggattgttactagctctgctttctatgtctggtagaattcagctgtgaatttgtctggttccgggcttttttggttggtaggttttttttttattagcaattcaattttgaaagtcattattcatctgttcaggatttgaatttcttcctggttcaatattgcaaggttgtatgtttctgggaatttatttatttcttcaaggtgttctagaagaaatggaaaaaacccagaaaacctaaaaggttttcttgtaatatcaccgttgtcatttcttattgtgcttatttaggtcttctatttttgttaatctagctagtggtctaccaatcttatttattatttcaaaaaatgaactttcttttgtttgtgtttttgtgtcccaatttcattcagttctgctctgattttgattttttcttttcttctgctagctttgggattggtttgttctttttttttctagttcttccaggtgtaatgttatgttgttaatttgagatctttctaactttatgatgtagttgtttagtgttataaactttccttttaacactgctttagttgtgtcccaaatattctggtatgttgtgtcacagttttcattagtttcaaataattttttgatttctgcattaatttcattctttacccaaaagtcatctaggagcaaaatgtttaattttgatgtaactggatagttttgagagatcttcttgttttttatttgtatttatattacatgtgggccaagagagtggttggtatgatttcaattttctttggatttttttgagacttgctttatggcatgtggctgatcttagagtatgtgtcatgtgcagataagaagaatatatattctgttgttgttgggtagtctgtagacatctagaagacccagttgatcaagggttgagtttgagtccagaatatctttgttttctgcctctatgatctgtctaatgctgtcaaatgggatattgaaatctccccctattattgtgtttatgtctctttataggtctctaagaacttgttttatgaatctgggtgccccaatgttgggtgcataaatatttagggtagttaagtcttcttgttgaattgaaccctttttcattatgtaaagcccctctttgttctttttgatcattgctggtttaaaatctgcttcatctgatataagaatagcaacctctgctctttgttgttttccacttacaagatagatctttctccatccctttactttgagccaaagtgtgtcattacatgtgagatgggttcttgaagacagcagacagttgggtcttgcctctttatccaacttgtcaatctatgccttttaagtgggtgtttagcctgtttacattcaaggttaatattgatatgtaaggatttaatcctgtcatttgtgttgttagctggttttcatgtaaacttgattgtatagttgctttatagtgcaagtgagctacgtatttgtgtttttgtggaggcaggtatctttcttgtttccatgtttagcactcccttaaggacctttgtaaagcgggtctaatgatagtgaatttctttagtgttcacttgtctaaaaatgattttatttcttctttgcttatgatgcttagttttgtgggatatgaaatccttgattggaattttttttctttaaggatgctgaaaatagggcccccagtctcttctggcttgtaagcttttttctgacatgtctgctatcagcctggtgggttctctttgtaactgacctgccctttctctatagctgcttttaagagtttttctttcacaacaaccttggagaatctgatgaccatatgccttggggatggtcatcttatatagtatctcacaggggttttctgaattccttgaatatcatgtcaacctctagtgagattgggaaaattttcatggactgtatcctcaactatgttttccaagttgcttactctctctccttctctttcagaaatgccagtgagtcatagttttggtcactttacataatcccatacttttcagaggttttattcattttttaacactcttttttctttatttttgtctgcctgtgttgatttgaaagaactgcctttaagctctaaaattcttctctcagcttggtctcttctgatgttaatgcttccaattttattatgaaattcttatattgaattttaaatttcagaagttcagtttggttattcttaaaatggctatgttgtctttcaactctcaaatcatttccttggattgagtttcaactttctcctgtatctcattgagcttccttgccatctagactctgaatcctatgtctgtcatttcagtcatttcagtttgattaagaaccattgctgggtagctagtgtgttcatttgtaggtaaaaagacactctggcttttagaactgccagagttcttgtgctgttttctcatctgtgagtgctgatgttcttttatccttttgaagttgctgtcctggggatagggctttttgtttttatgttcgttatttctcataagagttttgctgttgtgtaagttggatatagttgattggctttgtttctgaattttttcatagggccgaggttcagcttggaactcctgggctgtatgctctaaccctggtgacctgggaccaggcctgtggctttgtcctctggccccttgagctttagtaccagcttcactgggaggtcaaggtgcagctaggctgctggtgaaagcactctatcaggggccaccagctaaactgccccattggtggttgctggcaaaagtgccctggcagggtgggtgggggccactggcaaaagtgctccagtagggccctcttttttaatgtaagcatttagtgctaaaaatttcacttagcacagttttaactgtatgtgccatgaattttgatatgttgtgcttttattttaattacatgtaatgtattatcttctctttgacccatggattattttataacatgttgttatatttccccattatctttctgttattgatttctaccttgactatattgtggtcagagaacacactctgaatgattataattttgctgaagtttgttttatggcccagcattaagtctatcatggtttgtgttctatgagcaattgaaaagaacatatactctgctcttgttgggtacagtgttccataaatgttcattagatcctgttgattaatggtattgttgagttcttttctatctttgttgattttttgtttagttgctctatctatataattcatatataggattgctgtatcttcttagtgggttgacctatttataactctgtaattcccttctctgtagccattttctttactctaaatgttaacttatctgatattaatatagctattgcttccatcctttgattaatacttacatgatatatttttaaaaatatttttactttcaaccatcctatatcattttattcaaagtgagcttcatatagtgtatagttgagtctttttttaaaaaaaacccactcagccagtgttttcattgtcatatttagcccatttacatttaatgtaattattaacatgttaggatttaaaactcatttaattttgtattttctacttgttcttgtattttttgtttctttgtttcttcctcccttcctttgagttactttaatgattttggaaatccactttatctatgtttttgagtgtatgtctttgatagctttcttttatttattgttctagatataatattcatatacatattcataacattaaagtttactggtgtcataattttaccagtttgggtgaaatatagaaactttaccttcctttatgacattttacttatgcccctcatttatattataattgtttaaatatttcctctatgtgcatttaaaatgacataagacagtagtatggtgtttaattgaactgtcaagcataaaactcaaggaatgcttattgtacttactcaggttgttgcttgccatgttcttgcattcttcctgatgctccaaaattcctttttttatatttctcttctatatggagacataaatttagtaattctttcagagttggtctggtgaaaaacacaattttcctttttctggggatatctttatttccccctgattcctgaaggataacttcactgggtatctggattgatagacttgtgggattctgggttgacatatttttctttcagcacttgaaaaatgtgctgtttccttgtggcctccattgtttctgataagaaatcccctgtcatttgaattgtgttttccttgtaggtaagttgtcatttttctctggctgctgttaagatttttctttgtaagttttcagaaacttaattattatgtgtcttggaggagatttgggtttaccctgtttggggtatgcttagcttcttaaagttttaggttcatgtttcttccaaaattgagaagttttcagccattatttttctgagtaccttttcagacctgtcatcttgtcttctttcactcctctttttgaaactctgatagcatgaatattatatctttggttatagccccgcagttgctgaagctttatcatgtttttctactattttctctgtgttgttgacattgagtaattcctactgttttatcctcacttcactgattctttcctctgtctctccatccttctgttatgtgcatccactgcgttgtttattttggttattgtatctttcagtaataatatttcaatttggcttttatttacatcatctattttctgagacatcctactttttcatttgtttcaagtgtgttcataattgctcattgaagcatttttatcgtaactggtttaaaatctttctcaggcaattttaacatctcggtcatctcagtgttggtttctgtggattgtctcttttctatttattttgtgatcttctttgttctttgtataaccagttattttcttttgaaatctggacatttttgtattatgtcatgattctggatctcatttaaaccttgcattttaactgtctctttttggacactcctcttctgggggtaaggggtggtggtggtgattccttgtaactgacagggagatggaagtctagattccccaggaggcctctgttgatacctgaaggtggggtctttttactgattggttagggagaggggtgggagtttcaacttcccagatggtctctgctggcactgcaggggttgtggtaattacaacccaatggagatgaaagttctggatccctacttggccttctctgacactacctggtaggcctgaggggaggccttattacagcctcatgaaagaggaagtctagatccccatttggcctttgttggcatgggtagggagaggctgtacttttttctgtggtgttttgctggggtagagctgttaatatctaatatttttctgtcttgctgagttgattctttcctgactccttgattagagagaggctgctttagttgtgtgtgtgtgtgtgtgtgtgtgtgtgtgtgtgtacacgctggtgtttccggattgcggcctctttgactccaagtctgaggtacctgaggcaaaaagaaaacccagggaatccaccaccatgtccttctctgctctgccttcgtattgccatccttcagagtcttatgcttgttttacgtatgctcagagattttagttgtacttagtgggaagacgtatgtcatctctgggagtggattccttcttcccagggttatattttctccaagatatgccacggacagaagttcataggagatgcttaaactcccatacctctgcattgttttgtttgttttttatatctaagagcacagtttcttctgacttccgggaaggctgagatggctgggctaaggtatacagggtcctctcagactgcccagtacagatgattctgagtagttgaccaactgttgttctggaagaactgagcctttatcatagatcccaaagttgacataactcagacttatatgatttttagataaaaatttttaaattttagttatttaaattttataaatgatatttttcatgaaaagttctttttgtgccattgattttctgtttcctgataaatattaatattaagagaatcccttttaggaatggcgtggttaaaatatccttatttctaaatccacaataatagatattatactaacattgcaaatgtgctttcagttgagtatactcccaagaatggatcagaaatagctatataaacaaaagtacatttcatagtgggtgtttttaagttgctttggcaaatgggatagacttgattattattaagtacatttaatcttaaattggatagtagtgagtgtggggcctgttttctgcagcgacctatactctaagtgatatattccaactagagcagcttagagtaagttggaggccatcctaatggtgaattttcctatcattcttcacttcaggtaatgccatttaggcttttgagatttagaaatatgacaattgctttaatttgccgtctataacatttaaaaaatctagatttgcatgtgaaaaaaatatttgtgtgttcatgaagatagcttatatttactgagctcttttaattccatccagaatatgtggttctcatcatgttctggacttcctacgccacacacacacacacacacacacacacacacacacacacacacacaagcacagagccatcctgatttgaagattttggtaatgtgtttttgtacagggcataaaaatatatctctgtaattacatgatatttagtgattagataattatggataattgcatggggtagttctaagtgctaaagtgttaccataagatctaacatgtacaaattgcataataattattcttgagagttatttggtaattttgagcataattatcatgtgatccacagtgcatgtaattaatgcataatcacatggattttgccttcataactacttcacccttgttataaagctctttgtcataacatttgagtataaatataatgtaattggctcccggatacagtacattaagccccatgataattgctttcacagtaacaataccccttattccattccaattgctgtcttttaagattttgttaggaagaacaaaatacctaagatatggtggcgggcaggtagaggagtgggtgagtggcgggtactatgtgcttattgtggatgaggagtatctttgctgtgaccacaatatttccatgtagatggaagatgtttccatctttcatagtagataaaaatctgtcttctaactaaacttgtatttggtgtaaggctccttgctgtctagccatagtcagcacccattaagtctatttttttaatttttaatttttgtgggtacacaggtgtatatatttatggggtacatgggatattttgatacaggcatacaatgcataataatcacgtcagggtaaatgggatgttcatcacctgaagtatttatcctttcattgtgttacaaataatccagttatactcttagttatttgtaaatgtacaataaattattgttgactgtagttaccctgttgtgctatcaagtaccagatcttattcattctacttaactgtatttttgtactcattaaccattcccacttgccccccgccccctgccaatttccttcccagtaacaatggttacttccttctggtagctgttgttctactctctataagttcagttgttttaagttttagttcccacaaatcggtgagaacatgcaaagtttgtctttctatgtctggcttatttcacttaacataatgattttcagttccatccatgttgttgcaaatgaaagaatctcacctttttatggctgaatagtactccactgtgtagaggtaccacatttttaaaaatccattcatctgttgatggacatttaggttgcttccaaatgttcactgttgttaacagtgctgcaataaacatgggagtgtggatatcaatttgatacactgattaccttttgggtataaacctagcagtgggattgctggattatattatagctctattttcagctttttaaggaacctccaaactactctccataatagttgtactaatttacaattctaccaacagtgtgtatgagggttccctttttcctatatcctcgccagcatttgttattgcctgtcttttggacaaaagccatttgaactgggtgagatgatatctcattgtaggtttgatttgcatttctctgatgatcagtgatgttgagcaccttttcatacgcctgtttgccgtctgaatgtcttttttgagaaatgtctattcagagttatatctatttgcccatttaaagttagattattgaaatttttttctacagagttgtttgagctttttatacattctggttattaatcccttgtcagatgaatactttgcaaatattttctcctattctgtgggtatctcttcactttgttgattgtttcctttgctgtgcagaggttttttcacttgatgtgatcccatctgtccagttttgctttggttgcctgtgcttgtggagcattactcaagttgctttggctgcctgtgctcatggggtattactaaataaatctttacactatccagtgtactagggagttttcccagtgttttcttttagtcgtttcatagtttgaggtcttagatttatgtctttaatccatttttatgtgatttttgtataggaagagataggagtctagtttcattcttctgcatgtggttatccagtcttcccagcaccatttatagaagagactgtcctatccccaggacagttgacgattgttgacgatttttgcatcaatattcatcagggatattggcgtgaagttttattttttgatgtgtctttggttttggtatcagggtaatactggcttaatggaatgaatttggaagtgtttcctcctcctctatcttttggaatagtttgagcaagattcttctttaaatatttggtaaaattcagcagtgaagtgatcaagtcccaggcttttctttgcttggagactttattacagcttcaatctcattatttgttattgatctgttcaggtttttgatttcttcatggttcagtcctggtagattctatgtgtctaggaatttatccatttcttctgggttttctaatttactggcatgtagttgctcatagtagcctctaatgatcctttgaattactgcagtattagttgtaatgtctcctttttcatctctgattttatttatttgggtcttttctctttttttcttagactagaaaatggtttgtcaattttatcttttcaaaaaccaactttttgtttcattgatcttttgtattgttttcttcattccaacttgatttatttctgctctgatctttattatttcttttcttttactaattttgggtttggtttgctcttgcttttctagttctttaagatgcatcactttgggaggccgaggcgggcggatcacgaggtcaggagatcgagaccatcctggctaacacggtgaaaccccgtctctactaaaaatacaaaaaattagccaggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagatgcatcattagattgtttgagggtattctcttttttctcgatgtagttgcttatagctataaactttcctcttagtactgcttttgctgcatcccacaggtttttggtatgttgtgtttgtattattatttgtttcaagaaatctctaaattttctccttaatttcctcattgacccactggtcattcagaagcatattgtttaatttccatgtgtttgtatagtttccaaaattttccctgttattgatttctagtgttattccattgtggtcagagaagatacttgatataatttcagtttgtttttgaatttttaaagatgcatttttttgccataatgtatgggctattcttgagaattattcatgtgttgaggagaagaatgtggatttcatagccattgaatgaaatgttctgtaaatgtcaattcagtccatttggttaacagtgcagcttggtcaatatatcttcgttgaatttctgtctcaatgatctgtccagtgctgaaagtggcatgtggaagtcttcagctgttactgtattggggtctgtctcttgctttaactctaataaaatttgttttatatatctggatgctccagtgttgggtacatatatatttacaattgttatgtcctcttgctcaatttacccctttatcattatgaccttctttgtctcttttgctagttttgtcttgaaatctattttgtctgatacaagtactgctactcttgctcttttttggtttccatttgcacggattatctttttccatccctttctttttagtctatatttgtctttataggtgaagtgtgtcttttataggcaacagatgattgggtcttttttttaatccattcaaccactctgtgtgttttgattggagagtttagtccatgtgtatttgttattattgataggtaagaacttactcttgccattttgttatttgttttctgattgttttgtggtcttctctttcttatttctttccttacttttttttttaagtgaaagtgattttctttggtggtatgttttaatttctagctttttactttttgttgtatctgtttatgttttttgatttgaggttacaataaggcttgcaaataacatcttataacccattattttaaacggatgacaacttaacattgattacataagcaaactaacaaaccagcacagagaaaactaataaaaactctacactttagcttcatccccctactttttaactttttgttgtttctatttatatctttatatctgaaaagttgttggagttatttgataagttcatcttttagtcttttaactccagatatgagcagtttacacaccacaattacagtgttatgatattctgtgtttttctgtgtacttactattaccagtgagttttgtacctttagatgatttcttactgctcactaacattcttttatttcagacggaagaaatccctttagcatttcttataggacaggtctgctgttgatggaatccttcagcttttgtttgtctgggaaagtatttttccttcatatttgaaatgcatttttgttggatatacaatttcagaataaaagggtttctttcctttaacactttaaataacaatcccgtttcctggcctgtaaagtttccactgaaaagtctgctgccagatgtactgcagctccattgtatttttgtttgtttgtttattttcttttgcagattttaggattctttcttcattcctgacctttgggagtttgataattaaatgtcttgaggtagtcttatttgggttgaatctgtttagtgttcttatagccttcctatacttgaacactgacatctttctctaggttcgagaagttctcattattatcctttcaactaaactttctacctctttctctctctccctcctctttaagggtgataaatcttagatttgtctttttgaggctattttctagatcatgcaggtgtgcttcattttttaaaatccttttttctttggtctcctctgacggcatattttcaactagccagtcttcaagctcactaattctttgtcttgcttggtcaactctgctgtcaagagagtctgaggcattctgcaatgggtcagttatgtttttcaactccagagattttgcatgattgtttttaattattctaatttcattgttaagtttatcggataggattctgattgtcttttctatgttatcttgaatttcactgaatttttttaaaacaactattttgaattctttgtctgaaaggtaacatatctatccctgtctctccaggattggtccctggtgccttatttagttcgtttggtgaggtcatgttttcctggatagtcttgatgctcttggatgtttgttggtgtctgagttaggtatttattgtagtcgctaaaatctcggcttgtttgtattcatccttcttgggaaggctttccaggtatttgaaaagactttgcccactttttgatggggttgtttttttcttgtaaatttgttttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgctttgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagaccggattaagaaaatgtggcacatatacaccatggaatactatgcagccataaaaaatgatgagtgcatgtcctttgtagggacatggatgaaattggaaaccatcattctcagtaaactatcgcaagaacaaaaaaccaaacaccgcatattctcactcataggcgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgtacaatgtgcacatgtaccctaaaacttaaagtataataataaaaaataaataaattaaaaaaaaaaaagaaaagactttggttctgtgatctacgtttttaatccctgcagccatatctgcattaggggccactcaaagcccagtaatttcatggctgtttcagactcacagatgtatcaccttggcagtcttggatacaatctagaagaattttgtggattaccaggcagactttttttctcttacattctccgagacaaacgaacggacggtctctctctctccccccctccccgagcttcctggagctgggtgacgggtgacacaagcacctctgtggccaccccaccactaggactgtaccagatcagacctgaagccaggacatctctgagtcttacccaaggcccatggggtactgcctgggtaccactgttgattattcagggcccaaaggctctgtagtcaggagatgatgaatcctttcagtactgggaccttcccttcaaggcagtgggttttcctttggcccaaggtgtgtctagaaatgtcacctgggagctagggcctggaatgggggcctcatgactctgcccagtgccctatcctacttggctgagcagttatctaagttgtaagataaagtcctctttactcttccctctcctctcctcaaggagaaggaaggagtctcttttggagctgtgagctgtgctgcctagggttgagggaagggtgacactagcacccttagttgtgccagctagtaccttactaggttgtctgcaccccaagtccagtggctacaagccaagcacagcaccaggacttgcccaggaattgtagtccttccatcataggcagccttcaagtttatttaggaccccagagcactttagcccatggtggtgaggcttgtcagaactcagattctgaccactgggatgggtggtactgctctgtctagggctggtctaaatattccctccatgggctctggttgagttttgcctgttgtttttactgtgacagggcagcaccgagttccaataccaagtcccactatcactgtgctctctctcccaagtgcatgcgttctctctctggggcacacagccactgcagggggatgggtgaggggtgacatcagcaattccaaatgatcttttccaccctcttcagtgcctctttcaatgatatggagttaaaaccaggtactgtgaccactcacctgaaatttggttcgtatgaaggtgctttgctgtgcggacagttgttcaatttggtgttcctacagggaggatgattggtagaggcttctatttggccagctttctccactctcacccaagcctttttattactattaatgcagcagagcatcagttttctttttggcctagaagtttcagaaagctggaatttctgtaaggagatcttgataaactgcagtgagagggaggcttactttgctgatgggaccatcaacttaatgctgaaatgcaactaattgtgagactgaagcaagagctttggctaaatttccaaaatgatgacataatttttgcaatttttgtccacaggtttcacgtggcaggatgactatactcagtatgtgatggaccaggaacttgcagacctcccgaaaacctacctgaggcgtcctgaagcatccagcccagccaggtaagtgtggacgtggcttgttgctccttgctcccaggacacagtccatagccattacacttattatttgtttgtttgtttgttttaatgtagcaaagcacccaccatctttctggtgcagacgtttcagaaagttaggatgtctgtaaggaaaagtttggttcccatgagagaaagcgatattggggtgaccctccagtaagagacatgcccaggggttcttcgtttttccatgagactcttagaaaaatcctgcatcttcaaggccttggtcgaaagcagataagtcgagaattctcatttctcagtaagaaattatttttgctttagacaaaaaacagaattgtgaaagtctttatcatcctttcccagagcatagcaacgtatactgagctaaatatattgttccatattatcttattttgtactcaaaactatgtggtaattactaatgtcatacaaacgatgtggtaatgtcatacataccatggactaatgtcataccgattcttgaaagtgaggaaattgagtcatagggaggttaaaaaattagtctaaagacaaaccacagtaagaaagctggcactgtcggattcctgagccattgtgctatttttcatgttttttaaaaaaaaacatgaaaatgacctttcctaaaggtttagtttgaaaagttcatttttccctgacagacaattctagagtcatagtctttagaaagattccagtaacacaaaatttagatatctgctttcatgctcatggccatctgatagggaaagcagttaagtgtcctggcaggatcaagagtgagaacgtgtggagaactggtaaccgtcccccagcacgccgcacacactgagggcgcgggttgcctctttcctcagaacgcggcgcacactgagggcgggggctgcgtctttccccagcaagcggcgcacaccgagggcgggggcttcgtcttcaccacacggcgcacgctgagggcggcggctgcttctttccccagaacgccgcacacactgagggcgggggctgcgtctttccccagcaagcggcgcacaccgagggcgggggcttcgtcttcaccacacggcgctcgctgagggcaggggccgtgtctttccccagaacgcggctcacgctgagggcaggggctgcgtctttccccagaacatggcgcacactgaggttaggggctgcgacttcagcacgcggcgcacactgagggcaggggctgcctctttgtgcttctgtgcctggtgtatctacctttaatacctcctttatcaaagagaatgtgctgttatagtctgtaagacttttctgtaggaaaccaaacaaaaacccaccaaaatgttttcaacttgagctgtgttgaatttctattttggatgtgttcaaactccttatactcctctctaaattccactgggggcgttgtgcactgccccaatgaccttgaactccatcaagtatagggatgggttggacggccaagaagggcaaaaaatagagggctggaagaattgggaaaaccaagcaagggatggctcctcctcactctgggggggtgcagaacagggcaaacagaagctgccaaacgtgggaggaaaggggcgccacatagagaacaatccagggaggacctgcctctgagaaatcaaactcagcaacaaccatggagaggcgcctggattgtgccttctaaacaacgttaaatgtggtcatttggaaaaattgccagtttttattatttaaaacagtgccagttttattatgaaaaatggtatgttatctttgttttatgagttataagtgagattaaaagtttaaaatacatatgctttgagattggaattttctccttccttcctcccttccttccttcctttttctttcctctttctttcctcttctttttttttttttttttttttttttgggctcttgcttcatcacctaggccggagtgcagtggcacgatcttggctcactacagcctccacctcttgggttcaagcaattctcttgcctcagcctcctgagtagctgggactacaggtgcgcgccaccatacccagctaatttttgtatttttagtagagatggggttttgccgtgttggccaggctggtcttgaactcctgacctcatgatccgcccaccttggcctcccagagtgctaggattacaggcatgagccaccacatctggccgagattggaatcttctttgtgaattttctgtatatggtctttgtctgtataaaaaggactttttgtatttttctgtttgtttcttttattataggttctttatatttcaggctagtaacttttcacatattatattttgtaaaaatatttttatcagcctggaacgtagatggcactagctatggttacaaataaaaacagctcttaccattctgtaggttggatttctaaattctttctttgtgagtgttgaacccaggcaagagcaattatccctgcccacaaaacagaggcccatttagggaggcattggctggatattctccagactcctttcctccacactcccttcccctgccctgctatgggcttcatgcctgtaagctccatcgggtcctctgggcctctggctttggtggggtttggaacaagctgcacccagcatggagggcagaggagtctgggcatgttccccagctcttccccaggcccagacatgactgcctggggacaatcactccctctcatgctgtccctcctgctgacccaaaggcctccccagtcctgccggtgccttcctcatgcccgactctgacacctactgagggaggttcccatgaggccctgcccaggagagaataagaaacagtgtggcccatcgtcttcctcaacagttgcccacagtatttcctcatggaaatgtgatcgtttttctttttttcctaacatttctggaaaacttcttttaccattgatctactttctagtatattttttaggaatgttcttcatttatagagtattttcattgtcttccacgattattggtaaaatatgcttacactgttgtgtgatttgggatatttataagctatcctttaatagcgatttccacatttgtaaatgcagtgtagtggatgctattctcttgttgatgaaaagagtcaaactctgtaaaatatttttagagatgtattctgagccaaatatgagtggccatagcccgtgatgcagccctcaggaggccctgagaacatgggcccagggtgctcagggtgcagcttggttttatagattttagggaggcgtgagacatcaatcaaatacattggtttggttcagaaggtgggacaactcaaagcaggggcttccaggctataggtgaattcaaacattttctggttgacaactcgttgagtttatctgaagacctgggatcaatagaaaatgttccagttaagataaaggattgtggagaccaagttttattgtgcagaggaagctctcagttagcagacttcagagaaagcaggttgtaagatgcttcttattggacctaaaagggtgcctggctcttggttgattatctcctggatctggaaaggaaggaaggaaaacaaaggggaaagtagatccctatagaatgtggatttttcccacaagagactttgcagggcaatttccaggtattgcaaggaaatatattttagagttaaatattttgattttttccctttgtctcataatgttctgccagagtcagactgaaaagtcagtcacgatatatagggtcaaataaaacccatctgatgagaatttatggtttgtggggtatgacttcccagacctcttagataggaatttggacaagagaaaaaatcagagcttagttctcactattatggtttttaaaattactcagcacttgtgtagttatattcctttgcattgtaaacgtacgttttctttagccaggtgtggtggcgcctggctactcaggaggctgagagagaggatcacctgagcccgggggattgaggctgcagtgagtcatgatcacacacagcactctagcctgggagagagagtgagaccctgtctcaaaaaaaaaaaaccacttttttttcacccttgtaacatgatttttaaaaagaattatctcttagattttcttctttttgctgttctcttttaaataaaacttcttcagtaaaacttatttacgctatttattcatttttaaaaaaataatgaaatcacataaataatttgcttttgagcataattttaacatcattctataactgatgaattctcacttgcttttgttctaaattatctgtaattgtcattttatatccttttgaaacaataaatgtttggtaggcttttctactttttcatatttatgtgttgtttttaaacttcaaattagtgtctaattctactgcatttttagtcagaatgtgactttgttcaacttttactctttggtaattttgaggttttctttggcctaattgataccatacttaatcttcaattggcgcttcaaaaatatatttgtataactatttgcaggatacagacttttataaatagtttataattatatatatatgatgtgtaattaggtaaaaatgtgtcaattgtattacttcaacatgtccttatttatattgtgactttctgaaatttctcagacaaaaacagtaatctgtgagttttctttgggggttgatgtgtttagcttcataggctctgaggctctgctgcttagcacacgggggctgcgtcagctcgtcctcggcgtccatcattagtggattgttgtttaaatggtgcctgcatctcccttaatgcttgttgtcttggattccattttcctaaatgagtagggcctttcctgcttcctctttgtttttgttgcctgattaatccatggctatcttcagaatttgacctttgagactggttctgtttgaaactcagcttttataagatcaagtggtgtttccaaagccccttgggtcaggtcggagggcgagttatagcagcaaggggactgattcctctgtggggctttttcttctcatatgtggattgtggcttgtttgccttctcatacgtggattgtggctcgtttgcctcttctttagtattcgtaattttgtcttattttggatttaatttgtggccatcacctctagattttcaagcgattttatagtaatggatttgtttcattcctcattaaagggatcatgttctgattcctgctgcatgataaggaaccgtgttggctttcagcatcctcactccccactcccaggagctgcttctaaccaggctcccctagtgcctgcctgtgcccttcaccagatggaccctgggccagcatttgttggataaatggtggtgaaggacagaatgcgtgatctgcccaagcctttgaattcttgcatgggtagctacactaacgaagaatgtcacctggctttctccactccatgtgtattcagagcattctgagcttcacagctgaacaagaatccaccatgggccagtgacatagtagctggtgttctttacataaggcagttaatctccagagattgagtaacttgctgaaaaccaatcatccattcatgaaataaaggcgacattagaatgaagtcttcagaatccccagccctgtttttgggcttaccagagtggcaaccacaagctcatttctcctgctggttcttctcttcccacacatgaggtcccttaagcagagtaagccccatgagagaaagccagaaagagacgcagtgtggaaaatcagcaaagcagtaggtatgagtgcccagtgtgaggaacagagctcgcacctaaggggtcaccaggaacctgagaacatgctaaaggctaagagaacctgagaaccaggaacctgagaacacgctaagggctaagagaccttgagaactgagagcctaagaacatgctaaggactaaggaggacctgagaaccaggaacctgagaacatgctaaagtctaaggaggagctgagaacatgctaagggctaagagagtcaaggaaggggaacctgagaactgagaacttgagaacatgctaagggctaagataaccaagaacctgggaacatgctaagggctaaggaggatctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaaccagggatcatgctaatggctaaagagaaccagggatcatgctaaatgctcctgaggcaggaacagggacaacaaataccagctgtgtatatgagcaccgatgacttcacagagaacttcaggtggccatgaaggttggatataaaacataagatgggcctgtaatgtggaattttttcctttaacaaactgggtgacaatctagactatctcatattatcgtgagcctaaggccagtgtgtgccaatggagaagggaatagctactaagtgtaaaacatttttcatctttttaaagtacaaaattcatacgtatgaagttttgacctacttcaagctggatgacagagcaaaagtcaatgtgcaagttaattgctacaacaccacgcggcataatgataaaccctctcattgccgtaacatactgcagcatcacaaacaagtccccaggcatggacagaggcgaagcaaagatgaatacgacaatttaaagatacatttatgaggtggttccatttgcattgattagcaattagtgagaaaagtagacaaaataccagaaaagtaaattaactgcagttaaattacactctgacaacatagaacatgaaatttcattaattaaaaaatggccaaggaaattatagccatgatttgagatgcaaagaactgcaaaagccttggtaatttatatgcctgttacatctgtatcagtgtaacttgaaaagtgatattgtttggctgtgcccccacccaaatctcatcttgaattgtagttctcataatctgcacgtgtcatgggagggacccagtgggaggtaattgaatcatggaggtggctgtctccatgctgttctcatgatagtgagtgagttttcacgagatctgatggttttataagggactctttcccctttgctccttgcacttctctctcctgccaccttgtgaagaagggtgtgtttgcttccccttctgccatgattgttacgtttcctgagacctccccagccatgctgaactgagtcaattaaacctctcctttataaattacccagtctcaggtatatctttatgagcagtgtgggaacaaagtaatacaaaaaggcactagaaataaaaacatggtgggtttatcaattgagataatcaagcaaaaatgggattttttttataagccccatgcaggtatcacacacctaatgttagtgatctgttcttgaaaatcaacatcctacatggaaacagtacctggaaacctattccattactgtatgtgggaaatttgtaatgagttccacatccactcaagccccagtgtatttcctaaagtgtttctaaatcacactaaagacccatatacaagtaccagatggtcatgtttggatagaagacacttcttgctgatacccagaagtggaaattgttcttagcaaagtgtatgttctatttgaagtaatactgcctcactcagcacctgcaaagtctgagctgcacctccctcaggctgttgggtgatgccacagtgctgtgtttggagacatacccagactttttctgaatacgattttgttcagaatgtagcatcaaattctgtgaaaggagatacacatgcacacgcacacacacacacatacatgtatatacatatatacgtatacaggtgctccttgactcatatctacctcctgtgcctgcctagggagcctgggctgttcatatccctcattgtggagctctgctggggatgatgtccttcagtgtcgtatttctaagagagccataagtctacctttgtatttgaaggatattttcatgggatatagaattctgggttacttttttttctttcactactttaaaaatgttttccatcgtcttctggcctggagcacttctcaaggagaaatctatagtcgcctttccactggcatcgggggcactggattgaagtcccccaagatcctcactagccgtgggcagggccccaggggtgcccggggagctacatctcggttgggtgtctggacagcagactctgtagtcctgaagtccaaatgcagggtcttgggaagacccctcatggggaagtgaagagacgggtttggccgaggagaggttggactcagtgtggtcatgacagaggcctcaggagccctcacccctcctcaggggctggggaccagtgtgggatgcagacctccctagatggggtataaacgtgggtgaggcagacccccatggtggagggccattttgggaggggacgcagctgtgtggcgatgacacttgcccccagctgcctcagggacagtggtgctcagtggcctgccagagttgatgagacagagctgaaggtctggggaaaccaaggcagcttgagttcacaggtcagagtataaaagagaagagtgcacagagagccctggagattttcagccactgctgaggatttggtagatgactgatgaccttgtgtctatgagggaaaagaaccatccaaaaaaatgagagcaaacagtatctgacattcacacagggtgcgacatagtgcttcttcaaacctatcaagacttgcaaacctcataatttccagataattgggtagaatgcccacagagtcctgtcttagtagtggggagtaatttgtcatagataattgctgctctgatactgccaaacaagacttaaaagtaagaaccgagagggttgaactggtcccaaggaacttaactgaatgccagagcaaaggtaaataatatttatgggattgcaaatgtccatcacccaataaggtaaaattcacaatgtgaatatatagacatggattatctggcatgaaaaggagcaggaaaatgcaactcataaaattcatcagtgtagacacagaactgacacagacacaataagtaggagacaggaaaatttcatgggtggaatgaatagcagattagacactgtggtagaaaatattagtgaacttgaagacacagcaataggaactatccataaggaaacaaggaaggataattaaaaaaaaataaaaaacaccagtgagctatgggacacatctaaaggccaaatatctgtataactggagtcccaaggcgggagagacaggaacagaaaaatcatttgaagaaataatgaggaaaattgtttcaatatgataaaaatgataaactcacagagccagaaagctcaataagccccctaaaaaagaaacatgaagactaagaaatatcataataaaatttctcaaaaccagtgataaaaagccaaccttaaaagcagccagaggaaaaaaaggtgcatttcatagagagatgagatgatgaaggccactgcaggtttctccttgagaatgctccaggccagaagacgatggaaagcatttttaaagtactgaaaggaaaaacaaacaaacaaacatcaacccagaattccatatcccatggaagtatccttcagatacaaaggtaaaattattggctttctcagaaatacagacgctgaaggacatcatcacccacagagctccatgaccagggctggtaaagccgccgttctggcagaagggaaaggtgccagatggaaaccaatgagagaacacgcgaaggcaactgcatccaccgatagatggtgttttcctgtcacttaaatcacatttaaagaagttgattaaacaaaaatgatgaaagtgtattgtgaggttgataacatagctgtcaacagaattcatgtcaacacctgcatcagagctggagggagaattgcaaggatctatttaaggctcgtatttcatatgttaagtggtgtgatgtcccttggaggcaacctgtggtcagttaaacgtgactgttatacactatctgtaatttgggcttcttgccctaacgaggatctagacttagatgttgagaaggtgaaggtggagccatgccccagggctctgaggcagccagtgcctgggcgctcaggaaagtacctgcctccacctcggacctagcctctccctggcctgagagaagcagatggcagctgaccgcacctgtaaagcctgttatgagggaggcctgagtcttgtgctggcagtggggcatgacgccggggcctgtggcgtctggaccgtccactgcagcacaagtcggacctgaagtgattggtcatcgctgagcatggctctcagcgggaaggggatttgggagcattgctgagggcggcaggttcacagagggccctgcccttgtctgtgggcagcagagccggacagcaagggcccccagactggcccatctttttaatggtgatgcccgttcttttatggacataaatgacgcactcaattaattatacaaactaaaaataaccagaattaaaagctctttggtctgtgtctaaactccatgtctacgaaatctttgcattttattagaagcatggtgtgtgcgtgcaggcgcacacatacacagacaaacgcacacacgcactcacacccctcacacactcacacacacacttacacaaactcacacacgcacatgcgcgcgcgtgcacacactttttttgttgttgttgaaacagggtcttcctctgttgcctgaggctggagcacagcggcgctatcgtagcttactgcagcctcaagttcctgggctctagtgaccctcctgcctccacttccaaagtgccaggattatagctgcgagcccccatgccggcctcacattatattccttttttttttttttttttttgagacagagccttgctggaatgtggaggtggggtgcagtcactcacgcaggtgttcttaaacctggctggtagaggcgtctcctatgggaattatcttccttatttaggagcatgctctgggcccttttggtcatgtgcaaaaaagcaaaggcctccgtgggggctgtgaagctctgggcggctgagtcctgggtgcagagaccagcggcagagtctgcgggtgagctgggcagggagggccatgcccatccctagggaggccatgcccatcgtgtcccaggctgagacgctgccccgtggctcaggcaagctctccgccacagctgagggtaaagggggacagggcgcaggctcagggggccacggacatcctctgtgcatgcccaggcctccaccagggctccccataaacatggggagtcctgactctgtctctccggggcctgttgggcgttaccgcgacttttccagtgaatctccctggttctgctcttcctttccgtgtggctgcacaagctggtgatgggggccccactggcaagtggctgctttctcagggactctgagcatcattagtgggggccacatgtggctgacacgtccagctgcctcctggatttatgccttcagcacgcagctgtcccatggggcccctggccagccgtgcctggttcttggccttgtcctcgctggccctacccctgccgccctcagcagggtgggcaccacatgtgtctgcccacgggaagcgtcccatgtgtttgtccttctagcctccggcgtccctgccctgcatggtgcacgcgatggcggtgcgtgaatcactgtttaacagcagggactgcagcggaggggctgagagcactgcatggacgtcccgaggctgtggcgaagtacatcaacctaaggcctaaaacaatgcacatttatcaggcgagaacctggttcctgccttttccagcttctgggccgccaccttccttggtctacccacaaacccagcagaagccatgccaagccttgggccccccatgcccacccggcctccggctgcctcagcctcctggagaattcctgctgagcctgcagccaacacctgcagcttcctccctttctcccctccccttgtttcccatgtattgcttttgcttcctgtcttctgctctcagcaggggtcaatcgtccatccccacaaccacgaggcaggtgctgttagccatcctcgtgcaggacacaggctcgggggcccgggagaagttcaaacccatggtcatggagcagcaaggccaggccggccaccgagagcccggctcccagccccttgcatgcacccaggcaccacaggggacagagcagctccaggcaccagcaaacatgcggttgatgtctggtttcttttgctttttcaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgaggtgacccttccacttcctccccgggccggggttggcttttccttcagggtgcaggtacctgggcatgtttccttagtcgctggctcctcttggctttgcgcctgtttcccgggccagcgggcatcctgtgaacagggcttcggtgttcctggggccccttagagcgacacctgctcccagtccagccacccccacaaatgcttagtcctctgggtgaggctctgtaggatctttcttgggacaaggtgtcgtgactccagaaagcccaccatttaaaccacagatgcacaccagggaggtagaggagataggtggctgctcttcaccctttgagaaaggatccgggacagcagtggacactgaaacctgactgaggtagactgaggggccatgaacatggctggaattagggggcaccaggtgcaactactgcatccaaggaaagctcctgctccccggcaagcctgccccgggggcagcccagggcagcgtaagggctccatctgcctgtgggcatgagggtctgggcaccaaaacacaaggtgatgccctgggcacacagaccccagacaggctcggaggcgaaccccaggagtgtttatgcagggcgagtgggagctgcaaggacccgcatcacagagccacccaagacccttcactatgcgaagcccactcaacatcttaaggacacggaattaggaatctcagtaaattttgtaaatggaaaagcaggcatgatttttatgacgacttgttaggccagagttcacaggtcccacattgcctggaaagagggagggacaagagctgcagaaatcacctttggagcccagccctgccagcttcctgggataggattttggaccaggtgttgaggcccaggatggccctggggacattgggggtttgatggcgacgctcacacactccttttctgccaaacgttagttacatcagctctaatttgacacactttcctttctaagatggaagccatgctggtgtgagacaggaaagcctgaggaccctctgcatcctcttggactccactggggtctcaccaggagctgtggccctgggatatgtgtgggaagcaatgtgggcccagtttctattatgttcctgccatcgagccattgaaatgacttaagttaactctgggcaacccccacagacctcgaaaggtagagtcctcccagaggacgcgtggccactaagctcaatcccaggccagcttaggggcttcctggaaccttgcaccaagcgtgggaaccacagggtgagtttccacagaagttggccccacaaggtggcacgttctgtgcaggcaggtgaggaagctgaggcacttctgtgtcttagcaggtggtgcctggggaaggcccggccttggccccatggttctctggagcctttccgagggcagctcctgggcagccatctttgctgtggccttgcctcttcaggaggatgtcacaatgacgtttgaatgcagaagccagtctgtccacggccgccaaacagagccctgatgctggcccagagccatgcaggggccacggggtgccagacccacaggccacagttgagaggctgctcaggagggcccagtggcacctgggccatatttgtgtttttcctgatcatggactgtgtttcctggtttgttgaaatcacccctcatggtggagggtgggggtcttcagccctcgtggaagtacagggtcacagggctctgtgggccccaggtctccctctaaggttaggctcacaatgaaaggccagtcccagccctgctctgtgccaggcccacctcccatcaggaccactggctggcctgaaaaacatgccccaaagccttccaggagcctgtgggagtctctctgtgtgggcctaaccctagagggtctggtccacttaacactattttaaacaggctaaatttaaagtttttattcattaactgagagcaactaagcacgtctggtgcgccagacatcctgctggattttgtggatgcagaaggtggatttcatgcagctctgtccttgggtcagaggctcctccacccactgctctggggccagggggagccgctcagcttctgtgcctcgagtcctcagctgtaaaccaggggtagtggccctggaggtgtcatgagagccacgtgtgaagctcctcatggagtgcccagtcagcaatagctgtaaccgtaactatcgttgataaaataatctttaaaaaatgaaatagaaattaggttgagagtctgaaccaggctcagtggaggtctccgactctgatgagaggaatcagagggcgccaggacactggcaaacatattccctccgcacacctgtgcctcggcaccacagagcaggtctcagcacagcacggtggaaactggcatttctcccaccctcttgaacgttggtaatttagcacctccagctctgaaatcattgctttgtcctcctcctctgccccgctgtgtctttatcagaagggctgtggggccctgtgctctgcctccactgctgctgggagatttcaggcttctgtaacggcgccgtgacgtcacgtccccagacgctggaagtgaatgatcagtaaagtaacccacgtgcagtccagagatggttttagtaacatacgagggaagggggaggcgtcattaaaagtttcagagactcggaagaagtttgagagaagggaaatcagttgacacttttctgtgaagcagtttcctgtctttcccccctgacttgacagtggcgtgctcacctagactgacgtccaagggccctcttcacgggctactgaatagagaaaggcaggagcgtagccttggaggctcatccaatgtgccttggatgggccagtgagcgagtcgtcacctgcaaacagcatttggtttcattcaatgggagcctcagttgttccattttgaacccatcatcatgctcctccttcggtttcagttattttattaaatagccctggcactaaaataaaagagtcagagttagaatggaatttgcttgtgggacaaggcgcagcatggattcgcctcgagggtaaatggaatggctgcagtgcttccctgccctcagcagccagacgtgaggtcggccaagcagccgcaacatccacgcattagaaacaaaccgtagcaaattgcaggaactcgttgagagtgaaggtctttggtagatattgagcaattcgtgctatgagccattgggaggtatcctagtgatgccccatgagagggctcatagcagcccctggggaaagcaagttcctgccagagacaggatgccttcctaggccgagcacagtgtactgcatgtcctgggatgctttccaggtgctcagtggttctgctggactcagcagctcagtgctcattaggccaaagggcccgtggcctcgtcacactaaccagttgtatttactgaagtctttccattcctggcttactgcactaggattccagcaccagcattctcaacacacgccccggagtgctctggaagcagccttccccatacagcgggcgagcgtggcggccttccccatacaaggcggcgagcgtggcggccttccccctacagggggcgggcgtggcggcctttccagtacagggggcgagcgtggcggccttccccatcagggggcgagcgtggcggccttccccatcagggggcgagcgtggcggccttccccctcagggggcgagcgtggcggccttccccatacagggggcgagcgtggcggccttccccatcaggcggcgagcgtggcggccttccccatcgcggggcgagcgtggcggccttccccctacagggggcgagcgtggcggccttccccatcagggggcgagcgtggcggccttccccatacagggggcgagcgtggcggccttccccatcgcggggcgagcgtggcggccttcccagtacagggggcgagcgtggcggccttccccctacagggggcgagcgtggcggccttccccatcaggcggcgagcgtggcggccttccccatcgcggggcgagcgtggcggccttccccctacagggggcgagcgtggcggccttccccatcagggggcgagcgtggcggccttccccatacagggggcgagcgtggcggccttccccatcagggggcgagcgtggcggccttccccatacagggggcgagcgtggcggccttccccatcgcggggcgagcgtggcggccttcccagtacagggggcgagcgtggcggccttccccctacagggggcgagcgtggcggccttcccagtacagggggcgagcgtggtggccttcctctgcactaggacatcccttccgttgggagctcgtgacggggccactgggggttcatctcttgggttgcgaccctgccgctccccagggctgctgggtgcatggaggaggagcatcttccaccactgcccccatcttgcctgctctccatttcaagaaagaggaatgggagaggggcgtgggcaccggtcatgtcaaatattccaccagcagccagggtccaccttctgataagtttggctgtgtcaccttggaatctcctacacacgatggtcggcctcacagtcctggtctctactgttactcagcataattatcaggaagtcattctttcccactcggaggtgtcccagtttgaattaatgagctccgtggtcattccagcacacagacatttagcacagctgtcaaacggttattcagaaaatgagcacttggtggcattttggcttaggtatttttcttctttgttaagatagatgcttctcagtatttaaaaaaatgcatgaaaacccagaactcattttcttttctgtccagtgtttaaatgaggagaaagctcttagtcatcttgctaatgaacaaagactgaataagcacaggaagtgcgtgaccggaggctgcagcgctgccgtgcagattttgctgccccgtaaatatagggacttagagatctgggccctggcttctcccctcccctctcagctgatgaaatattttaattggaaatttaagctttatatactgacgatctttgaaggtacaatcaacttcctgtgaattattttataaatcattgttttctatgtacccatcatcaaaaatgaaactctagcgtagatggagaaatatcctaaacatattgcctttcagggccttcatgctggtgacgtcataacagaattattttattttattccactgggaatataatcatgctctttctctttgttcattagcgagatgactcagagctttctcctcgtttaaacactaattgagcacttattgatcactaaatcaaggtgtcgttatgacttctgcattgtgagggtggtaacgcttcctgttttattgactatggtagcaccagttcacagtccttgaactcatcatgcagaacaccataaattccctgtccactctgttactgaggaggtttagtcagaaattcattacttaccaataccattaactagctgatttatcttggaaatgtttaaaaaacatatttaacatacaagaaatggtgctagattaaggaaatgattaaggaaagttagtttctgtcctttaggattttacagttttgctgggtaggagggagaaaacaagcaagcaaaaaatataattaaaaaattaaagcaagtgctgtgatggagggaacacagaaagtaaaggtgcactcatgccagagggggcaggtggcccaggcgggcttctgacagagggggcaggtaggcccaggcgcgctcatgccagagggggcaggtggcccaggcgggcttctgacagagggggcaggtgggcccaggtgcgttcatgccagagggggcaggtggcccaggcgggcttctgacggagggggcaggtgagcccaggcgtactcatgccagagggggtaggtggcccaggtgggcttccaagaggacggccttgggggacgaccaggagacacctcctgcaggtgtacgatggacgtagggtgcagagtgtcaggagcccattctcctcccaccccgaccacatgagtgagcccccgggagaaatctgccaggagactatccccctcccaccccaacaacacgagtgagccccaggagaaatctgccagagctgaggacacaggaaaagaggatgaactgcattccagaaagggatggatgaacccattccaaggagaggagaccacagcttctttcatgcgcattggaatggaagaagcagaagccagtcacaggaagtggggagaattcggcctaaattttaagaaactcttgaggtgcatggaacagatttgagagacaggctgtgcaaagcgagtgtctgcacccccgcctctttcctgtgggctttcgctgagtatgtgagatgcggcactagggatggaggagggagagggctgggagaaatcctgccaaggagcaccaggcctctatggagtgccccatgtggccttctgaagactggggacaagggagcatggtggaaaaagatctgttgaatctttctaagggtgcagaaagccagggtgggaccgacggggaagagaagcttcagaaactcacaaactgacacttggaccataaagcagagagctcccccatggttcagaaacctggcggctgagtgcagagcataaagggatctcgagtctcactggagcccagatccaagcctgggcgaagaaggcaacttagacccaaaggatggaaaatgtgtacgatggaaactcgaaaggcaggaaagctggtgtggtcatgttaatattagacagagtggacttcaagactaaaagtgttattcatgacagagacactttatgatgactaaatggtcaattcattaagatgctatagaaaaatgttatgaaccaatttcagagcttcaaatacataaaggaaatatatgagagtactaaagagaggaacatacaggtcgatcatgatcattaatgattgaaactctcctctgtcagtaactgattaaacaaatagataaagtatcagtaaggatagagaagatttgaaccacagcattaaccagtctaagctaagtgatgtttatagaatgatacacctaaaaactgctaaacacacattctttttgagtatgttatatagaatatttcccaaactagatcaaatgctgggccataaaataagtctcaataaatgtcaacagatcaaaatcatacagagaaagattttaaaagaaaactgcagattattattcttcagaaatatagaaacaaaaattctaaacaatttttatcaaattaaattcaacaatatataaaaaagaatactgcatcataatcaaggcagatttatcccagatatgcagggtatatcgaacatttaaacatcaaccaacataactcaccatagttacatagaccatgtgatggtctcagtagatactggaaaaagcatttggcaaaacccagcatccatccatccatgacggaaacctacatctaagattacatcaactggtgaagggctgaatgctttccacttaaaatctggcattagacgaggatgtctgctcttacctcttcaattcaacactgcattgaagatcttttttttttcttttgagacggaagttcattcttcttgcccaggctggagtgcagtggcacaatcttggctcactgcaaccctctgcctcctgggttcaagtgatgctcctacctcagcctcccgagtagctgggattataggcacccaccaccatgcccggctaatttttgcattttcagtagagactaggtttcaccatgttggccaggctggtctcgaactcctgacctcaggtgatccactgcctgtcacattgaagatcttagccagtgcaataaaacaagaagaaatgagaggcattcagattacataacctttgtcaaaaatttggtggaacctacagaaaagctactaaaactagtaaatatagcaatgctgtagagtgcaaagtcagcacacaaaaattaatttatttctgtatactagcaacaattaaatatgaattttaaaaaatatagtagcatcaaaaattatgaaataattgaggttgaatctaaaatatgtgtaagacaatgtacaatgaaaactacaatacattgatgagaacaataagacaaattaatggtgatatatacatggtcatgtgtctaaagactcaatagtgttaaggtagaaattacctccaaattggtatcaatatgatacaaaaacacaatccttaaaaaaaattgataactagaactttgtcaaaatttaaaaattttcttcttcaaaagaagacacttcttcgaaagacacacaaaagacaagccacatacttagaaaaatacttgcaaatagcactttttaagataaaaaatttcagaatgtataaaaatctctaaaaactaaaaaagcagcacattaaaaatgggcattttttttcaagacagtggattagaagcggtgttagcatgcctctcccacttggaaagacaaaatagtgtgtaaagattcacactgtgaacttttttccaagaagcgacaccagaacttgacaggaaaactaaaagaaaccacagaacctttgaaagaagtggcaggctgcagcctacactgtgagccaagcaaagaactgtaagccccacagtgtgagggggagacactgcctccaagatatgcacccccactggagaattcagcccatgggggcgggaccttaaccctaccaagtcctggaactgatttagggagcagtggagaatataaagtaggagaagcagtagaaagagccctgtgtgcattcccagtctccagcatggactggggaagccattctgcctcacaggggaccttgcggaagtctgccaaccaactcagtcagtggccacgggttgagagaagctcccaactgaaatttgcaatctaatcttgagtggggacaaactcccttggccataacccaggggggagtgggaagcacgctgcagccacaaacacaggatctgggagcctggctttgctgctggactgggatagatgtggtctgaaagccacacttcctgtctccatgatgattgggacaatatctcacatctcaatattagtgttgaatgtaaatggcctaaatcctccatttaaaagataacagattggtagaatggataaaaagacacaaaccaaatatctgctatctcaacatagtcacctaacacataaagatgcatataaagttaaggtaaaggggtagtaaaatatattccatgcaaatggaaaccaaaagtgagcaggagcattctaatatcagataaaacagactttaaagcaacaacagtaaaaagagacaaagaaggtcattaaatgatgataaaagggccaatccaacaagaagatattacaattctaaatttatatgcaccaaatgctggagctctcagattcataaaataattactgctagatgtgagaagtgagataggcagcaacatgccaacactgggggacctcaatacttcactgacagtacaggacagatcattgagacagaaagtcaacaaggaaacaatggacttagtctacactctagaacaaatggatctaacagatatttacataacattctaatcaagaactgcagaatatacattctcctcatgagcacatggaacattctccaaaatagactagatgaagaaaatgtggtacatatacaccatggaatactatgcagccataaaaaggaatgagatcatgtcccttggagggacatggatgaagctagaagccatcatcctcaacaaactaacacaggaacagaaaatcaaacactgcatgttctcacatataagtggtagttgaacagtgagaacacatggacacaaggaggggaacaacacacaccagggcctgctgagggttggggggagagtggagggaaattagaggacaagtcaataggtgcagcaaaccaccatggcacacatatacataggtaacaaacctgcatgttctgcacgtgtatcccgtctttttagaagaaaaagtaatgaaacaaaaaaagactgtatactaggctacaaaacaagtctcaataaattttttaaaattaaaattatatcaagtatcttctcagaccacagtggaataaaactagaaatccactccaaaaggaattttttaaactacacaaatacatggaaataaaaaaatatgctcctcaatgatttttgggttaacagtaaaatcaagatggaagtttacaaattctttgaaatgaatgataatagtgacacaagttatcaaaacctctgggatatggcaaaagcaatgctaagaggaaagttcaccgtgctaaatgcctatatcagaaagtctgaaagagcccaaagtgacaacctaatgtcacacatcaagtaactagagaaatatgaacaaactaaacccaaagctggaagaagaaaagaaataacaaagatcagaacagagctaaatcaatttgaaggaaagaaacaaatacaaaagatgaaacaaaaaattggttttttgaaaatataaacaaaattgatggaccattagctagattaatcaagaaatgaagagtgaagattaaaataagctcaactataccacagaaatacaaaagatcattcacgactattatgaacacttctatgcatacaaactagaaaatctagaagaaatgaatacacgaatatattcctgcaagcatacaaccctcctagattaaattaggaaggaataaaaaccctgaacagactaataacaagcagtgagattgaatcagtaacttaaaaattgcccataacaaaaaaagcccaggaccagatggattcacagctgaattataccagacactcaaagaattggtaccaattctactgaaactattccaaaggatcagggcagagagaatcctccctaactaattctatgaagccagtatcactctgacactaaaatcagggataaaataatgaacaaaagcaaactatagaccaatatccctgatgaacatagaggcaaaaaccctctacgaaatactagctgactgaacccaacagcacatcaaaaagataataaaccatgatcaagtgggtttcatcccagggatgcagggatggtttaacacatgcaagtcaataaatgtgatacgtcacataaacagttaaaaacaaacaccatacgattatctcgatagatgcaggaaaagcattcaataaaacccagcatcacttcatgataaaaactctcaacaaactcggcacagaagggacttacctcaaaataataaaagccatgtatgataaacccacaaccaacattatatggaatggggaaaagttgaaaacatcccccctgcgaactgaaagaagacaaggatgcccactctcaccacttctattcaacatagtactggaagtcctagccagagcagtcagaaaacagaaggaaataaagggcatccaaaatggaaaagaggaagtcaaactattgctgtttgccaatgatatgatatacctacaaaaccctaaagactcctccaaaagactcctagatttcataaacgaattcaggaaagtctcaggttacaaaatcaatgtacacaaatcagtagcagtgctatataccaacaatgaccaagctgagaatcaaatcaagaactcaatcccctgtacgagggcttcagaaaataaataaaatacctatcaatatacttaaccaaggaggtgaaagatctctatacagagaactacaagacactgctgaaatacactgtagatgacacaaacaaatggaaacacatcccatgcttatggattggaagaatttcatgaaaatgcccacactgcccaaagcaatctacagatttaatgaaattcctatcaaaataccaacattattttcatatagcaccaaaaaatagcccaaatagcaaaagcaatcctaaacaaaaagaacagatctggaggcatcacattacctgactccaaactatactacaaggctagagttaccaaaacagcatggtactggtagaagagtaggcacatagaccaatggaacagaataaagaacccagaaataaacccaaacacttacaaccaactgatctttgaaaaagcatagaaaaccataaactggggaaaggacacctgtttgataaatggttttggtaaaactggatagccacatgtagaagaatgaaactggatctctattgatgcagggtaaggagccccaaagtggggcttagcccaccagggttcttggctttgcccaggaaagaattcaagggcaagctggagataaaagaaagcaaccttattgaaaaggcagtgttacaactctggcagtgttttagctctgtgactgctcctgcagagccaggctaccccataggcagagagtagcagctcagggaagctttgcagtcatatttatagctacttttaattacatgagggttaagagtggtttatgcagaaatatctagggaaggggtagtaacttttgggtcatcaggtcattgccatggaaaggggcagttactccttggtgttgtcatggcaagtgtaaactgacatggcatattggtgggtgagacttatggaaagctgcttccaccttggccctgttttaactagtcctcaatttggttcagtaacccagccctgcctctgaagttgagtcctgcctcctacctcattatctcttaccttatacaaaaatcaactcaagatggatcaacaacttaaatctaagacctgaaaccataaaacttctagaagattaagtaggaaaaaatcttctggacattggccttggcaaagagttcatgggtaagaccccaaaagcaaatgcaactaaaacaaaaataaattggacctaattaaactgaaaagcttcatatagcaaaagaaattatcagaaaacccacagaatgggagaaaatatttgcaaactatgcatctgacaaaggaccaacatccagaatctacaaggaactcaaacaatttagcaagaaaaaaaaatcccattaaaaagtggacaaatgacgtgaacagacatttcttaaaagaagatattcaaatgggcaacaacatatgaaaaaaatgctcaacatcactaatcatcaaggaaatgcaaattaaaaccacaatgagataccaccatactcctgcaagaatgactattattaaaaagtcacaaaacaatagatgttggtatgactgtggtgaaaagggaacacttatccactgcgggtgggaatgtaaattagtacaacatctatggaaaacagaatggagatttcataaagaactaaaagttgatctacccttttgatccagcaatctcactactgagtatccaaaggaaaagaaatcaatatatcaaaaaggcacctgtagatatatgtttattgcagcacaattcacaattgcaaagatatggaaccagtctaagtgcccattgactgatgagtggctaaaggtgcagtggctcacgcctataatcatagcactttgggcggccgaggcaggtggatcatgacctcaagagattgagaccatcctggccaacatgatgaaacctcgtctctactaaaaatacaaaaaattagccaggcgtggtggcgggtgcctgtagtcccagctacttgggaggctgaaggaggagaatcacttgaacttgggaggtggaggttgcagtgagctgagattgtgccactgcactccagcctggcaacagagcaagactccatcttaaaaaaaaaaaaaaaaaaaaaaaaaggaagaaaatgtagtatatatatacaccatggaatactactcagccacgaaaaagaatgtaataatgtctcttgcagccacttagatggagctggaagccattattctaagtgaagtaactcaggaaaggaaaatcgattaccttatgttctgacttataagtgggagccaagctatgggtatgcaaaggcagacagagtgatctaatggactttggagactcagaagcgggagggtgagaggggagagggataaaaaaacctacatattgggtacaatgtgcattacttggatgatgggtgcattaatatctgagacttcaccactattaaattcatacatgtgacccaaaccatgcgtaccccaaaagcttttgaaatttaaaaaatgggcaaaagatttgaataaacacttcaccaaagaggataaatgagtgacaatttaatgtgaaatattcagtatcattcctcattatggaaatgaaaattgaaatcacagtgaaataccactacaaacctataagaatggctaaaatttaaaaaaacaaaatacaaactgaccatcctatgtattggcaaggaggtggaggagctggacctctcatatgccaccagtggaaatgtaaaacattaacaacgatttggaaaacgtcttgacagtttcttcaaaagtgaaatgtttacttgcctgtgatccctccatcccacttctactcaagacaaacgaaagcatgtgtgcattcaaagatttacacacgtatcttcatggtagctttcatagtaaatgcccacaactgaaaaaacccaaatgtctatcagaaatggacaaagaaattttgtttgatccacaaaatggaatgctactcagtaataaactggagtgagctgttgatgcatgaaacagcacagtgagtctcatttctgttgaccaaaagacaaaagaggagctattgttataattccagtttggaaagctgtagaaaatgcaaactgggttataagggacagaaagctggtcgggattgcctggagctgtggacagggatgggagagggcagtgtctccaggggcaccggaatgtattcagggtgacggacgtgttcattgtcatgcctcctgtactgtttattgtatgtcaattatatctcagtagtgctccaaagggaaaagaggcaagcaatcccatgcaaaaatgtataaaaactttgaacggatacttcataaaaagatatacaaatggccaatgaaggcatcaaaggtgcttagcatccttattcacaaaaccataaagaacaaccacttcatgtcactagattggctaaaattaaaaaaaaatccataaaaccaactcttgatgaggacatagaaattctcaaattagcgggaatgcaatgcaagctgttataacctgtatttggaagctgcttaaaggctaaagatacgtctgtccttggactcagcagttcccctctggatgtctatccaagaggagggacgcctgcattcacaggaaagctggcccatgactgcccacagtggctctatccagaacagccccaaactgtcaccacccagatgtggtcaacaagcccaccttcccctatccctgtttctggaggggggccacctagagagattgtgcagagatagcacagcttccctcacagccctctgcttagccatgccacctggaggagcaggtgtggaggcacacagcgatgaggaccgtggcctccacatgttggatgccacattcacgatgtccatttgagttttttaaaagtttgccccctcatgtgattgttcttatgacctttggtgggaagcggagctctggtggaaaattggccccagggcatggtgttctgctcccagcatacacagtagcatctgaggcagagcaggttgatgcatgctggccaccgtcatcctgactgtctcccctggtttcctcccagacagtcctgtccctgccctccactgaacactcacagtgacagctaccacccaccctgcactagcagtccctccacacccagacctgtgctccatggaagccgacctgcttacggttcctctgttcactcggcgtgtttggtgtctgtcactcgacagacatacacagcctagggagaagggctgcatcttagctctgccctttcctcactgcaggatcttctttcctcatttgcaaaatgtgggtaatcatgtctgtaccatcgagtcattgaaagggttagagaaaattaaggcatgtaaagccgaaaacagcctggtgtagcactcagtgaataagagccccgtggcgatgactgtccctccatcttctgggtggttatgagccaactgacctctaaccccaggccaaggtggacgggacatggattggaactcgctgctttaatcatgccctgtgcttttcacttgccaggtaggaggcttttgggtgcagcttctggaaaggccaaaacgcaaacaggagccagaagagtgacagaaggaagagtggcgggcaaagtagggtgggctgagagcagtgctggcctcacggcattgcgagtctcggagcagggcgggctgagagcagcactggcctcacgatgtcgtgagtctcagcagggcggggtgagatcagcactggcctcacggtgtcgcgagtcttgagcagggcagactgagagcagcactggcctcatggtgtcacgagtcttcagataattccagactctcagaatgcatcatcattagcagatatccaggagttcacattggcaccccgtgatactgtcaactcgctacaaatttgttgatcccaagtagtttaggacttaacctcttcaacctcatagattttgtgaactctgaaaactgtttggggtcttatttttcagtctgagagctctataccttggctgcagagatagcaccgtatacgctcgtgtgagacccccctgcttccctgaatgcaaaaaagttattttgtcttggcgacagcactgttggtaagaatgacaccacaattatttcccctccacacgagtgggccacttagagcctgagcactgttaaacactgacactttctactgtgttaagacagagacagaggcagagatacacagagagacagagacacagagagagacagagaaaataaatgagctgccagaatcacctctctaaggcccgagacagaaaggcacagtgaagtcatcccaaccccacattcacgagccggagccggagctgcagcgttcccacctcagctcccaaacctggccgcatccggtgccggctcattaggaagcctgtgaatagcactgaggctgtgtgctttgtcaggccggcagcaagcacgccgtgatcaaggtgcctgtcagtgctgccggcgggcagtgagacagggagaaaacgtgtgttatgtggtcaaaagatgtcccgacttgggcttcctaatttgttttggatcctcggtgcaggagaatagctgatgagcatgggcagagaccagtgcacacacaggagtctcctccacccagagtctcccggcatgtgggactccccggacctccaggccttcctgtcagcctgaactcataattgtgcctttgggactgggctgggtggatctccaggagaggcatgtttgtcaaaggaagaggcctgatttttagctctggtactcccggccccagtaaagttgggagcgaggagagtcacttcctcagcagtgtcactgtttgacaggtgaggggtatggtgcagggcgtggctctgtgaactgcatcagctggctccaggaagcagctctgatttcctccagctgaagagaatcacattcttccaaaaccaggattgcttttctgaccctttctaatagcattctttcaattacggttgttaatgtctatgactcaactcctagttcagtctgcaagatgtttgaggacagggccacatctgagttattcttccttcatagaagtccagggcttggcacacagcagcagtaggggtttgatgatgctgatggcgggggtgacactgatggtgtggatgctgctgtggatggtgtggatgatgatggtgctgctgctgctgctgatgatgatggtgggaagctgatggttgaggtgatgatggcagggatcatgttgatggtggaagtgataatggtggggatgctgctgtggatggtgaagatgatgatggtggggatgctgctgtggatggtgggatgatgatggtgaagatgatggtggtggggatgctgctgttgatggtggagatagtggagatgatattgttgatggtggaagttgttgcgggaagtcagggaccccaaatggagggaccggctgaagctgcggcaaaacataaattgtgaagacttcatggacatttatcagttcccaaaattagtactttcataatttcttatgcctgtttttactgcagtctctgaacataaattgtgaagatttcatggacatttatcatttccccactcaatactcttataatttcctatgcctgtctttaatctcttaatcccatcatcttcataagctgaggatgtatgtcacctcgggatcctgtgatgattgcattaatggtacaaactgtaaaacatgtgtttgaacaatatgaaatcagggcaccctgaaaaggaacagaacaacagcgatcttcagggaacaagggaagataacattaaggtctgactgcctgcggggtcgggcagaatagagccttatttttcttcttgcagaaagcaagtaggagaaatattgctgaattcttttcccagcaaggaataatcctggggaaggaatgcattcccaggggtaggtctatgaatggccgttctgggagtgtctgtcttatgcagttgaagataagagatgaaattctccctggtctcctgcagtgccctcaggcttaccaggattgggaaattccagcctggtgaattctagtcagaccagttgtctgctctcgaaccctgtttcctgttaagatgtttatcaagacaatgcatgcccagtgggacactcatcagtaattctaatttcaccccctgccttgtgatcttttattgccctctgaagcatgtgatccctgtgacctactccctatttgtacacccctccccttttgaaatccctaataaaaacttgctggttttgtggctcaggtgggcatcacagaacctgccaatatgtgatgttacccctgaaggcccagctgtaaaatttacctctttgtactctttctctttatttctcagactggccaacacttagggaaaatagaaaagaacctgtgttgaaatattgggggctggttcccccaataggaagtgatgatggtggggatgctgctattgatggtgggatgatgctgatggtgagggtgatgatggtgtggatgctgctgttgatgatggggtgatgatgatggtggggacgctggtggtgttggtggtgatgggatgctattattgatggtggagatagtggagatgctgttgttgatgattggggtgatgatggtggggatcctgctatggatggtgaagatgatattggtgggatgctgctgtcgatgatggggtgatgatgatggtggggatgctgctgttgatggtggaagtgatgatggtggggatgctgctattgatggtgggatgatgctgatggtgaaggtgatgatggtatggatggtgctgtggatggtgaagttgatgatggtggggatgctgctgtggatggtgggatgatgctgatggtgaagatgatgatggtgggatgctgctgtgaatggtgaagatgatggtggggatcctgctgtggatggtgaagatgatggtggggatcctgctgtggatggtgaagatgatgatggtgaagatgatgatggtgggatgctgctgtggatggtgggatggtgatggtggggatgctgttggagatagtggagatgctgttgttgatggtggagatagtggagatgctgttgtggatggtggagatagtggagatgctgttgttgatggtggaagtgatgatggtggggatgctgctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagccattaacacttccgtgccagatactattattattatccttgttttacagattacttaaatagtgtgctgaagcaaaggtcactaagctcgtagcattggtggtagtttaaacccaggcagctccagagccagttccttttccttggggacctcaaaccgtgaaagagccagtcagcgtgagaatacttttctttactgcccatgttcccaactctcaggccctcttggttatgggatggtcacctcaccttggtgagaaacaccccagtgtctgcaatcatctattgagtagccggagtggcttgcaaaaaccgatgtttgctattatttctacaggctctgttgtttgtgctaactactgaaatattctttttcctcttcaccttaatttgattcagaacataaaccaaaaatagattgtttatccaagtctactgcacagatcacactctgctgtgattgtgtaatgcactgaacctagtcagtcctgcacctggagcttccaactcaactttaattaaaggccctttgcgtggaagctccaggttactgcattcatagcaatgaggggaaagccacttgcaggcacataacgagggatttggacgcagatccccaccccccagcacggtggctgaccaggtgttcagagacagcctttgcaagagggagtgcaggctgagctggagattgacacttacacccaatttgtgggaaattgctggaggggctgtttgttgtggtggcattcactgtctctcgctcgctcgctctcgctctttctcacgctcttgctctctcacatattctctttcttaagggaagaatagttgatttcagctagtccttggacaaatttaagcaatttggatgatagctatagtcacatcactttagaaataataattaaaatatcttagagataatggctgggcacagtggctcatgactgtaatcccagcactttgggaggctaaggcaggcccatcacttgaggtcaggagttcgagaccagcctggccaacatggcgaaaccccatctctactaaaaacacaaaaattagcagggcgtggtgaagggcacctgtaatcccagttactcaggaggctgaagcaggagagtcgcttgaaccccagaggtggaggttgcagtgagccgagatgtgccactgcactccagcctgggcgacagtgagagactccgtctcaaaagaaaaaaaaaaatcttagagataatgtccgatttccttttttgacagaagaaaattgagtctttaggggtcaagtaatttacccaagttcatatatgagaactgaaatcagaacctaattcaacctggccaggcgcggtggctcacgcctgtaatcccagcactttgggaggctgaggcaggcggatcacttgaggccaggagtttgagaccagcctggccaacatagtaaaaccccatttctactaaaacacacacacacacacacacacacacacacacacacacactcacaaaagcagccaggtatggtggtgtgttcctgtggtcccagctacttgggaggcagagacataagaactgcatgaaccaaggaggcagaggttgtagtgagctgagattgtgccacttcactccagcctggatgaaagagggagactctgtctcaaaaaaacccagaaaaaccaaacaaccccaacctctatcaacccacttcccaactcccaggttgctactcaaaaatctaactcagaggatgaacccaaatattttcggaaatagccagactcaggagctggacccccttaccttactgtcagtgatggctgcacacccttagctagtgccgaggtgtccacctccactgacatgacattgatcatgtgccccaaggaggtgcaagtagaaaatatgaacggatgggatttaaactggggtgtccacacacccatgcacgcctccagggagctcagcttgtgtgtcgaggattcgaaagtctctaagctggaaattattcatactcagcctgtccatgacattttgatgaagcccaagtcagaggtacaatgtggggacttttcacatttttacagctgccctagaggtgaggacagctgggccttggtttatctagtgacacaaagtgtgatgaggacatgtcctcttaacggaattttactaaatgagtgaggagaaaatatagacagaaatcccatgaaagactgttagccagggcattgactagtaaatgatgtgataggtaattatcgaacaagagaccctggcatcttccctgctgcagcacactgcagttaaaagagcaggcagcaaacatgtttcaggtcttcagtaaagaagttggagtgaagacctccagacaaggcacttgaggcctctgctgagggttgctgaaagagagattcagctattggggagcagcttttcagggttaaaataaaaaccagtgcaggcaaaaaatacaaacagacatttcttcagagaagatgtaggagtggtcaataagggcacacaaagatgcagcatcattagccaccagggaggcaccgccgagcctcatgaatgtgtctgggagcagctcctctcattgctgtgaatgcagtaactccgagctgccgtgcaaaggacctttagttaaagctgagttggaggctccaggtgcaggacatactaggctcagtgcattatgcaagtgacacagcacggtattgctttccaactgctaggacaaccatagtaaaaacagaaggaaagtagcaagtgttggcaaagatgcagaggaactggcatctgcatccattactggtgagattgtttgtggtgctgctgtgctggaaaacagcttgggagttcctcagtcagttaaatgtcgagttaccatgtaatatcctcgaataaacccaagagaattgaaaacacattgatacacagactcataaatgaatactcatagcagcattattcaaaatagccaaaaggtagaaaaaagcaaatgtccatcaactgataggtgaatttttaaaatgtgggatatacatgcagtgggatagtacttggctgaaagaggaaggatgtcctggcccatgccccagcatcagcatgggtgcacctgaggacattatgcttagggaaatgagccaggcacagatgccacacatggtgtgattccatttacaccaaacgtccagaagagactcctccatagagactgaaagcgaatgagcagtgtcagggtgggagggaggaacgggaacactgcaaagtctctttttgggtgatgcggatgttctggacttagtagtgatgtctcacaactctgaatacactaaaaactgctgatgtgggtgaattatctccataaagctgatattaaaaataatgcaggaacaaatatgaaatagggacctgggttggtcagtgtgaaaatgagagtcctgttttggctttacatttcagagatgtccagggctgtttaggaccttgaacctgagaccgaagggcatctttgtacccccagggctgtttaggaccttgaaaactgagactgaagggcatcttggtgcccccagctgacgatggaaatgtgactcttgctctgttttgctctcctttccttcagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggtgagccagccccgcttggtgtttcttgtttgctgactgtcctctgtccagcccctcccagtgacagacgcaccatgctcttcccacacgtggggtctgcacaccgcactcccccggggacgcgtggcaggaatggggcaccatgtagggaagggtcccttcggccctcataccctctctgtgctgggaaggagtatgtggtcatttcacgtcctgggaacgcagtggccagtgagaggcgggaggtgatcctgacagtgggatggagaaggcgctgctgagggtgtgaggacagtgaacacagcggccagtgggaggggaggtgatcctgagggtgtgaggacagggaacgcggcggccagggggaggaggagatgatcctgagggtgtgaggacagggaacgcggcggccggggggaggaggagatgatcctgagggtgtgaggacagtgaacacagtggccagtgggaggggaggtgatcctgagggtgtgaggacagggaacgcggcacccggggggaggaggagatgatcctgagggtgtgaggacagggaacgcggcggccagtgggaggaggagatgatcctgagggtgtgaggacagggaacgcggcggccgggggggaggaggagatgatcctgagggtctggggacagtgcgtgttcccttctcacttcttgttcatcccttccccagattttatgatttcacaattctactgctgaagctgatggatggggcgggcaacatggcttgcaggacgggtctggcccacagcttgtgtcgtccatatctgttttggaaaattgactctgaacacgttaagtccagtgtcctttgtcgctgaactcacctctccctgtggcccagcatgtgaccgtagcccatatttatggcggtttgccacatcctccgaagccccctgtctggatttcatgctgctcaccatgcactagctgaacagtgtcggcctcgagatgactgctctgccaagaccgtggcttccggtgtcgctacctgagttaagccacgtcagggcgggcccaggggagaagggcgtttgcaggttcctgcgactctttgtgatatggagaaggttccgacccatttatttcccaacagccttttcccaagaccatcctgcagtgggttctgataaaacatgacttcccttttggagataacaaatactaaaatttcacaaacattgcctgagcatcgcgttatgtgagcactctctgctccttaagtgaaggctgaatgggagccgctgagagcgagcatcagcttctctgctgtctgcagccgggagctctcctgccctcgctctttctttgttcatgcagccgttatggcagtttttaaatagaaggaatgtgaaattgcaattagagggaaggacgtgtgaccattaccgatgctttctccttgttcctctcttggaggagaaggacggcggaggaggccgatgctgcacttgagtgagtgctgctggagcattgatggtgctgtttgctacgggagctgcccgcctggagtggccactttccctccggcacctctccctctggggcgacgtctcctctgttctaagccatgctctactccgagaaaccccttttcttgatggccctgcctcctgcacttgcgtgggtactagacaccatcggggtcttcactgcctcctgcactttcatgggtactagacaccatcgggggtcttcactgcctcctgcactctttgtgtactagacaccatcaggggtcttcactgcctcctgcgctttcgtgggtactgaatgctatcaggggtcttcactgcctcttgtgggtactagacaccatcgggggtcttcactgcctcctgcactctcgtaggtcctggacgctatcagggggtcttcacttgcgaccttgggtccgtgtagctgccgagcttcctgttctcctccagctcagtgtggcctcagcccttggccacaggcggtgaatacatggctgaggtgaccttcagcttctcatctcagccttgccttgcccctccccggcaccggctgcccctctacctgcattctcccacctctatactccttctagtggggtcacgttgggtcgtcctcttccttctctaacctcccttttctctctcctatcccatctcccacagcttaaaaagccccattcacctctgtcctcattattgggaacagaaagcaataaacatcctcgcccccatcacagggagggaaacccagctggagagctgggtgagggtgagctcacagagagaataggacgcattcctgctctgcgtgccttccctacgcgcgcgctcccgctctgagccctccctacgcgcgcgctcccgctctgcgagcccttcctacgcgcgcgctcctgctctgcgtgtccttcctacgcaccctcctgctctgcgagcccttcttacgcgccactcctgctctgcgtgcccttcttacgcacgcgctcctgctctgcgtgcccttcctacgcacgcgctcttgctctgtgtgctcttcctacgcgtgcgctcttgctctgcgagcccttcctacgcgctcctgttctgtgtgcctttcttatgcaccggggagcttcacctccctgccttggcgccttctctttcctcccacaccccagggtgtggatcttcggaacaagcgtcctgaccgtgctctctccactctcccgtgatccctacgagttacacaatgtgcttggcattcttcctgagctaccctgcgatgctggtgatattctgataaaaactgacttccaaactgcactgtgcgctttagaaaagcctcatgtaaaacggcaaataggaaatacgcagagagaattgagaaccccatgcaggtatcacctatgaaatacacagagaatactgatcacctatgaaatatgcagagagaattgagaaccccgtacaggcgtcacctacgaaatatacagagaatattgagaaccccgtacaggcgtcacctatgaaatagaattgagaaccccgtacaggcgtcacctatgaaatagaattgagaacccggtacaggcatcacctatgaaatacacagagaatattgatcacctatgaaataagcagagagaattgagaacttcatacgggcgtcacctaagaaatatacagagaatattgagaaccccgtacaggcgccacctatgaaatatacagagaatattgagaaccccgtacaggcgtcacctatgaaatacacagagaatattgatcacctatgaaataagaagagagaattgagaaccccgtacaggtatcacctacaaaacacgcagagaatattgagaacccagtacaggcgtcacctatgaaacacgcagagaatattgagaaccccgtgcaggcgtcacctatgaaacacgcagagaatattgagaaccccgtacaggcgtcacctatgaagtagagagaattgagaaccccgtgcaggtatcacctatgaaacacacagagaatattgagaaccccgtacaggcgtcacctaagaaatagagagaattgagaacccggtataggcatcacctgtgaaatatacagagaatattgagaaccccgtacaggcatcacctgtctcccacaagtggtgactctcaggctttcctgatgctcctctgcgcccactacagccccctgctctgccctgggatgattctaaagcaaatccagacatcgaatgatttctgaagatgagaggccctagctagacagacattctcaacacacaaagagcaactgcacccgagcaggaagggaggaccctgcgataatgccagggaacagaaaacttctttacaggtcagagaacagggccaccctcctgtcgcacggtcgggtccaacatgagacccttgctgtttagtcttcagagagtgggagagaagacccacgcgtacctgctcccaaagaagcagtcagtcaacgaagctgcgggctgaacgcatatgacaaaagttcacctggtaaaagctttaaaaagagactctcttccttcacttattcataattcacatctggtctcctttcaaagagctttaaagcaggttcagtggaaggcctatctaaggtggggtgacggggaggacaacaggtgacgtgcaggacaacaggtgacgtgcagtggccggtgaaggaatttggggctcatctagttcagcgtctccagtttccccactcgagacctggcaaccatggaccttgttgctgtctccatagtttgccttttcctgaatgtcctggagttggaaccttacaatatgtggccttttcagatgggtcacatgccttgaagattcccccatcttttcatggctcgatggctcatttctctttagtgctgaatagtattgtattattacattataatccataacactcccattgtatagatgggccacagtttattcgcctactgaggaacatcttggttgcttccatgtattggcaattattcataaagctgccataagcaccctcatgcaggtttttgtgtgggtataagtctttaacttctactggttaagtaccaaggagtgtaatcactggatcacacagtaagagaatgtttggttttggaagcagccaccaaactgtcttccccagtggctgtggcattctgcattctgcgtgccaccagtggtgaatgagctgctgttgctccacatcctcgcctgcattgggtgttgtcaatgttctgggttccggcccttctgagaggtgtgtggtggtgtctcgttgtcattttcattcacatttccctgatgatggaggaagcagagcatcttcacatgcttgttttcatctgtgtatcttctgtggtgaggtgtctgtggtggtctctgggccatgttttaattaggctgtttgttttcttattgttgagtttgtaaagttcttgaatattttagatattggtcctttatcagatatcagatatcagatatgtcttttgtaatcattttctcccagtctgtggcttgtattttcattctcttgacagcgtcttttgcagagcattagtttttattttaatgaagtccagcttaccaattattttattcatggattttgcctttggtgttggattttaaaaagtcatcaccaaacccaaggtcatccagagtttctcctctcttacctttaaggagttttatggtttttcattttataatgaggtctgtgacccattctgagttagttgtgaaaggtgtaaggtctgcatctggaattgtttctgtacatgtggacatccagttgtccagcaccatttgttaagaggcgatcctttctccatagcatcacctttgctccttttcaaagctcggctgacctcatgtatgtggacccatgtctgggctctctgttctgtttcattgatctgtttgtctgtgtcatcaaccccaccctgcctggattcctgtggagttggagtgagtcgtaacaatgggtgtagtgcatcctaatgatgggtgctgttgtcctccgcctttgttcttcttcagtattgtgttggctgttatgggtcactcgcctctacatataaactttagaataaacttgcttgtatccaaaaaatgacttgctgggattttgactgggatttcattaaatccatagatcaagttggagaactgacatgctgacaatattgagtctttgggagccagtcataatcctgaaagacacaatcctgaatgccatagttctgaatgttaagatcctgaaatatcaaaatccctaaggtccctaaaatcctgaaaatcacagtctcaaaatatcaaaatcccaaaaatgtaattctggaaaaaattatttaaaagacatttatttacatttttaaaagggaatttatttgcaaaacatataaaatcgtgacaaaacacttcataggccattttacacaataaaataagcaataataacattcgtatttttgcagacataagccctcagatatcttgacgacagttgcatgggcatcacacttatgagcagatgaactgtgtttatgaagacataggtcaggaagggagatgtataaaagcatgtccctctgcttggtaattgtgtgcacccagctgtataactgcaggcatctgaaataccctgatgaacaacctaaggcttttgacaagatgagtcaaaaaccctgatgggtcactgctgcataaacagtcgaagagctgagatctcaagaaattgtatctttcgcaaatgcagatgtacaaaaaggacattcttcatttattgaggaagttgcagtgtttttgcattgagaaccagggaagctgatgatgtaactctcagtctgaagacccagggacggctggtgtgagtcctggagtccaaaggccgccaaacctggagctctgatgtccagggcagcagaaggaaagtctgccccagcactcagagggagcctaattcaccctctgtgtttgttttctctgggccccagctgtttggacagtgcccgcccaccaacactgaggcagaccttcccccagccctctcagactccaccccagtctccctggagacacctcccagaaacacccaaaatgaagctttactggatttctaggtattccttaacccagtcaagttgacacctaaaacgaagtctatggtttcaccccttgtcaacttggcactcacacacaactccttaagttatgcttaatttccaaataaagacaataacaagctaatagctccacccagcaggatgcaactctcctgtggttatgatttaggggattttaaacattagcaacactagacttttgggatttagactctatttagagattttgatattcagatatttggggattcactatttgggattatggcaattgggactgtatcttttgagattatgatccaaacccatgtcctgctagccatgagcatgtaatatttatacgctgcttctccatttctttacttttgctttctttcatcagtgctgtagttttttttcatatagatacggtacttgtgtaatgccatactttcagctcaagactctgatgacagcgaaagcgttttggaaatcactttaggagatgcatcagacaccgttttctaaatgaaccaatgacaaataatgtgtggggtgtccactgttgtaatccttgctcattgatcaaacaccagccacactgaacgggaaacaaaaccggtaaccaacctgttagaaccctttctttcatcatcttggttctgcgccctccagagcctggatgggaattacaagtccctaattcacatcatgatgactgacttttggttctgaatttcacattgcaacctcatcccaacatacctgatatttcttctattcaggtgtcttattatactatcgcttgtatggccaaggtaatcacgggtctccacccagccagcctctgtcctaagatggggcccgtggtgttcatgtgggaagtgcactcggaaactcatgtggaagctggaagaacttgtttctgctgccggccgtgcaactctccagccatgcaacgcttcgcgtggttattcccaagttcactcattcattcagaaagcacttgcgaagtcccggccaatcacacgggctcctgattctcccgagttcactcattcactcagaaagcacttgcgaagtcccggccaatcacacgggctcctgattctcccgcgttcactcattcattcaggaagcacttgcgaagtcccggccaatcacacgggctcctgattctcccgagttcactcattcactcagaaagcacttgcgaagtcccggccaatcacacgggctcctgattctcccgagttcactcattcactcagaaagcacttgcgaagtcccggccaatcacacgggctcctgattctcccgagttcactcattcattcagaaagcacttgcgaagtcccggccaatcacacgggctcctgattctcccgcgttcactcattcattcaggaagcacttgcgaagtcccggccaatcacacgggctcctgattctcccgagttcactcattcattcaggaagcacttgcgaagtcccggccaatcacacgggctcctgattctcccgagttcactcattcattcagaaagcacttgcgaagtcccggccaatcacacgggctcctgattctcccgagttcactcattcattcagaaagcacttgcgaagtcccggccaatcacacgggctcctgattctcctgagttcactcattcactcagaaagcacttgcgaagtcctggccaatcacatgggctcccagttctctcccctcatccaaaataagcgtgttctggtcctcttctccttcgagccttccgtgaccctgaggtcctgcgttggctggtggggtgcccacttccttgtcgtgttggtggtgggaatcccagcctgaaaaccctcacagagaagggcgtgttccccgcagcccagtctcaggagggcactgaaccaaagctttgacttttcacggtgacagcagtagattataacacagaaaaaactgatgccaatgcttctgtcactttggagaaaatatgcccacacttttggggtcattttcacttgaaaggaagcacctgctgccttttcgtttttgaagaaattcattcatatttgaatgcatcccagtgctgctcagtgctctaaacccaagcatgcctcttggcttaaaaaaaaaaaattagaagagaattggccacctaatcactggcacacagaggccgcctctcacaggctgctccaggaggaagccactgataaattgttaatctcggatccatgcccctggctggagttcacgagcaccctctaaagcaggaggagaaggcacctatgttatcaaagtgcctttcatcctagcgaaacagtcccgggctcagtgtgcactgcctgaggcctttcttcctgtgtgtcagcacaccgtggagtcagcagcagcgcactctctcccaggggagcaggcgcaggagagggcacccggggtgctgggggggtcactctgtggcttatatagcgggaacagggttcctctcactgcaccttgaggacacacccacctgctcagcaaccctgacgtggatgcgcccagtgcggggtggcagcggccgtgtgtggctggcagcctcggacctgcgtgtggctggcagtcccggacctgcactgctcggctccacccagctcatgtcttctcccagtgggaggaggctccccgacttctgtactagtgcagagtcactgctttcagatttgggagaagtaagagtcataaactgcccccatgtgagaaatctcttccccggtgtttggctgatgtccttacagactctgcttaaacacctctgaggtcactgctttcctgccaggtccatgctgctgtaagccagctgcatttgctggaaagatttttactttgagaattgggttgaaatttgcctctgtctgactaggaattggtagggcacctaaaggcacctcactgccactgcccaacccctgaggttttcctcccaccaccttctgccatggctccaagggggaggccttccagagccacatggaacaggggtgctctctgctgtgttagcacaatgggggggccttccagagccacatggaacaggcgtgctgtccgctgtgtaagcacaatggggaggccttccagagctacatggaacgggggtgctgtccgctgtgtaagcacaatgggtaggcctttcagagccacatggaacaggggtgctctccactgtgttagcacaatggggaggccttccagagccacatggtacaggggtgctgtccactgtgttagcacaatggggaggccttccagagccacatggaacaggggtgctctccgctgtataagcatcctctgcatatgatgtcatccttcctgtcacttttccaaatctccccagttccaacctgaacgctggtggttaatggagaccgctgattacatggtgatgcttccgctctgagggcacagggcaggtgtagggaaggcactgggggagcctttccccttcccacgggtgagtgcgtcacaggctggaactgggggctcgaagccccagggcgttctatgcagcagttggtttgctttgggtctgatcatgccgagcgtctgactgcagctatgtgttcacctgccctctccaccggcatttctagaacttttcgaggtaactgttcccattacgagggcgtttctgcagatgtcggcttagctcatttagcgaatgtgggcagctccgaagtcccaaccctccgacatctgtaaaacattttctcttctggtcttacctgccacccagtccatggtgagctgcgttacctgtcgtccgtcagttcacgttctgagtgtgcaaactcacactaacatgaacctaaaggaagcagtctttagaaagccatttgactgccaatccccacaccccactgaagtcatgtcattaatgccagagctaattggatatatttttttcttctttgcctcagtattgcattcaatagagaaagtgtcagactgggtgaatgctgagccctgtgagtgcaaaatattgcggcatgacagtgcaggagaagcttcatcccaggctgcagcatgggcacttttcattagtcagggagagatgcacactactcagctgtgattccttaccccctcatattggaagcagaatatattttactacacttgtgttgtttccagtgaaaatagacaacatgctggcatatgattatgtcagtttctccctgtggaagcccaaatgaggagagaatgcgataatgagctcctactgaatttacctgaatcctctgcaaatacccaagttttggaccccagcaattaaatgggctatatgtcctctaaaccaaaggagcacagtccattccccatgatggtgggtgatggtgatgatggtggtgatgatgatggtgttgatgatgatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtggcgtgagtatggggtgtcattgagggggaaagtacgtgtggcgtgagtatggggtgtcagtgagggggaatgacacgtggcgtgaggtggggtgtcattgagggggaaagacacgtggcgtgagatggggtgtcagtgagggggaaagacgtgtggcgtgagatggggtgtcagtgagggggaatgtcacgtggcgtgaggtggggtgtcattgagggggaaagacacgtggcgtgagatggggtgtcattgagggggaaagacgtgtggcgtgagatggggtgtcattgagggggaaagacgtgtggcgtgagatggggtgtcagtgagggggaaagacacgtggcgtgagatggggtgtcattgaaggggaaagacacgtggcgtgagatggggtgtcattgaggaggaaagacacgtggcgtgagatggggtgtcagtgagggggaaagacacgtggtatgagatggggtgtcagtgagagggaaagacacgtggcgtgagatgggatgtcattgagggggaaagacgtgtggcgtgagatggggtgtcattgaaggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgaaggggaaagacacgtggcgtgagatggggtgtcattgagggggaagacacgtggcgtgagatggggtgtcggtgagggggaaagacacgtggcatgagatggggtgtcattgagggggaaagacacgtggcgtgagatggggtgtcattcagtctcttcacaggatcttaatggtgtattttccctgtaaactgtttgcttgttctatccattggtcaagtctctctggcctccaaaacattttagtgtgtctgtgctggtgtgagaacaatgttgtagccctcaagaaaatgaagcttttaattttctattgtttcttttttctttctttttttttttttttgaggcagagtctcgctctgtcgcccaggctggagtgcagtggcgcgatctcagctcactactagctccgcctcctgggttcacaccattcttctgcctcaggctcctgagtagctgggactacaggcgcccgccaccacgcctggctaattttttgtatttttagtagagatggggtttcaccatgttagtcaggatggtcttgatctcctgacctcgtgatccgcatgcctcagcgtcccaaagtgctgggattacaggtgtgagccaccaagcccagcctattatttcttagaataatgtttgttcccaggctttgatcacaatagatgcccaatacaggttggtgcaatcattgggtaggttagtgggtggagggatggacggagactgggctttgactttaatgagaggttcatatttttttaaatataggttaacattttggttaatattttggcagaaaatagtttcaaaatgcataatcttgaattagatcttgagcaagttggaaggtgcctgtcagcttgtgtgactgagcatctaaggggctctctgactgtgttcctcacttctcacctgaggatcacaatgagctgtggcgagagcttctcatggagaaccaagtatttgttttcagaatggatggaaagggggaaaagagtggaaaactaaaatgatttctcatcctctccttgtttcatgataatagttataatttattaagcacttacagtatgctgggcccatgcctcacttgtcaccattttacagatatggaaactgaggcatgaagaaatgagcgagcttgccccaaaccacagaccatgagcgctggggccaagactccgggagcatggtcagcctttcttcatgggagtccagcctggcatcccccagggcagggcagcacaaggatggatgatcggattgatgggaactttaaatgtgtctaaggtcctagctgcaatgatggaaaaagaaatgtgagctaacaccctacagattctagaataatcaggcctgagaaagtgtgcaggcagctgcagccacggcaggggagcccctgttggttcagtactggcagctccacgccaagcctggccgcgtctggccagggtgctctggctttcccgccgtgcctgatggcctttctgctcacgttgccatttcttcctcccttcctggtccaccatggagcctcagtttctcaagggtggatgcctgccagttccccaaactctacattcccagctgctctctgtcgatacaagtaggctgttcatatggttgagtgtggcgctcactgtaccacgctgtaccgggcactgccgccccttctcacgatgatgtgagggaagtcttgccaagccgtggtattctggaaccttctcaccgtgatgtgagggaaaccttgccaagctgtggtattctggaaccttctcgcgatgatgtgagggaagtcttgccaagccgtggtattctggaaccttctcaccgtgatgtgagggaaaccttgccgagctgtggtattctggaaccttctcacgatgatgtgagggaagtcttgccgagccgtggtattctggaaccttctcgcgatgatgtgagggaaaccttgccgagccgtggtattctggaaccttctcgcgatgatgtgagggaaaccttgccgagccgtggtattctggaaccttctcgcgatgatgtgagggaagtcttgccgagccgtggtattctggaaccttcttgcgatgatgtgagggaagtcttgccgagccgtggcattctggagacgtggcttgctgttcagttcctccttcagagcaggcacttggcctctgtgtgggtttgagaggggaataagcatcattttgcaaagttcagggtgggtcgacacacctgtctttgtgttaagcaggactcatcagtgttgacagtgacggtgtttgctgttagaaacacagaccgcagcctcttccctcggggtggtgggagaagcgccagcctgccctggagggagagggtgagcgctccaccccgggatgcctgctgatgtcccccttctccttccccttccccttccccttctctcgctctatcgcccaggctggagtgcagtggcacaatcttagctcactgcaacctccacccccaaggttcaagcaattctcctggtttagtctcctgcatagctgggattacaggcgcctgacaccatgcccagctaatttttggtatttttagtagagatggagtttcactatattgctcaggctggtctccaactcctaggctcaagaaatccgcccaccttggcctcccaaagtgctgggattacgggtgtgagccaccgcgtccggctgatgtctgctttctctttcttttggcattttcctgctggcaacactgtagccactctgaattgaataccctggcctgtgcacatcatttttataaaccttggggggctcagaaaagtttatttgtggatcagtatggcaaaacatgattcattttcactggaaatgccgaattcgagaacatttaaccttctttattgagaagtcacatgatttttattctctcaccatttgtcaaaatatcacaaccagcttttcagcccccttaggaaacacagggccttgcagaagaacggttaatggaactctgtcccaaacttgtccccgcacggaccacgtcaccttctctggagctgcagtggggtcgtctgggcaggtggtggcccggggctgcagtcctggggagctccggctgcgggggggacggtggccactctgctgcctgggagctcaggaaggcggtgtctacagatgcaggtggaggctcccaggccttgtggtgcctgctgtgccaagctagtgtgtggagagtccttttgtccttttgggagggcagaagggatctttggacttggaagtgaattgttctaccacacttggaggccctgccacttcctgcgaatcgtgacatcagaaataatggactttgccccagacgaggcctctggtcaggtcgttactctggggccctcctgccccactcacctgatgaggaggccgctgggcagccgagcctgtgttcattggttcgtgtccacaggaaggacctttccttagcaaccaccactcattcctcacctccctgtttctttccctccgatgaaattccatcacggggactggtgtccaccgtgagctatggccgggccgactctgacacacatcttggctagtgcaggcatgtgtggagacatccctcgcctcctaagcacggaggacgccgactgctggggacagccatgcccaatgccgagggcccttcaggtctccctgcagctgtgccggttcctgccgcaggctccggtgcctcctgccagttctctggggctgttagttttctgggctccgcctggtggagcccgggacccttcagaactcaggctcttgcctgtggccgcctacttttccagacacagctcttcctcccgatccctgcacttccttatttccattttctttgggatgagtgagccctttgttgccagcattggacctgtggacgtggacgagcgagataagactgtcgcgatgataatcgctgggaaagaaaaagatctgtggtgggaggagactgcagtgaatgagaatgaaaaggttgctctgggctcgtggctcggtggctcggttgcgaggctgagatggctcttctgattctgaaagctgcaatgagcagcacattttcaaaacagcaccgagggctgtggtatacacgcacctttaattccggagcacatcttttatcttctctgtgaaacaacgtgagcctgtcagcgtggaaggagctggggcatgggtgccgttgacctgggactgtccagcccttcagccctttgtcacctgcagacaggagtagcggtgaaggcaggctttgctgcggttttaggcatgtttttgtttgtgagaaagtgagatgtattttcctgagtttgttgctggaagctttctttgaaggtagcattccatcagtgaatgcatggtgagggctgatgtgtgggggttggtgggccctgggggtgtggcgaagggaggctggccctcccctccaaggctcaaggctaatgaaaaaacagaagagtacgcggcctccatgccaatccctgcgtttcccttcttctgttttaaacggcaggtttcattatgatttaggacggcaagcccgagagatctgggtacagctgctgttgaaacaacagtttgttacttacagattttgagaggagggggcaggccacgccatgggtcgatacagggatgcgccagcgtcagtccggaggctgggcgagggcaaggcagggtcgtcagggacaggactgcccagcttgaatagttccagccgctccggggccaggggctgcccgtgtctggtccttgccccagggtgactagggcagcggcctggagtctgagcccacagaggcggaggcgggcgtgggctccggatcgcagggtttgcatgtggaaagcctgcgtggagtgggtgactgttcactatctgggaattggctgttcgtgggaggggcagcccccagggtcagcagggccccagatgtcagagcatcagaaatgtggggttaatacggacacttcaacccgaaggtaaagaagccgccactgtctgccgaacaattcagaggcctcaacgtcggccagagcggggcactcggccaccccagcaggggacatcggtggcagtgaacgcccagcacgctccgatcagaacgcccgtgtccgtcacacatttcgtgtacagattgactttaaaggactctgtccgcttcatcccatgctaaactacacataatgctgtctcagaaatgcctgtcatggacgttcaggcctttacatcagagggtcttagtcatcaacagcaagtctggagtggcgctgacaggactcaggttttcaaaggggaaaatcagagggtcatggctgtgaccctttccatgcgagaccctggtgggggatggggtgcagcagagagtgttcagaaatgaagcaaaacacttcaaaaaatgtgtccttacagccgtgtagcaagacgccccctgaagaaccagcttcaattaatgggcaagagagactgcacttaaaaaattttcactcaaagaacccaccacaggccatcggcacttgtgtttggaaagtcatgcgagtctaggcggccccagacactgactcctgtcctgcgtatgcagtgaacggggcacgtggggaccgggtgccggccccgctgcctcggcatggactagacacagcctgcgctgtggagagaggacgggacgtgcggctgagtgaacgggggtgccacaggcagtgccactgtcgagccctgtgcagacactgcaggctgcagcccaggcctggtgatgcatttgacgcagacaaaaaacctaaaatgcctacatttcttaatttgtaaaaagcagaaataattcctccgcttctattgtagaggattgtgccgagatccctctagggcagagggtcgcagtgggatccctctagggcagaaggttgcggcgggacctgtctagggtggagggtcgtggtgagacccctctagcgtggagggtggcagcgggacccccctacagtggagggtcgtggtgagaccccactgaggtcaggacattctgtgtcccctctgcgtcactctgccggtgtcgttcgggaaggtagagacgtggccatgagctattttacataaacctttatgaggacagagatttcaacactgaatacaaaagaaagtcaggttttccttcaaagctcggaaatgggcccatgaaccttctttagggcagagtctttattgctgctgttgagggggagtatacacacggcgagatgcgcagaccgcaggtggacacgatgacgcgttggacgcatgtgggcctggaaccagcggccacgctgcacggcacaccctcacacccgacgcttcctcctgccccagccccacctgcaggtgatgcggctctggttgccctgggcagacctcgcccatccttgaacttcatcttctgttaacaggattctgtggattctctggtgaccggcttctctcactcagcctgactggttctaggtctgtcccccttctcgtctctgtggttccttctggctcagtgctggtgtggatgtggcctccttatccgctctcctgctgccgggcacatggactttagactctgtctgtggaactatgaggagtcaggctgctacccacagtctcatttaactctcatggttacgggtttcacttctctcgggtaaatacttacgagtccaatttctgggtaatacggaagatgtccttttggaaaagactttcctttctctgttgaaacgccctggcgcctttgaaacagtctcctcggagttgtcactgtgccacttcctggacgcggtgaggaggcttcagctccctctagcctcttgtgccatccagttcatgcctgcagctgttttatgaaccctaccttaaagtggtaataatttttccttgctaacaatcagttgttttttagataaagtaagaggagaaaagaagacggtctttcttgtttatgtaaccacatatttaccctttcaggagctttttggctcctcccgcagctctgggcttctgtgtggtggtgtttctcttcagcctgtgtgcaggcccacagggacccactggctcagctttgttcacatacgtgatatgaaaatgtctctcctttaccctctcgtttgaaggatattgtcattggatataaactcctggattgaatgatttttctttcaacccttcaaatgtggcattcattatctgtaacgtcaaatgcctgactctgcacattgtatgaaatacgttgttcttacaggacatgcagggtgtctggcggcctctgcgctcctgggaccctttccattctcatgtgtggagcgtgtcttccccccgccccgcccccgctgctttccaggaatcttctccatctctgacttgcagtagctcagctgaagtcatggcgtggttctccttgcattttattatcgtggaacttagtgactgtcttgagtccctgagtgacaatccttcccagatttgagagacttgtgggctttctttcaggtgtttctggttcctttcccgcccccccgtgccctcctgactccgacggcttggatgccccaggggtgactgaggttctgcagaacgtctcccattctgttcttccaacgatgatcgcttctatgatctgtcttcagattcacaaaccgtttcttccgttatgtccacccgtaatggacataaattttaaatttcagacgccgtgctcttcacttacagaatgtgtgttggattctgttttaatttccccactctgctgagcagcgggtgcacacatctctccgtggttatggcagctccacaaatggccttgtctcctggctctaatcatcgactgccctattctcaatttcgggttctgtttttctgcctcctcctgcatctgttgctgcttgtgtgaagtgggggcctagaccctgccaccttcctttaaggggcttttccggcagcagttactttcttggacgaggctttgaccctgtgtggctgtgtttagatgtaattagagttggtccatgctgggcagggtgtgctgggcagggtgtgctgggcagggtgtgctgggcagggtgtcctgggcagggcgctgtccttgccaggcattgtttctccttctgccaagtgagggggacacagctcatcccattcttttatcctctggaggacatggtgaagttgcctagcccatctctcttcctggcttggtcattccagtgttttctggaagctgtgctttccatcctcctgagcgcgtggatgagtctgtccttccattctgtgggttttccacctctggggaactgaactagtgatggttacagggtcaggtggatttgagattcaagtccaatatcccaatcttctctgagcactggcctgcgcctggccctaggtggccactgccttgggacgccgcagacgcccaccacacccctatggtctggaggccctcacctttgcattcgtccacccacaacgtccttgtgtttgtgtgtgtgcccctaggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccaggtgactgcagcgccatgggtgcccacacccaggggtgctgcggggaggggaggcctcagggctgtgcagagactgctggctcaccaagtgcaatgtgggctttctgctggggagatggggatctgtattaatgatttttatctgtttgaacttttgcctctaaaagctttcttaacagactaagcctaccagagcaattatgttgaatggcaaattgctctctgcgaggaggtttcactcctccatgctgaggctgagtcaggaaaacaggcgtgatgggaagtgttgtgtttggactgtgtaccggtgaatattgtcaaatatttgaatagcagagtgagaggggatcattcaaatgtctgcttggggcgtgcattggtcctctgaggctgctggggaagcagaaggcagcccctcagcaccactaccccggcaggcatccggagccctgtggaggccccatgggtcagccaggacttctgcagcctgatggcttctcacagcgtggagctgcaagaaagcacctagctcagctccccacacatggcagccccacaagtacgtgctgaaaaccaaatgacagacgtgcccctctctctgcacgggtgcagagggggccttgctggaagctggaagcctgacttggctgacaggcagggtgcaggggagtagtggaactgcaccccgggagggcctgtgttaggtggtcgcccagtggttgaaggaatcgggacccgcaccatggctaggagggatgcaggaggccctggtgtgcgtgctgtctccaggggcactgttcaggtgccatgagtcacgcacctttgggcactgaaagtaggatattaattaatttatttattattttattttattttttgagatggagtctctctctgtcacccaggctggagtgcggtgacgtgatctcggctcactgcaaactttgcctgccgggttcaagtgattctcatgcctcagcctcccaagtagctgggattacaggtgtgcactaccacgcccagctaattttttgtatttttagtagagacggggtttcgcctgttggccaggctgatctccaactcctgacctcatgatccgcccaccttggcctcccaaagtgctgggattacaggcgtgagccaccgcgcccagccggggtacctatttagagagaaacgctgaccacagtgaaataacctaagtcagtggattctgaagccatcttaattgtgaggtggttttggcgaaggcttcactttgctttttcatgacgtgaactgctcggtacgatggggtttttttttgccgtgagttaactttgtcgatcacgtgagacccccagagctgggtgaggtcattgtggctgccttcacgtctaccatttagctcctcagtcccctccgctctcgcgaagtttacagaatgccattttgtgctataaacagaaaaggtttactctatggcaggacttaggccagcgtcatcacacctcacctttcgtatggaggggtctgcagggtcaccctttttatgtctgtggcaccctgtgatgacattcttgatgagggtcttggtaacactggtgtcttttacagatgacggagtgcaggacgacgatgatagactttaccaagaggtaagatgacgtctctggtgtttgtttcatgttaaatgtggaagttggtgatctttttgttcatggtgtgggaacatttatgaaatacaaaagtttttttcccagaaaattatggagaaacccctcataatctccaaattgaaaaacagtataaagagaacatacaaaagtgtgtatatttggatacgaaatatctcttttcaaattataacctaatttatccatggtagaaatatgaaagtcgtggtaaatgcaaagaagaaaattaatttttcctggaatttcccagccaggattatcacacggcagcctgtgcccactttgcacatttgatgcctcctgcatgtgcggattcctgaggggttcagctcactcacacctggctgtcccgtgtggcacctctggccacatgtggccatctaaacctatatttaaattgaataaaattaaataaatgaaagatgcagtgccttggccgcactgggttcaggtcggcggcacgttagtcgcatgtggctcagggccaaggcgctggatgccacaggaagaggacggtccaccatcccagagcccccgtgggcactgctgctccggaggcagtcagaagaagggcccagtcgcaggcgatgtccacgagctagacactggccttccctgttaagtcttttagcctcttagtttctctccctttaagaacctttggtcgtgaatacaaggccgaaggatgaagaaccgttctaagcaacagcagtgacattgcatggttctgggaaacccagttttgggggtggagaaagaagagtctttggttagtcattctctcctcagattctcttactggttagtggttccatgcctgttggcaagtgcaggaagaaaacatcagcagttctggttttgaatatccatcagaaatgatgggacctgctgtctgagctgtggagggagaagtggggctgagaaacacatttcctaatttagggagtcggggagacccagccctcccacctgaggggcagggagcgctctggggggctgccgttagcctaagactccctgacttttagaccacaggcttttcatcctccatgcgtggaattctgactcagttctctgttgtttggggtgtattttcaagcaattctgtttctcaaaaagggtatgtgagtgttgtattttctgacttcttatttatttaaaaacatctttctttttcttctcacatgaaacacaatttaagtgacaatattatgctttttcctagctctgtttagtaacgtcaacggctacatcctattgtcattgaggatccaaatttgagcagtgtttttatcacactactattttgtttaaattttaaaaaatacaaaaggaaaagttgtaatttgtagccaaaatgggaataattgcctctatagtccttccttaattttcttaaaagtgtgttttggcaaagtgagttgtaaagtgaatcagattttcctgtttacatctaatataatattgaagatataatttcatggttggaaaaaaaccctgccaagtagacataagacttttggcatcacatgcaccaggaggtgtccgtgggttgcctggtatgtgccagtggcaggagcagacccggtctttcctaggaagcagtgtagggtgcctgggagggcagtgcggcccaggggtggagatcatgtctttgatggcccttagacctgagttccaattctggatctgataatcacgacttttgtgatctggtaccaataatttgatatttaacctctgtaaactccagagtctacaaattaaaggtgaaactcaccctttatttatggggttggagtagtaattacatgagaacccacacaaagcaaatctgtacccggtgcatagtcagcagaggtgccagggggttccgagggatggcttgtccaggaaaaggggatccggctgggagactgtagcccgtgtgaggaccacagatccctcaggtatcgttagaatcaattacacatccctgtgatgtgcccacttgtgggttaatcgctttgtgcctccgtctccccttctgtgaactggggttactgagggtgccccacccacaggcttacgtgaggactcagtgtgttcatgcagataacgcatttagtacagtgcctttgtgtgctggaagagctcagtcgttgcaaatttgttattattattattattatttagtgttcattgcttctagagggctggggtgggatcttgatatcacacagtttatttttaaaaatatcaatgccaaagacctacacaaactctacaaaatctgattcttcagagaggtgtgtgtgtgagcatgtgtgtgagagggagcgggagggaggagaaaacagcacgtaagtgattcggatactcagcgccctcacacctcatgctcggctagacatcattctaaatatagactgcacacacttcgccttcctcccacactctccttccaggctgcccatgtcatccccacagtgactctgtcccgggcagcccttgattgcatgtgtcacatcagcattcctttcgcagacgtccctcacggaatgtcctctctgtcaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagagtgagtagcagccctggctaagctcctgtgtgccgagggagggcttgtcccagcaggctggaggtggggcgcctccttgctgtggcggatgcatacgcttttaagtgtcttcaactgaataatggggtgcaggcctccctggagtctcaggcgcggagggcagcccaggtgcctggacagtggctcctcctgatgcttctgagctgggctccagagctggagagccgttctttgaagggcatcaaacaaaaccaaaccaagcaaatcccttcctgggtttttggtcctgactggtcacctgcaggccgcgcctctctgcgggtcagaatcaccttcagcggcggccaggcagggtggggtctcggggcaggtaagtgtacagcaaagcctgagcacggcccgcgcgggaatgcgggatgggacgcggccctggaaactgctgcaccccggactcctcctgcctgttaggaaggactccaggtgctttatctgttttgcaccaaagtggcccaaatatcctggcgtgggcgcccttcagaaggaagaaggggcttcacagcagcgagcctctttccccgccctcatgtcgatctgaacttaacgagtctcagaattcagacatcacgggcccagcaaggcacaagtggctggcccgttctcaggtcaccccgttaatgaatctgacatttgatgctttgctttgtacaagtgttgtgttttcttcaagtgatagaattggtgtttcaaagagaaggacgtgtctgcctggatgtacacacacccacacgtttgtatgtgtgtgtatatgagtgtatgttgggtaggtgtgtgtgtgtatgagtgtgtatgttgggtagatgtgtgtgtatctgcatacgcatgtgtgtgtatatgagtgtgtgttgggtagatgtgtatgtgcgtgtgtgtatagtgtatgttgggtaaatgtgtatctgtgcgtatgtatatgaatgtgtgttgggtagatgtgtgtgtatctgtgtgtatatgagtgtgtagggtagatgtgtatctgcatctgtgtatatgagtgtgtatgttgggtagacatgtatctgtgcatatgcatgtgtctatatgagtgttggatagatgtctgtgtatgcatgtgtgtgtatatgagtgtacgttgggtaaatgtgtgtgcatctgtatgtgcatgtgcgtgcgtgtgtgtatacgagtgtgtgttgtgtcgatatgtttgtgcatatgtatgtgtgtatgagtgtgtgtcgggtagatgtgtattggtttgtgcttatttgcatgtgtgtgtatgagtgtatgtcgggtagatgtgtattggtttgtgcttatttgcatgtgtgtgtatgagtgtgtatgtcgggtagatgtgtatcagtttgtgcgtgtgtgtgtgtatgagtgtgtatgtcgggtagatgtgttatccgtatgatgtgcatctgttcgggtatttcgttgtgtgtatctgtgcgtgtgtgtgtatatgtgtgtgtgtttggtagatgtgtatctgtgtatgtacgtgtgtgtgtatgtgtgttggataggtgtgtgtatctgtgcatatgtgcgtgtgtgtgtgtgtcaggtagatgtgtatcggtttgtgcatatttgtgtgtgtatgagtgtatatgtcatagatgtgtatctatgcatatttacatgtgtgtgagtgtgtgtgttgggtagatgtgtatctgtgcgtatttgcatgtgtgtgtatgtgtgtcgggtagatgtgtattggtttgtgtatatgcccatgtgtgtgtatgtcaggtagatgtgtatcagtttgtaggtatttgtgtgtgtgtgtgttgggtagatgtgtgtatttgcgtatttgtgtgtgtgtgtatgagtgtgtatgtcgggtagatgtgtatcggtttgtgcgtatgtgcatgtgtgtgtatgagtgtgttgggtagatgtgtgtgtatctgtgcatatttgcatgtgtgtatgagtgtgtgtcgggtagatgtgtatcggtttgtgtgtatgtgcatgtgtgtatgagtgtgtatgtcgggtagatgtgtattggtttgtatgttcgtgtgtgtgtatgagtgtgtatgtcgggtagctgtgtatcagtttgtatgtacccgtgtgtgtgtatgagtgtgtgtgtcgggtagatgtgtattggtttgtgtgtataagtgtgtgtgtatgagtgcgtgtgtcaggtagatgtgtttcagtttgtatgttcgtgtgtgtgttgggtagatgtgtattggtttgtatatacgtgtgtgtatgagtgtgtgtgtcgggtagatgtgtattggtttgtgcaaatgtgcatgtgtatgagtgtgtatgtggggtagatgtgtatttttatgatgtgcatctgttcaggtatttgtgtctatgcatatttgcgtgtgtatgtatgtgtgtttgttgggtgtgtgtgtatgtacgtgtgtgtatatgagtgtgtatgtcaggtagatgtgtattggtatgatgtgcatcttcgggtatttgtgtgtgtatgtgtgtatgtgcgtatgagtgtgtgtttggtagatgtgtatctgtgtatgtgcgtgtgtgtataagtgtgtgtgttgggcaggtgtctgtatgtacgtgtgtgtataagtgtgtgtatatgagtatgtcaggtagtgtgtcgatttctgcatatgtgtgtttgtgtatatgtgtgtgttgggtagatgtgtcagtttgtgcatatgcatgtgtgtgtatgagtgtgtgtgtcggtagatgtgtatcggtttgtgcgtatatgcatgcgtgtatatgagtgtgtgtgttgggtagatgtgtgtgtatgtacgtgtgtgtatgtgtgtgtgttgggtagatgagtattggtttgtgcatatgtgcatgtatgtatatgagtatgtcaggtagatgtgtattggtttgtgcgtatgtgcatgtgtgtatatgagtgtgtgttgggtagatgtgtgtgtctgtatgtacgtgtgtgtgtatgagtcaggtagatgtgtattggtttgtgcatatgtgcatatgagtgtgtatgtagggtagatgtgtattggtttgtgcatatgtgcatgtgtgtatatgagtgtatgtggggtagatgtgtgtatctgtatgtacgtgtgtgtgtatgagtgtgtgtgttgggtagaagtttgtgcatatgtgcatgtgtgtatatgagtgtgttgggtagatgtgtatctgtatgtacgtgtgtgtgtgagtgtgtatgagtgtgtgtgttgggtagaagtgtgtgcatatgtgcatgtgtgtatatgagtgtgtgtgtcgggtagatgtgtatcagtatgatgtgcgtctgttcgggtatttcttccttggtgaagaagtacctcttattttgaggatcattcgcactggaggtgggagctgcatgacagctagaacccatctgtcctgcgggctctgcgagcctcgcagtgctcgggctggtgctgtcgctgtgctgcagatgctacatttcatcagggagaattagctgcatatcataattgggcagaaatattttatcttgagctcaaaccgcagagtgtgtatcaaagccaaattaaaatttaagatgattttcagctgtaggtgattatcttagttgtatctttaggtaagttgtaagcagcagaaacttgaagcttacactaaaatatggactccattttctcaagactgctttacataagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacagtgtgttgtatatgtggcgtgtgtggcacatagtgtgttgcacggtgtggtgtgtgttgtaggtgtggtgtggggtatgttgtgtgtgtgtgtgtgtgtttggaagcctgtgtctcctcactctgtgctggagccctcttttctcctgaaggcccccatgttgtgttcgtggacactgtgtgtttccctgcaggtgtcctggggacttgagccacccttgcagggggacggccgcccatccctgccccggggtaggagagtgccccagagaaccagtgatctggtcattttaagggctttccaaatggatgccgaggtgttcacccggagagcaggaggccggtgtggtttgctagggaaccttcagagccgacaatcctgtgccattgctgctaatgggctcaccctggagggaaggacaggagggcccctgtctgcagcagcctcgcactttctggggaaggagacctatcacattgggtcatttcctgtctgtgcttgtgactttccagtagaaaaaagctagggcttttctttgcattcgagtttattttcttgtagtgggtttgccggccatgccttttggactggaatatttacctcctatgagcagtgggttaaagaaaaaaaaaatcatcatgttatcttggctgacttcttttcttttcctttgcgacttcaactggttggaagctatctggtgaagacagcacagctttttgtcagcaatttgtactgcttgagcaaggtgtgatgcactaggtgaggtctcctctcttcttgcaaggagattgaggtttttgccctattatcagactaataatttgtgattctcttgggcaagttttcaccagatttcagcttaaaccttaacagatcagctattaatttccaagacacagatggcattctttaaaaaagggggacttttgtacatttggttgtcccacagaaaggagaggaatgtggtttagaactcggtgtcacctcagcatccacatgctcttggtgctgaggttcagatgggaggatggtagggctcggcttttccaggcatgattttctctctcacattttctgatggacacagtaatcctttgccatttacatttttatcctttttacaaactagagggattcttgaagactggacgaagggcaggacagccgccccagtcctccaaggacaactttaaaatgatttcatgttaggtttccagaaggaatcacaggacggacaccaggtatagggaggagggagccccttacctctcagcaaagaggaacctgccttctaaatccagaggcaagagcttcagagaccacggctcacacacacatgcctctctctgcctaccccagaccccactggattgggatgtattctgcggaacgaccacgctgagccagtgaggtggattttggggaagtgaaacctgtagtcaggaaaacatgggagctgaggcagaggcttgagtctggggtggcggccacagtgctgttggagaaggtggcctgggcccttgacccacggaagtccggcatccagggtcagggtcccacggcagccccgagacctagaatgtggcaaacgcccctgtgcttgggtttcctggtctctggagtggcagccgcagtgtgtggctcctggactgtggagagatgaacggggctcaggtggagcagagcccgggccacgtgcagaggatgcagggcgcaagcagaggaggacgcagggtgcacgcagaggaggacgcagggcacaggtgcacggatgagcagcctctgtcagcagtgggaagaacacagtgttgcttgaaagaggaggagccaatggatttccacgaggggaagctggagaggttggagccctgagtcttgcggggaggccggctgagggaagaatgtgcaaaaagtggcatggggcggcgttgacctctccgatgcctctcaatgctaacaagggagacagctgcagctgaaatgtttcttccttcaagtgtttcttatgacaaaactttcttgcacctcggagaaggcaagcagcaaaatggcagatggtaccgggccaccgttaggggctgctgcgtgctcacctctgtgggggttcagttggaatgtggaattcagagaggccagtgaaggcagggatccgccggccagggagaggaactttggaaccagaagtctggaaggaggtgggggcttcggtctctccatctgccaccctcagtgagtgccctggccctgcaggttcccccagccccttcctcggctcactgtgagatgtgaaatgtgaaacccaccgagtgctcaggaaccactgcccgctctccgggggctggtgtggcggagaggaagttccgccgcccgctgtcctgggggctggtgtggtggagaggaagttccgccgcccgctctccgggggctggtgtggcggagaggaagttccgccgcccgctgtcctgggggctggtgtggcggagaggaagttccgccgcccgctctccgggggctggtgtggcggagaggaagttccgccgcccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctctccggggatggtgtggcggagaggaagttccgccgcccgctgtcctgggggctggtgtggcggagaggaagttccgccgcccgctgtcctgggggctggtgtggcggagaggaagttccgccgcccgctctccggggatggtgtggcggagaggaagttccgccgccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctctccggggctggtgtggtggagaggaagttccaatcctagtggctgcccaggaggcctcaccgctcaggagcccctcaggggttcagcgagaagagcgcatcacgagaaccagcagggtgccaggacggggtgcagccgaggtccggactgatgcttcctgctcgtccttccttgttagagtaaaggaaaccctgaggatgctgaagatggattctgtgtttctggcgccagggcagatttcaggggttctgttttgttcttcagcctccacgctgtgttgtgacttcctgttcagaaagcgcagtcctcacctctgtagaggcccctcctgagggcggacatgccctgccttgtcacttgctcctctttgctttgtggtcttaaaagaatatctgtagcatgatggatttattatcatttaagaagatttcaggtggtgtggggttatagccccgatgggtaaacatgttcacggttgcttgtacattagaagagaagaaggcgagaaggagtggcatgggggtggggcaggaaaaagaggaagaagaagtaaacaaaaactctcccaaacctcagcatccccgacagtccagcccatcctgctgggagcggccgtgggaagtacgcgaggcaggggggtggccgtgggagggacgcgaggcagggggcggctgtgggagggacttgaggcagggaggtggccctgggagggacttgaggcagggggtcggccgtgggagggacttgaggcagggaggtggccctgggagggactcgagacaggggggcagccctgggagggacttcaggcagggaggtggccctgggagggactcgagacagggaggcggccgtgggaggcacttgaggcaggggggtggccatggttgggcctgagccatgtctcgccagcccggcagctcagtgggctctgtgccccacccggctccctccatggccagctgtctcccctcctatggctccatccatgctgtctccccttctcccctcttcccttctcccaccctggtccaggccatctgagcctcttgcctccgcactgcggggccttctctcttgcgcaccagcatcacggctctttctttctcacccgccgtgcacgttgaacccaaagaggactcgacaaaaccaaatctggccccgtcaccctctcctgttggaatctggctgtgactccactggtcctgagatacagaccccagccccagcgtggcccaggctgaccagcagctctgcaggtgcatcttggggacactccaccaggccctccctccgccccggcagctgggctcctgcagaaggtcccagctctgcacctgtcccgtctgggaggcagcttcctgttcacgtcttctccccattcagagaggtctgtccacacccctctttcccaagtctctttgtcaccaattttccattatgtttcttcaagactctgagcatctggccaaaccattggccatggcctattaatttgtaataatcacacatttggctatttctctttccaagcaaagtaaaccagatgtacagcctatagttctgcccattggagaatttcccttcaccgctgtccttttagggatgttccagaaaggggcagtagtgctgcagttgtccactaacgtgggggcctgcatatcatgcagaaccatctgtaaaccaggcccaggtcttcctccgtcagctgattttagggaactctccaggagactgtaggtgcaggctgggagagagaaggcagcatagcgggagtggggaccgttggcattggtggcacttctttatgtaacttgtgcctttagggcctacttaggcccagacacataccacttccatttgatgatggaatgctgctgtgtacacccaactttctggcttggtgggtcggaaaacattcagttcatgatgggcaactcaggtcccatggtaacttggtggtccatgtcggcacgggatctgaggtcgaatcagattagagaaccagctccgcctgggtcggcacgggatctgaggctgaatcagattagagaaccagctccgcctgggtcggcacgggatctgaggtcaaatcaggttagagagcctgttccgcctgggtcggcacgggatctgagatccaatcagattagagaaccagctctgcctgggtcagcacgggttcacggctcctgctggaggcacttcccgatcctatttggcacactttttaaaggtgacgctatatagaccttccgtacctagatctttagttagctgctggcatttaaaaagtgtttatagtgagcagtacagtctcatccttatgccaaaaaataagttgtcagaatacagtggttttcctctattgattttctgcctggaagagtcgatggtgtggacagccccactagcagtggtccagggtcgttggcctgggtgcggcacacgagctccggggctgcatggcggtccgcaggaggaaggttcagtttgggtgcacaaagcatcaaaacctccttctcccagaccctgacattagactcctgcaggaagagagtgggcgtgcaggggatccagggtggagacagacatggtgtcggtcactgcggcgtcggtcaccatggcgtcggtcaccgtggtgtctgtaggatactgtggcgcctgtcagtcaccacgcgttggtcagggcacctccccagcccactgtttgccaccctcgaagcgttgcttctctgcatgggggaggttcccgtgggctggaaacattttaactactttataagatgatttaaatagaataaatttcatggtttgttttaatgatgaacagggataactagaataattggttgatcccaagaaacctcgtttatctattggttttgagtattgtcttatcaaaagagtttatatcaaagttgactcattttcccttcacatttggctccctagctcctggtgggttttgcagtaaatagtaaaatgtcccagatcgggctggtgaagctgcagaagcacagagcatggtcagcaggagggtcggtcatggcgggtcctgttcttggcttgatttcatctggcccacaaggaagaggcagtaacaaggctgccaaaatgagacgtggagaagttttatgcaggcttccttcggttttgttaagaacaagtgtaggtcgcaacaggtccccgggctcaccccacctttctgggcacctacgttggaacatggcctgaatgataaagtgttccgtttgagcttttctcctgggagtttcctagtagtgtaattttgggcaatgactttagtttctctagcctcggtttctcttttaaatgaggccaataatagtgtgttcctcaggggtctgctgaatgccagatcccaccgctgtgtggggcctcagtgtggcgtccagcacaggagcttcccagagtttttactactctttatatttccgacccctacgtacttttcactagtctgatttttaggggtgacactcccgtagtcattttctgctcatgcgtccacccgtgcactcatttcggggtgacgtggatgccacacggaagacccagcactgtgccggggctgagaggacaccgtggaagagggacactgtcacttcttactctgagcctccctccagtgagtgcttgccgaggccttagggcctcccatgtggctgattcagtagatccataggaacaggcttgtccaacgtggttgagcttagagacgtcacaaacttgccactgtccttcagaactgaaagactctagagagaggagacaccatcttcagctttgaaagtcctttccactgccctcacaggcactcctagctctgaccctgaccccataaaagttctcatgcctgtttctcttctacggcaatattagtgtccaggtattgagggtggaagccgccacatgcagacacagcacgtcgcacctgctggatcctcccactcattttcaggatgacgtccaactgctttctaaggaagttcaggcctcggaatgacagatgatggctgtggctttagagatgaaataggaatggctgcgtgatcattgtgagcacagtcagccctgtcttgtttgtctgctttacagaatggagccagcactcttctgctttacagaggagccgtgatgcccctgcccacctggccggcactgtcacccttgccaggctgaggaaggaagggagtggactgcacgtcccgtacactttgtataactggggacaccttggcttgtggaggcagcgggttcacaaacacattctgggcttgtggacttccttgttgtgttcagggtgttgtaggagtcttgtggatgcttctgttggtttccatattggagcatggagggcagagggctgggcccaggattcgtggtggagcccctcccatgtcctcataccatccccttggtttgaaacatgctagaaaaggagactcatggaatttggtagcaaacattgattgggaagttggcttatgctccgcagggggcagtaggcttggaagaaacaaactcagatgacacgtggctcctgccctcaatgagtttgcagtttgtagggggaggcaggattaaaatatgaaagtactggagaccttttaaaataagtcatgagctgagtgatgctgatcaaagcacacagggagttttagggaaagcctgaagagcagcagtttctgtctttgctgattggagtggtgtggtcggtcctagccttctccacctgcccttctgcacctgccctcttcctaatggctccaaggatggggaggcccagggaggctggggtgcagggggctgaggcaaggcaggtcagcgatgggagcaggtaggctggccctttggagcagtcaccaccaggcccaggcagagagaaaagcccaggctgctggggagcacaggagccgggaggaaggaacctgcagccacacgaaaaaaaggaagggctcatctggaagcatcgcacttgcctgccaggagggtttggcttggagcagggaggctggttggatgcaagtctggagttcccagcagcctgggctggtctcagctggggtggagctgagccggctgtggtgggtcattgctctgtccagctgcagcctgagtttgtctttgtagccccgcctggctcccttccctgttgcctcccttctggcccaacatctggccattctgacactttttctggcaccagtgcccttcacaagctgttcagatggccctggaggatgttttgggacaggagctgacctgggttagagcagacatccaaaatgtacaggaaaagagaggacatctgggacccctccccttccagcagccactctttaaaggaaaatggcttgtttctcaattgtaaaattacacagaatgcagccttgaaaaatccactttaaagaacacgccacaggctttccttggagacagggagcagaaaggagctttgccagggatccagcaggaacttggctcagctttctccgtgagccacaaggagtgttctgctgaaatagagattggacgaaggctggtacactgccttggatgtggggagcagccacacgtcatggtgcttttatactaatcaccttgtttcatcttcccaatttcttgtattttattaacatatagataacataaagtttactgtcttacccatgtttaagcatagaattcagtagcgttaacatttgtgctattgtgcaaccatcaccgctgtccatccccagagctcttttcatcctgtaaaactgaagtttcatccccattaaacactaccctaccccagcccctggcagccttcactctactctgtgtctctctgaatttgaggattctaggaacctcacatgggtagacacacagaatttgtccttttatgcccaggttatttcagttaccatcatgtttcagggttcatccctgttgtcgcatgtgtctgaatttcttcctgttcagggctaaataatattctacttttggtgcaggccacgctttgctcctccatttgtccatcactaggcccttcagttgcccccatgctttagtgattgagaataatgcggctgtgaatgtgaggcactaacatctctttgagaccctgttttcaattcttttgggcaaagtagtctcccccttatctaagggggagacattccaggaaccccagtggatgcttgaaacttcagatagtgcagaaccctatataaactatggcttttcctatacatacatacctatgataaagtttaatttataaattagagtatgagattaacaacagtagtgataaaatagaacaattataacaatttactgtaatagaagttgtgtaaatatggtgtctctctctctctctctctccctctttcaaatatcttcttgtactgtacctcaggtacctaaaacacagaaaacaaactgcagctaatgggggactactgtagataccaaggaatggagttactcgatcaaagtgcaattctatttttcatttttttgaggagtctccatactcttccacacttgatataccgtgttacattctcaccaacaaggcacaggagttccaatttagccacatctttgccaacgtttactattttctgggtttttttcttcttacagtggccatcctgataggtatgaggtggtatcacattgtagttttgatttgtgttttcctaatgattagtgatgttgagcatcttttcatgtgcttttggccatttgtatattttctttggaggaaaatgtctattcaagtcctttgcccatttttaaatggtattgtttgtatttttgttgttgagttttaagagtactctatacacgctaggtacattatgaggtttcttaaatagtgatgtaaatattttactttcctttaatagtcaaaatgagaaattttacgttaaactaaaaatgtagcaataatacactcacagtgctatctcttatattaaaagaagatattggccaggtgtggtggctgatgcctataatttcagtactttgggagaccaaagtggtggatttcttgagcccaggagcttgagaccagcctgggcaacatggcaaaaccccatctctacaaaaaatagaaaagttagcaaggcatgctggcatgaacttgtaatgtcagcaaatgggaaggctgaggtgggaggatcacctgagcctggaaaggttgaggctgcagtgagcaacgatcatgccactgcactccagcctgggcgacaaaaaaagaagacattattgacatgcttgaaaacaaagactgtcatgtttatgcttatagttaatgcaaatagatatcccttgttgtgtactatagaaatagtccttaaaagatctgtggaatatcatattttgctaatctctgtcttttgattggagagtttaatctatttacatttaaagtaattaatgatgaggagggacttctgtcattttaatatttgttttctatgtgcattatggattttttgccactcattttctgcattactatcttcttttgtgtttagtagatttttaaaaattaaatgcctaaattcctttcttctttttgtacgtattatgtagctattttctttgtatttatcatagaggattagatttaacatctgaaaattacaacactaacttaaatttatactagcttgacttcaataacatacaaaaattatgctcctttatgctatttacccaccctttttggctattgatatcacaaaattgcatccttatacattgtatgtcccaggatataaactaataattgtttaaaatttattcgtttcttaaattatgtagaaaacaaaatgtggagttacaaaccaaagttataatactagttttaactagtaattgtttttaagatatgtactagtctcttaaatcatatagagaactaaaaggagttacaaaccactgttacaataatactatattttataattcaccatatatttgcctttattgagattttaattttttatatggctttgagttattgtccagtgtcctttcatttcatcctgcagggctccttggaatatttcttgcaaggcaggtctagtgataacaaactctctcagctttggtttatctaagaatgtcttaatttcttcttcacttttgaagtgcaattttgttggatataggattcttggttgacaggttttttttttcttttcctgtagcacttggaatatattggttcactgctttctgttctgcaaagtttctgctgataatattatttggaaagcctggtgtgtgatgaactgcttctttcttgctgctttcaaatgtaagaggagaattctctgtttgtccttgtcttttaacaatttagttaaaatgtgtctctgagttaattttacttggagttcactgagcttcttggatgcttatatccatgtctttcatcaaacttgggaagttttcaggtattgttcttcaagtattttctctgcccctttatctcttttttttcttttgggcacaatttcctctcacaattcatatactggttctcttagtggtatcccacatgtcccttagggttttgtcacttttcttcaatctttttttctatttcttagactgaataatttccattgtcctatcttcaagttcactgattctttatttttcttgctcaaatctgcctttgaatctctctagtgaactttttaatttcagctattgtattttgagcttcagaatttcttttatattttaggttttctctttgacattttcatttttcatacataatttttctgactttctttacatctttcttttgttcttcaagcatttttatgacaattgttttaaagtctttgcctagtacatctgccatcaggtctttttttagagacaattattgttgacttacctttttcctttgaatgggctgtagtttcttgtttctttgtttcttgtttcttgcaattttttgttgaaaactagaaattttaatctaactctggaaatcagattgtctctccataggtttgctattttttgtttatctttcttttaaattttttgtaggctgtctttgtgccaaggatcagcctgaggtgtaaacttgtggtattatctgagcctttccctgagcatgtgtggtgactttctaattttccctgtatattcagttacttttgaatattctggtctttaatttctggctcccaaaagcggaaaaagagaaaaatgaaggtgggaaaaatgggtgttagcattttaaatcccctgtaagtcattttggccagagggggaggagcaacaacagtgaggaggtggccaaacaatggtgccctcctcctttcctgcacctctgtgatgagaagcagcaatcagcagtgagattgcagattcccaatatttggaggacaacatctgtattgcctgttctggctcctgccagtgtgtgcaggctgctccaggaacatgtgcacagctgcttgccacagggctgaaggtgagtagcggtagctcctactgtgatgaaagctgacattgactgcaaggtgtatccagaccttccactagaagtcggaggccttcattaggcttcagagttcaaggatcagttacatcagacagatcctactagcacagtgttgtcaggtgggagacagattcctggtgtttcctactcaccatcttcccaaaactaattcatgctttactttagttttacagaaactttataaattgagtggggttcatttaatagtttacattttaatgatttttaaaatgttggattttttgctgtttttgacattctcgtgttcattcattcatgcagttaatgccaatgtagaatctacttgtggaatgagtacttgtgtccatgtgcagggagaggtgcatggtgcagtagccaaagcctaccccacgtgggtgaggtccttacttcaccgctccatgcagggtgtgcagagcgggcctgtcttataaaactcaagttcccagttactcacctgagcgaaccaggctccttccctgttccatctgagggtggcacagggtggagtgtgagggatgggctcagtgcagacagttgagggcccacccagtcttgtcatatcttcacctgatgccttgaaggcaacacagactccgtgtgtttgatgctgacctcaggatctttcctctgtcctggggctgtcctgagtccactcgcagtgctataacaaagcaccatggatggggcagcttagaagcaataggaatttcttcctcacaattccaggggttggaatccagatgccagtagatttttgggttcttggtggaggcacacttctgggttgcagatggcattttctcacatgaaggaaaaagatctacagagcctcttgtagagggcactgatctcattaggagactccaccctcatgacctgaccacctcccataggcccctcctcctcacaccttcaccttggggctaaagattggaacatacagattttaggggtcacaattagttcatagcagcctgcttcagaaaacagcatctgctctgctgtcccttcaaccctgcagagcccacctttctcactcacagttctgaacaccttacccgctgacacatcgcagtctatgaccatgtccacttcagtcaccattaccacggtccatgctgcttgagctcatgtctcattgagacaatctggaggccaccagctgtttcccttctgtctcctctggtctccaacctgttctttatccaggggagggaacttttgttgttgttgttgttgttattttggatatggggtcttgctctttcacccaggctgggatgcagtggatattcacaggtgcaatcatagctcattgcagccttgagctcctggactccagtgatcttggctcctcagccttctgagtagctgggaccaggagagtgggacagtgcccttgcctaggccctgttgatagctcgccattgtatttgggataaactccaatcccttaatgggtgaggagcacccatgtagttggctcccttccttctagccatccgtgcctcccctgccccttctctcaagttctctgagtgactgtgctacccgagggcatttgcttgctgtttccatccctgcgtctgcctctcgcgctctgtgccttagactagtaacacgatccattctctcagccctgtggtagttcttggggacccttctggggctcccttaccccagcctggaccaggctcccatgtaggccccagggccgtggccagtggcttctcttttccctggggtttgccatgggttttttaatgcatattctttaccgttgttcctgccagattagaggctgccgggggccgctggctcctcctcctctctcatctctgcttccatagctcctggctcagcctggtaccacaagtgctcaggaagtatttcttagatgaagagtagagcattcccgcggcacgtcttccacatccctcccaactgatgtgtagattgcctgaagctgagcgacctacgttagtctagggttggaagtcatgtggctttgttgctgattttatggtgtgggagtttggccaaggggttcccaaagcagatgcctgaacaagtgtcagcaccagtgggaacccacgagaaacacagattcccaggcctgacctgtggcctcctgactccgaaacgctggagggtggctggggcatctgcattcctggtgagtccttggcccatcctggtgagtccttggcccactcaggtcccagagccctggactgggcagggaaggcctgtggtacgtggatgcagcctcatctttccattgctgtaaccactcccaaactggaccagctgtcaccttcacctacaaagggtttttttgtttggtttggtttttttattttaaatacactgtcctgggctccagttccagccacactggctgggcaggacaggcatgggcctggacaccctccccaggtggctctgaggggtacccagatgtaggggccaccggtctccctggaggtaccgggcttttgggacaggctcagcccctgagctcagatgtggctcctccctgagtggaaggcggcctgtgccccagctggtcccggattgctacgtgcctcgaagtcctggccaaggatggtaggctgtgtccctggtggccacaacaacagctttagcgtcgacgccatcagatggctttcttgttgcaggtgcgaggcccatgagaatccacctcaatgcgtctctctgtccccaggaaggattcataacccccaagaactaccctctctctccagctagtgcagctgcgctctgaggctagactagtcacggcatgcgcctgctcatgagtctgaatctgcaggccctgctgaggtcctctccccaaggggtccctgagtgtaagtcatggatagagaatgcctggggtctccagccctggtgccagttctgttaccattgtcctactcctgccgaaggcctctgcctgctctgggcacacacagccatgccctacatccagcaccttgtctcatcactcctatccctatgctagcatcctagacgtcttccagcttaacagaaactgcccctcttgcccccagaaccctgggcagctcttacagtgttggccccatctctcctttcctactctccatccctccaatgctgaacaggctgcaggtccctacagccttgcagaagagctcctgtgaggtcagcccacagccatcatgacccgctaagctcggcctcagctccccatcctcatctctctggaccaatctgaggcccggcccttctccttcttggaattcttgccagctcgctgcttgcctctgtcacagtccttttcattctcttttgccagttcccctcattgccctaaatgctggggggccctcaatgctggggggccctaaatgccggggggccctcaatgctgggggatcctaaatgctggggggcaaggctccgtcttaggtgctccagcttcagtcaccctcctgaggccagtgaacacctctggtcgtacagctccccggtctcggcattcatgatgcactgcccccagcacccagcctggacgccctgctgtggcctctgacctctgcactcacaggcacatcgcccctcagtacccagcctgggcaccctgctggggcctctgacctctgcacacatggatgcactgccctcagcacccagcctggatgccccgctggggcctttgacctctgcactgacagacacgtcgcccctcagcacctagcctggacgccctgctggggtccccatgtccacgtgtgcaggatgtaaactcctgactctgtcagcaccactcccagctgggccttcctggggcttctgcccatcttgtgttttcccagcgccagcggactccaccggcatggcctcagatgtccctccagatccccaggctccccaccggacagccgtggtggccagctcaggcccctgccccagctgacggcctcctgcactcgtctccaggccatgtccacccagctgctctgtgacttcacctcctcaccatgtggcaccgcggcccccttgccttctctgctcactgtctgataccctgtttccagctccttcacctctgttcaaacggggccccactggagaggcctcctatagcccactttacaagacagtctctcctctctgcccttccctccacagccctgcatgccacttctctacccagctgtctcctccagagaacttgtcagccgacaggagctagtctgcctgggctgctggcgcacacttccaaagtgggaaatccatcttctccctgtcctggaggctggaagtccaagacccaggtgtgggcagggctggttcccctgaggctgaggagggtctgctcccagcctcgcccctgctgctactggcctgagatgacttcagcttgtgggtggtttctccccatgtctttgcgacaccctgtgcgtttgtctctgagtccaaaccctccttttatacggacaccagtgatattggcttagggttcaccctattgacctcagcttaactaaatctatgatagccctatttccaaatcagttcacattatttgggttttaggatttcaacatatgaatttttaggtgacataattcaacccatcatagcatgattgatttctattcaccagcatctctagaacgtgaacccctcgagggcagggctggtcttgctgttcattgctgtatttggaagcagctcctggtgccctgcaggcatcctgcacgctcactggatgaggaatgcaggcgttttggtctgctggggtgaaagcctttgcggtacaacatgcttttacataatattgtaacttaatactccattaaagtggtactaacaggatttcacaggcaacttgtgactttcaacctgaatgctggccttcaggatgagtcatcaagctgcaaaccaccctggtgacggctcttgcctcttgacggacaggtccccagccaggtggccttgtggggagtctgcggccacagtgccttccgggagtgcccccgccccctgccctgagttgctgccagtgggctggctgcctggtttccatgctcacacttccattgggtagttaaattgcccctcactggggcctggttcacatcagaaatgagcccattaaaaacagatgctttctccatggatccgccccatcctcagtcagagtcccagcatccgccgcacctgcctgtcccttctcccttctcccctttattgtattttcactgaaggctgagaggagccagtctccacacggtgggccacttgcgattcccacagccccgtccgcactgcactgtttgtcttgttgctggaaactcaggtgactccttgtgcctgagggggcagctgaccccaggccaggagagcagggtgtgtgtggggaccagggagcggggctgtggggccacagggctttagttctccaggactgctggctctgtggtgactgctccccatccctgctgtcatccgcagccccctgcgccccgaggaaggaaggcggctggtggaggacgtcgcccgcctcctgcaggtgcccagcagcgcgttcgctgacgtggagtaagtacggggccctggggtttctgtttggctcctgttgctcggtcgcagagactgggtgggagggaaggagctgcgagcccatggctcttgttaattacatgagggaacctgtttagagaagtgaaaggtgatttcagcagctttggtaagttatttagaggcagtggaaaccagtgtttaaggggaaggatgaaaatctcctgaaggacagtgtcgctgcagccaagtgtcaaacctttggtgctgtaaccaccgaaggctctagaacattctgcacatgtcctatgccaatgtgtgggagcctctggagggcccaccccagagaacactgcgcagcgttcatgagcacctgctgtggacacggccctgtccctggctgtcaggaaaatgcgctgcccttcggagacctggctttggatcccgagtctctgcagcttccatggcaggcatggccatggtctcagcgtgacctggtttagagagttgtgggcatgaggcatgcagggctggtgggtgagtacacacaggggcagcctcttacctgtctcacgacaagtgcttgaggaaccatgcgtgcatatgtgaagcttggagcagagatggctgagtgcagaagctgcaggagctcccacagcgcacagctgggtgtggagaggtcagagagaagagggagggtagagtgacatccacagaggacgtgagacaagaggccggcccgggctgtgtgcccacctgcctgtggaccgaggggtgcctgcctacacgtgttgttcactcactggccccttcacacagggtgacttcattcactcagtgactcttcacacaggtgacgtcattcactcactggctcccacagagtgacgtcattcactcactgactcttcacacaggggtgacatcattcactcactgtccccttcacataggggtgacgtcattcactcactgactctttacacgggtgacatcattcactcactggctccctcacacctgggtaacgtcattcactcactgacgcttcacacaggggtgatatcattcactcagtgactcatcacacaggggtgacgtcattcactcactgtctccctcacacaggggtgacatcactcactgaacctttcacacaggggtgacatcattcagacactcttcacatgggtgacgtcattcactcactggctcctacacgcagggtgatgtcattcattcactgagtcttcacataggggtgatgtcattcactcactggctccttcacacagggttgacgtcattcactcactggccccttcacacaggggtgatgtcattcactcactgtctctttcacatatggggtgacatcattcactcacagagtcttcacacaggggtgatgtcattcactcactgtctccttcacacaggggtgatgtcattcactcactgtctccttcacacaggggtgatgtcattcactcactgtctccttcacacaggggtgatgtcattcactcactgtctccttcactcaggagttatgtcattcactcactggctccttcacacaggggtgacatcattcactcactgagtcttcacacaggggtgatgtcattcactcactgtctctttcacacatggggtgatgtcattcactcactgtctccttcactcaggagtgatgtcattcactcactggctccttcacacaggggtgatgtcattcactcacggtctccttcacacaggggtgatgtcattcattcactgtctccttcacacagtggtgatgtcattcactcactgactcttcacacagggctgatgtcattcactcactggctccttcacacagggttgatgtcattcactcactggccccttcacacaggttgacctcgttcactcagtggctcctcacagcagatgctcactgggcacctgtggcaacctggcctcgcaccaggagctgggcatcccctttgagatacatgggccctgcctcaattctgccatttattaggaaaagacagaagagtgtatgggtcattagcatggagggcactaggggacatgcatgagaagcaccccagccagcctgggatcagaagtttctagaagtagaaatctgaaggacacatggaggcgtcccagagagagatgtgacatgcaactccacactgctcactgtggcccacaccgttcctagggtacagacatatgcaatgagcaggttcaaggaaatgtccatggacaggaaagatgtggagggacagggggctccatacatgccagggctgctggggtttccctgaaatggggtggtccggtgggcaggccaggtaggactgctcagcagggacagagaggccatttagggacccagtatgtagagtgagaggaccctacagggtgaacacagtgagatggtctgactagagctgagagagagcagccctgaggccacctggggaaggtaaaggagggagcaggtgcaaggcgggtgtggtggcaatgggagcacagagatccaggtgagggggggctatttgtggggctatagtgggtgagtgggctgtagagatccaggtgagaggtggcaggtgcatggggctttaattggcaggctcatgcagacatccaggtgagcaaagggtcacgtactcagggctgcagtgggcaggtggtttgcagagatccaggtaagagtgggaccaggcacagggtgaatgcagtaggaaggggctatgctgagatgcagatgttttttggggggcaggtgtgtgggcctgcagtaggcagcagaggtgcagagatccaggtgagggagggggcaggtgcatcaagttgcagtgggcaggggactttcccagatccatgtgagagagggggcaggtacatgggcctgctgtgggcagacggtgtgcagggatccatgtgtgagagggggcaggtgcagggcagatgcagatatccacatgaaagagggggcatgttcatgggctgctgtgggcaggggacacgagaagatgcaggtgagggaagagagcaggtacagcgtgactgcagtgggtggccactgggtgacttctgcctgggaagcaggatttgaagaattgtagaaaggcagcttcaaggatgagggtagatctgagtgcaaagtgtgtgttgatctatacagtgtgatgcctgcccatggaaacaggcaagtagggcctcaggcagaagtcctggtggcccctgggcagtcaagtgttttccctgtggctcacaatggggagggcctgttgttcccagagtggcctgggatgtttgggcatctggggttctggaggtggcgggtgggcaggggctgcagctgtttcccacctggtaggaaatacttcagtgttttaacttctgatgtgactgagggtactggaaatgtatggagtggctttcagcacaccagggacttaggaggggggagggtttgagggagcttcctaacaggtttgattgataggtttgtttcaggtacctggatgacttctaaggggtgctgtccaggtgacttaggggacagatctgggtaggtgtatatgacataaccttaatgtacagtggacagcaagatcccagtttctgatgggatcaggagatggaggtaagggaagagaaggggggcagcagcgatgtggggcacgtggacccttaggtgtatgtgagaacagagacaagtgtgcatgttggcaccaccttggtttcttgtgaggtagctcccagtcagtgttttgggttcctagggaagaaatattaactctagggaaaccacacaggacagatttcacagaggttgaaaatagaagaagctcccaagacctgaaagagctgagatgcttccaggatcttaaaatcttcctctttatgctgaaggagaattagataatctggttttatgggatcctggggaagtgacttttcctctctgggccatagttttatattttgaaaattagaggggtttgcctacttcatctttagtgattactcaaggattaatcttctgtgaacctgtgacctgggacactagtgaaaatcatgtaacaggcactctatcaccttcggggagcagggcacagatagtgtgacagggttatatccccaagggcagactccacaggtaggcgtttgtgtggagaggctcatttcatcagcccctggagacatcctctttatcagtgttttggatattcccaaagtggcacacttctgagcagtgataaacagtgagtcagaaaaggtggaaatagcttcttccagatgatacacggaggtgtgtgtgtggaggcagggagggagctaagaaagaagctggagccaaggatggaggtgatggtggagctttggaggaaactgcgctggagctgggagggagcagaggtggaggttgggatggaactcaagagagagggagatgagctgagatgaagctcagaaaggagctggagatgccacttgtaaggaataaggataaaaatgagatagagcagaaatggagctggggggaagctagagggagctgcggggaagctaggtggatggggctgggatggactgggatagagctaagatagatcagggaaggaactggaaatggagatgggatgaagctcagaaaaaaagctgagatgaatctgaggacagagcaggatggagctagaatggagcagtgatgatctaggatagagctgaatggagttggaatggagatggaaggagctgggaataaaacagaagagagatggggatggaattcagtggagctggatgaaggaggggatggaactggatggagctgggatggagcagtgatagagctgggtatacagtagtatggagatgagatggagtagtgatggagccgggtatagagtagtatggagatgggatgaagctgggtggagctgcaatggagctggatggggctgcatggcgtaagatggagctaggatggaaattgatggagataaggataaagcagggcatgcatctggatggaactggatggagatacaatggagatggatagagctgggatggatttgtggatggagatgaggtggagctgggatggaggtggatggagctccatggtctgggatagagttgatgaatctggatggaagtctatggagcttggttcagcttgggatggagtagggatggataggaatggagctggatggaagttcatggagctggggattattgaagccttggatgtacctggggtagagctgggatggaatctgctgtagctgagtggagatgggatggagctgggatgagggtgaagctagggtggagtttgatggagctcagtggagttgggatggagctgggatggagtttgacggagctgagcacagttgggatggagctaggatgaggatggagctcggatgcagttcagtgaaactgagtggaattgggatagagttgggatggagctgagggtggagttgggatggagtttgatggagctgagtggagttgggatggagctgagggtgaagctagggtggagtttgatggagctgactggagttgagataaagctgaggatggagctgggatggagtatgatgacacttagtagggttgggaaggagctgaggatggagctgggatggagtttgatagagctgagtggagttgggaaggagctgagagtggagctgggatggagtttgatggagctgggatggagtttgatggagctgagtggagttctgatggagtttggataagggtggagctgggatggagtttgatggagctgtgtggacttgggatggagctgagggtggagctgggatggagtttgatggagctgagtggagttgggatggagctgagggtggagctgggatggagtttgatggagctgagtggagttgggaaggagctgaggatggagctgggatggagtttgatggagctgagtggagttgggatagtgctgaggatggagctgcggttggtgctggttggagctgggatggattttgggatggagctgggatggttgtgatcatgggtggttgttggctcttcctcaagctctcctccactactgacaaggcctccatcagtcctgttctctctcttttctcccttctgttctcctctctgtccctgcctaggtgagccctatagtcttcatctcctttttcatcttgtgaggggccctgctgctgatcttggtgtcttactatttcctcatctatgacttttttatccatccacaaatccctgattttcacagcggtatctttgctcttaagttgtcttgattcttatgtgtcttccagggcctttctcaggagtctttgagcctgagattcacctgacctccattgtcttcatcctggccttcctcaggccttctgatgcctcagactgctctggggagggcatagtgaggaagcacagaaaagaaatctcaggcaggatgccctgatgctccattgccttaaatctgtctctaggccaggcacggtggctcatgcctgtaatcccagaactttgggaggctgaggcgggtggatcatgagctcaggagttcaggaccagcctggccaaaatggtgaaaccccatctctacttaaaaatacaaaaattagtcgggcatggtggcaggtgcctgtaatcccagctacttgggaggctgaggcagagaattgcttgaacccgggaggcagttgttgcagtgagctgagatcgcgccactgcactccagcctgggcaacagagcaagactccatctcaaaaaaaaaaaataataataatctgtctctaagaaccagaaggaaatgtgtccaggctgctaaccatcatgggctgagtgggatgatctgacttcatgggcattacaaagagcagtgtgctgtggcccccgacaccattggtgtccatcacatcaagtgggggcctgcactgacctggcacagagcaggacatgtaagaaggggaacactcatccctgcccctgagctgtttgaaacctggctcatgagacaaacaaatcggacagtgctagagaaggttctggaactgccagtgacctcagacattctgagtacaactcatgctagggaagtgaggctggagaggaagggaatctcctggggcccagagagtgggccctgcctcggacatcgctgctccatgggcacagccacgttagtccagaaagtgcagttttcctgatggtctttgagtctcacctgtgtgcagggctcttcgcgttctttttcctactgctgttattttaaggctttttacctcttactttgaactggaaggagccacctgccatcaagtgtcctgaatggttcaaactgcattcctttccacgaaggattccatcccaggcctgtatctttggcactatccctccctatggcccccaggaaggcgcctagttttaggactcaggaactcatcgtgggcccaggccatgcgcacagggaggatgaggccacaggtggtaagtgggagcctcacactgactgcagccaatgaccgcaggccctttgttctaggtgctcacgcctgcttctgctgtcagacagggacgggtgcatgtctggacacccaggccttactgggtcctgctgatggcttatttcagaaggaggggttccccatggactgatgccccagctcctgtcccgtcaggctccctgtctaggactcagctctgatgccgctgaggagcatgaggtactgtcctgggggtgtgtcctcccgggtctgcagtgccttccctgcactgtggcccccagaacattagccgtgtgctgtctttctccccagaccatcagctcctcagtgcctatctatgtcctgaacccggctcagtgactgcagagaagtgtgcaagtgcacacttgcatcttaagtgcaagtgtgattcaagcgtgatgcaatgagtccttgaacaacaaaggcctcatccctccaacacccgcaaagctgcaggcccatcccacacccccttctgcctctctccatatatcaaatacatggggcatgctctgtgattctgcagccctgggaaactcacctgttgctgccaaggcccacaattactgatgaacgtgtggaggtgtggatgcctccttagttaaaagtgagattgtcctcagggacatttgagggccatggaaaagaagcagcctgggtaccatgagaggtgcctccatgagcagcagggcggcctggagccatgggagggaggaagctgttgcacccagacacataactgagataattgggcagagggcaggcagtcacaagaggtggctttggaataaagcatcctcgggccagctcgggatgcgtgcattgagtttaccatattttcctctggcaaagcccttctgtggtggctgtccagcacgtggaaggccgtggctcaggcgcacaggggctcagtgttttctgaaggttccctcctggccgccctgctgctgatggctgccatgcactgttagcatcatggctccagggtgaaggcgtgggctgagggctgcctggcacctgggctcagtgcctgccacatgggtccagtttgcgatctggggcttgggagaggaaccacttcatcctcaggacaggagaggggccccagggtcagctgcaagctccatggctgctcactgtgagcagatcctgggacctcagggcccaccgtggcgtagtgacgggcagagatgggcctgccgctgctcactgctttggccatctctgccctcccccagtaacatcccctgggagagggtgggccagaatgaagaagggaggagtggttggccacatggccaacagctggacggtcagggtggccaggggctttgctgtccacactgattggagcagacctgaggctgacgggtgcactactgtgctgggtgagattttcttaaataccaggtgggatttcttttaaagtctccatggctttcatggtgagctgggttttaaactcttttggtgcaatggaaggtgtgaggtctttctttgtatacagtgggattgtttgggctagatgactggaagaaggaatgagtttattctgctgattgtttcttttgctgtgcagaaactttttagtttaagtcccagctatttatcattgtttttgttgcatttgctattgggttctttgtcatgaagtctttgcctaagccaatgtctggaagagtttttccaatgctatttcctagaaattttatggtttcaggtcttagatttaagtccttgatccatcttgagttgatttttggataaggggagagatgaggatccagttttattcttctacatgtggcttgccaattatcccagcaccatttttgaatagagtgtcctttccccactttgtttttgtttgctttgtcgaagatcagttggctgttaagtagttgagtttatttctgggttctctattctgttccattggtctgtgtgcctatttttataccagtaccatgctgttttggtgactatagccttatagaatagtttgaagtcaggtaatgtgatgcctccaggttgttctttttgcttagtcttgctttggctatgcaggctcttttttggttccatatgaattttaggattgtcttttctggttctgtgaagaatgatggtggtattttgatggggattggattgaatttgtagattgcttttggcagtacggtcattttcacaatattgattctacccatccatgagcatgggatgtgtttccatttgtttgcgtcatctgtgatttctttcagcagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcaaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtggcacacacacacacacacacacacacacacacacaccccatggaatactattcagccataaaaaggaatgaaataatggcattcacagcaagctggatggaactggagactattattctaaatgaagtaactcaggaatggaaaaccaaacatcatatgttctcactcataagtgggagctgagctatgaggatgtgaaggcttaagaatgacataaggactttggagactcagggaaaagggtggcaggagggtgcaccaaaatctcacacatcaccattagagaacttactcatgtaactcaacactgcctgttcccaaaacctatggaaaataaaaataaataaagaaggaataagtttatttcatgaacacaatgatccttatgagggaggagtggggagaggaagtgaagcatgaccactgatgggatggggggaggaagaggaggcagccgggatgtgttggggggaggaaggggaggcagccgggatgtgttggggggaggaaggggaggcagccgggatgcggaacccaggaatgaggccagagaagaagtgggtcttcaaggctgagaagcccggctcccctcaaggacccaggaacgctgcaccccgcactgtcaccttctaccatcttctccggccctccccgcggccccgttccccgtcccccactgcttccttgctttctcgctttctccccagctcctcggtggtcacgctttgcttcatgtctcccactcctctcccataaggagcgtcccgcgttcacgagataaacgtccttcttcttccagtccccgagcccaagcaaccccattcaccttcacagagtctcagcaaaatggtgggactggcagatgccaggccggggcgggcgagggaggcgtgtgcctcggggagcctctggtttcacagagcagctgggcctcgcccgtgcctgctccctgcccctggccctcctggccaccgccttcgctgtcggaagacggattctgagcacggacggcttctccgcattccgggagcagggctgggctttgccaggctcagtcctgggtaagcgtcaccctcgggcatctcccgccttaggacactggcggccccctctttcctacagagtcaaacctgagtcccgccgcccgtccctcggagccttcgggaatctggacctctccacctcctccccagggagcccccccggtggcctcacccgcaggatcctttgcgggtcccctgcccacattgcggagctgaagcctgattcttgctgcgtccagcgcttctccgaggtccccagtcctggccaggcagaggctgccccacgctgggtcttgagttctggtgcctgcgtgcgtgtgtgctcatgtgcaggggaccacgcaagccttacttccacgtcctgtgcctcacccgggcccagcagccacgggcacacacttggcaaatgcaccggctcgagggacggacgggggtgtgggctgtgcctcgttggtgtctcgaggggagcagctctgacaggcgggagacacggccacgcggtgctgcctgtcagagcatgttctgggagctgctcattgttccgggaaaggaaaagaggcggacaggatgcgcaagctgtcactctcagactctcctgcggttttgtggaagtgctagttatgctgaatatgttttgttagtggttatgtagctgtcacataaatcccattatttcttatgacatcattagagaccattaaaactgcattagcatgtgatgtaattatgccagcagaccggcagtgaccgcagccgggtttttacgacgtgattgtggctgtctgcggcggcggtgatcgatgccaggccgccttccgcggaatctcggggaggtgggcagtgctcctgggaaaaaggatgccaaagacacattcccacgagcccctgagtccacagtgagacgggctctgtgacagttctcttccagatggcttcggtggagctcccacatcagccacgaggaccgccggggcattcggggcacgcagcctaattctgtgatcaatcttcatgtgctctcctggtgggagaagcgtttactttctcatctgtgtgatttactggattgatgaatacggtgttattaccgaagaggcagcagtgggaattctcaaccctgatgcttcttgttggggtcttctctgtgcacggggcgcgggaggtgcctgtgcctgctcgatcctgtgacaaccccagtgctgcccgggcccctccacctccttccccagtgtctgcccctctcccaccctgccagtgggagaagtccctggggtttgccgggaaacttctggaaagtatgtttcagtttccgggggcagagttgtgattgttttgcccctagtcttgtccccatgcataggggatttacaaagatgttgtaggcagcaggaatcctgtgaggggtgagaatggtccttcattccctgggttggctctctggttttccctgtggcctcgatgactataaagccctggataattttgtctacacatcagggcagtgcagattaaccactgcagcgacagtgctgtgcgttagtaatatcactcaaagccaagagcccccgcagtgagaaactcccaggagccccaggggagggtctgggtaaatggcatttgcatctggatgtggtgtatccaccacctgcagactccggccctcacgggcaatgttgctacctgtttcacctgtgttctggatttgccaagtgaggaaggtggggaatggggcctcatgttatgtaactctccttcccaaacggagcccaggcttcgtcttcagtgccctgtctgaatattacaagcagttgcaaaggtgcaagctagtgtctcgagacagtgacatgaggttttcctggaaataaggaatgtcaaggaaatgtcacagtacgtcaaaactccccgtcccgtctttaagatgagacaacaagggaaggccactgtggatttgcaaataataattctgtttgagtgaaaggtggcatttctcaggttaagtgaatcccatgatttgattaaagatatttgtgtttaaaatattggtggagccttgtttcctagtatgaaatgatatgaccatttaggaggagagcagtttccttattttcctgagcctcagtttccccacaaggatggaggtggcctgggcatgtggctgagacccggctcttagaggccccacacatggttcatgctttgctggtaccatcttgagactcttacaattcttcaacaaagggccccacaaattatgtatacggctgtgaggccatgacagggttggagagactctaggaaaaactagaataacgtctgctgtggaggtttgcaatacatgttagctggacaattgcgctatttcattgctgttaggaaaaaaaacactctaatttctactgttaatggattcagattggcaagaagaacccattcttttctctagacttttcaatgcacttcaagtgtgaagcattgggtaaatgctggatttgggtactggacaccaggtagtgaagagtttcccaggcagttctgagttttcttgtaaaggcactttcatccataggacttgaatcttttatctcctggcctggtgcggcggctcacgcctgtaatcccagtactttgggggctgaactgggaggatcactggagaccaggagttttgagaccagccagggcaacatagcaagacctcgtctctgcaaaaccagaaccagaaagtatacactcctacgctccttgaaggcagggcctcggtctgtattgctcaatcatgcgtcatcagtgactagagtgtttctggcccataacaggggcttatttgttgaatgagtgaatgaatgattccacgaaagaatgggcagactgaattcaaaggcacatgggtttgactctgtttttctcaacttgctgtgaggccctgggcagattactgaagccacctggcctcagtgtgctcctccatggagtagagacgataatgtctacatcagagttgtagaattaaatgccctgcgtatgcagatacttaacaccaaataaagggtagctttccagatacattattaaagtaataaaatgtctaagccaagaaatatgtaaacacatgaacaagttagatttatatagaaatgacaccaaacactgtggtaaaatatgcattttacttatgacctacaccgtcaatactagataccctgcttggcgttattcttatttttctcaccaggaccaaataaaaatcacttcactcttccgaatgtgtctctccagtcagagacgttgcgcatgagctgattgcaggaggctttggggcagatgggcggggcaggttattcaggactcacctcctgcaggaaaggctgagacctgcaacccagggcagggaggaatataaacctgccccagttacaggacccagcggctcctcccaccacggatgctggcccatgagtgtgcgttacacttcatttgggattgcaaactggagttgtttgaaggctggcagttgccttcgggagttagcagcctgcgtgtccagagaaacaaaagtaaaacaagaaacaaaaccagagtgagccacagtgcccaggagaccctgagggatggtggggactgcgcagtggagccctcaggaacactcagggggaggagttctcacctttcctgcctgtcctacagcaccgaaggctgtggccaagctgctgaggcttcgggaaaaagcctgggtcctaattcttgggtgaatgcttctacttctaaatgttagtcactaataattcagtcatgtgtttgtgtagctcattaatccttaagcatcatgagagcgaagctgcaatagaaagcacagatgggggccgggagcagtggctcatgcctgtaatcccagcagtttgggaggccgaggtgggcggatcacaaggtctggagttcgagaccagcctggccaacatagtgaaacgccatctctattttaaaaaaaaaattagctgagcatggtggcaggtgcctgtaatcccagctactcgggaggctgaggcaggagaatcacttgaacccgggagtcagaggttgcagtgagccgagatcacgccattgcactgcagcctgggtgacagtgcgagactccgtctgaaaacaaaaacaaaaacaaaacaaaaaaaacacagatggggtggccctggtccttcgggaatggcgagcgttctgctgctcctggtgagatccggcccacccctgtgctgggggaacaagggtcttctcttgggactggtcatgccacccagcaggtgtaacaggaaagcagcctgcagtagaacttcaaaggaggcaaatgcttctaaagttcaaaggcaaagcatacatactgaacaatctgttttcttccaaatactccatgagaaaagtaagcggcaagacattccctggcacagaaaggatttcccaaatcccatgtaatggcaaagtaattgcaaagaagatacaatctgcacagtgatgcagttgctcaatgctttaagaaaataaagcatcattaataattatgttttcattaaggcttgcatgatgttaaattatcttgcaataactgtgtgtgtctttgtttcctcatacattcaaataagaattggttctctcttcttcctcctttgtaagctcttaggctagatattttgggaagttattgcctcatgtacgagaggcaggaatacacaattgtgcaggaaatgtggtaaaattaaaagtgtgtgtaaggaaagtaggtatgcattatgctatccacgtggaattccggagttttatgttcccgatgtctcctctgtaagaagacatagctggaatgaggcatgcaaagagaattctgtagcagccagacgtgagctcatttttttattggttttctgtcggtagcttggattagcccagcaccaagctgtgggcttgcctagagtgagggacgccagtgaacaaggaacaagactggaggaggcaagttatcatcaggaacaattcagggagtaaaagcacaaacagtgtgggggtcggtccagcgacagagtcaggaaaggacagtggtgcaggcctacctgtgggtccacagtgtgggggtcggtccagcggcagagtcaggaaaggacggtgcaggcctgcgtgtgggtctacagtgtgggggtcggtccagcggcagagtcaggaaaggacggtgcaggcctgcgtgtgggtctacagtgtgggggtcggtccagcggcagagtcaggaaaggacagaggtgcaggcctgagtgtgggtctatggtgtgggggtcggtccagcggcagagtcaggaaaggacagaggtgcaggcctgcgtgtgggtctcacacttatactcgtgcctcgcagaaggctctcagccaagaacgccgaagttgtgattctagtggtggcattgatattagaattggactatttggagctagcacctaaaactacaagggtttcaacttattcatctataaaatagcgattgccaaatgagttgccttaggtcaaattttgtggttgttactgagcaccacagcagcgtgctctcttggtttgcgcccacctactcaaggccagacacagggctggtttcttggaagttcccctgtgcctctacctcgaggctgaggggctggctttagggagcccctaaaacatgtactgtgtgtagtgagctcttccaggttttacctggcctcaaattatgttcagccagatatagtaagtctcttaaatcattatgattttgtttgataattttgagacctttattagcactgtgtttctctgaacataatactgactaagaaacagaatgagcaattcactaaatgtatagcccacaagatgggaaaggtttaatgcaaaatgattcttaagctataaacagtattttgagaaagtgtctaattatgtttgaattaatataagcaataaatatatacatatctctatccaccaaaccacccacctatcaatttttcatccatccatccgtctacctccccatccatccagccagccatccacccatatatctatccacttatccacctctctacccatccatccatccttctacccacccacccacccatctatccatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatctcgctacccatccatctatgcacgctttccctcacccacccacccaaccatctctctacccatccatctatcacctatccctcactcacccacccacccatctctctacccatccatcacctatccctcacccatccactcacccaaccatctctctacccatccatctatcacctatccttcacccacccaaccatctctctacccatccatcacctatctttcacccacccacccaaccatctctctgctcatctatctatcacctgtccctcacccatccacccacccaaccaaccatctctctacccatccatcacctatctctcacccacccacccactcacccaaccatctctctacccatccatctatcacctatccctcacgcacccatctattcatgttatgggcttcactccaaatccaggtgtcaaatagataaagcacaggtcagtctgtcaagccagcagagagcatgctagtaaaataaacaaacaaaaaacagtctacagaagttttgtttttttcatttctaaataactttcaagaaaattcaccagttgaaaagagaagcatttacttttatgttggttgtaaagcatcaacattaaatgattaactttaaaactatatttgttgccatatatgccttggctatcttctttttatccacaaaaagtcaagggaatctagtacctgaggcctgtctttatttaaacggactacaaacttgttaactactgcttaggcagtgtctattcagaaaactgtagtcaaatgtgttacatttattgtagcccttaaaggttgacttgatacaaataagcctgtgttatgtatcgactgtatagtcgttactatacagaaataacaacccccagactaacccaaccaaatagaagcctcggttcttatttaaaaccatttccgaaacatggaagcttttgtcagagatttgttcatcttcttcattctcaaccggacggttggtctaagaacagatggagctcagtgttttctttcctgtggttaaagtgtcatgccctgaaaactaatattcagaaaatcactttgagatatatgattgctaagacaacaaatattagtacatcagtatattgatgttctaaaggcagataattatatgtatttttaaattatttcactcataaaagtaggggaaaaagagatttccaaatagtcctcagttaagaaaaggccttttacgcagaactcttacactcaacagtctggttgatggagggctggtatgtttgtctcataagtcttgagtgataggagtatcctagaacacaagcaataaaatcagtgttaaaatgctagatgtcacttctcttctttgttggcatgttttatgaccatcaaaagaaatgagcaattatcaatatatagtaaactatcaagtggaaccactgagtgataaagaactcaggaataaatggaatgatatttaaaatagaggtaactatagctaaaattacagtgatgaaatgatctcttatctatgtacaacatatatggtttccttattttggttaaaggtagttttaagtcagtgaattctgtagaatctcagtgatatattttttcatgttatttccagcccaattgggagatgactcctagcggcaataaatagcttttgtttctcctaatatattcttcataggacccatgtgaacacattgttcgagtatcacacctctgagggctctaggcagcaggtgtgtgtgaagactccctctttcatcaggggaggaaggtttgtgtgaagactccctctttcatcaggggaggaaggatgtgtgtgaagactccctctttcatcaggggaagaaggtttgtgtgaagactccctctttcatcaggggaagaaggtttgtgtgaagactccctccttcatcaggggaggaaggtttgtgtgaagactccctccttcgtcaggggaggaagcgtttgcatctgagtgggcagcattcctttttggcatttcttccaccctaaatagaagtcacctttcacggtaagtgaatttgactgtcaaaaggtggatggttctcccaggaacagtgactcagaaactcctcctgctcttgcatcagacgcttcttaccgtagatgtgcctggcacgaccatcgggacgacactttcaagatctaccctgacgtggccatttacagattcctcatgagatcttcactgcacggtccagggtcgggaaagagacagtcccctcccttgtatcaaccacgtcattcccgaaggaaagcaaccaggctccctgagaaagcagtacagcgtgcggggactgtgtgaacccacacaagccatagtcaatttagagagtggattttatggaagaatttggaggaggagcagacccctcctgactgagcagggcacagactgacagctttggttcagagggaaccctgtcgcatgtcagctatcctgcccgatcctccaatgccctgcaatgtttgtcttgttcccccgattttgcagggtaaataatgtaatgtgcaaaatcgccccgcgaggaagtggcggttaaacaaacaattggatctcaagccttgtaagctccagtgctcccatcctctctacagtataaaattgaaaaatgtgaagaagataataaggttattgatgtgtgtgaaagcgcttcaacacagatgctaggcagtcgatgatcctgttcattcgcagattctgtatttgcaaattaatttgtaacccccaaatcaatgcttatgccaaagtcattcctgcacacacacacagccataaagttcaggttgcctgacatgcctgtgctcaggtgggagaggacagctccgccttctcgtttcagctcatactgtaaaacaaggctcctctttatggtctattgagtgccacattttccacattttttgtgcttttcgttggtggttttgttgtttaaatggccccagcacagtgctgagtgctgactggtgttcctagtgttgtaactggctcaagtccagctgtttgccactcagaggccgaaaacatgagagtgaggtgtgggcagaggaaagcagttattaatcaaacgctggcagctggggaatggccaggctcatgcctttaacagaccattccccctttgtggctgagtgaggggtttaaggaggaaaaggcatggagctgtgtggagtggtgcaggcggacgccaggctgtgtgtgtgttctgatggttatctcatcgtgcagaggcctggtttctatcattgtggcttcagcctgggagcggtgggctacctgttcctaactccccctcagcggaggattctgcagctcagtctctctgcctgttctgtttgaaaattggcccctggaatttctaagcaggtctgtaattagataggtgagcactgtgtaaggagcgcctggtggagaagggagccacgaagaatttcacagtatgcttcaaagccaaagcaggaatgggaaggaagtgctctgtgtgtgaggccgggacacgtggttacaatgtgcctgacggagaaaacacccatgtggatgggcgtcgtgtgtgtggatgggcgtcgtgtatgtggatgggcgtcatgggtgtggatgggcatgtgtggatgggcgtcgtgggtgtggatgggcgtcgtaggtgtggatgggcgtcgtgggtgtggatgggcgtcatgggtgtggatgggcatcgtgggtgtggatgggcatgtgtggatgggcgtcgtgggtgtggatgggcgtcatgggtgtggatgggcatgtgtggatgggtgtcgtgggtgtggatgggcgtcgtgggtgtggatgggtatctgtgtggatgggtgtcatgggtgtggatgggcgtcgtgggtgtggatgggtatctgtgtggatgggcgtcgagggtgtggatgggcgtcgtgggtgtggatgggtatctggatgggcgtcgagggtgtggatgggcgtggtgggtgtggatgggcgtcatgggtgtggatgggcatctgtgtggatgggcgtcatgggtgtggatgggcgtcgtgggtgtggatcggtgtcggagtgtatgggcatccgtgtggatgggcgtcgtgggtgtggatgggcgtcatgggtgtggatgggcgtcgtgggtgtggatgggcatgtgtggatgggcgtcgtgggtgtggatgggcgtcatgggtgtggatgggcatgtgtgaatgggcgtcgtgggtgtggatgggcgtcgtgggtgtggatgggtatctgtgtggatgggtgtcatgggtgtggatgggtgtcgtgggtgtggatggctttctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgtcgtgggtgtggatgggcgtcgtgggtgtggatgggcgtcgagggtgtggatgggcgtggtgggtgtggatgggcatcgaggatgtggatgggcatcatgggtgtggatgggcatcaaggatgtggatgggcatcgtgggtgtggatgggcattgtaggagtgtatgggcatccgtgtggatgggcatcgtgggtgtggatgagtgtcggagtgtatgggcatctgtgtggatgggcatcgtgggtgtggatgagtgtcgtgggtgtggatgggcgtggtgggtgtggatgggcgtcgtgggtgtggatgggcgtcgaggatgtggatgagtgtcgtgggtgtggatgggcgtcctgggtgttttctccccgagagctgtaatattaggtgcagtacttgctcctaagagactctgcagggctctaggcatctttgttttactttttatttcctgattagtacagaaattccccttttgatgctggcaatatgcacatgggatttattcaattttccccaaatgtctaaagagacagaaagctgaacaagatggcagagacaaccaaggctccctggttagaaagaagttggtgggaaggctgacctcactccctacccagaagcctctcacctggaccacacagcactcagccatctgccacctgcacagcagacgtggcgggcggggtggggggtggtgggtggggttggtaacaaatgccagggcaagttcttcttgtggggagggatctctgctgctgatggtgctgggggcagagccagcagctcagctctggagcccccagtgttgcccctgtttactgcagacccgctgggcctggccaccagagtttattgaaaaccagggtctcctaggccaaagcaagtccaagaggacctgtgggccttgccacactcgacagctgagtaaactgaggcccagcggaagggcccaggagggccacagaacagtgactcatggagttagacctgtagtggggcctcgggatagagacttcttcccacgtcagagcagccactatgggttttagggaagagcctgcacgtattcaagttagggaaggttatgcagttggggtcacgttaccgaccctctgagtctcctccggagacagctcctcatgccctgtcctcccacagggttcctgagagcacaagggccagagccagggctcagtgcaccgtgaccgcaggcacctgggtctcgctgggcctgacggcgacggtcactgggtgctcaccgcctgcgagatgtaccccgagggtgtcaggagcactccctggtgatgaccacagccccacgcaatggtgacgctcggcatgcgtgcaagaaaggacacgggctgtgtgggcctctcctgcggcccccacgtgaaatacggggccatggatgggtcacatgcttcttcatagcataggggtctgggtctttggactctgaggaaccaagaacctcctcacagcctttagagaaaactttcagcacgtgagggaaaaattaggtttaggatattccagtcccatctgtcagggaatcttcagatgtggtcgagattacagtttcacagatgccgtgtgtaagcttgaagccctgtggctgagctctctgtcctcagcgttgtttcgggggtacatgagtgctgcttgtgttaatgaggactttctcttaattttagaaaaccattcaaccaaaatgttgaaccggtcacaaatatgaattgatcacctcctgcgtgggtgaggccgtggcagaaatcatcatgcatgcctcaaagagcccatcctgtgctcgggaagaaggaaaacatctataaaacgtctggtgtgccatttgagcactaaatatcaggcactcagggcccttctggaagactgtggagacagggagaatcggccactctcacagtgctcactcgggagtagggctttgagagggggtagaactcagcactcatgagcgagtggaacatcgttggcaggagagctgcagtccagggagggagtggcctcctcctttctgagggcccatagtggggaccagcagagggcccagccgaggcaccgtagacaggcctggggcctgggctcgagaagacaccagctcctgctccatggtcatccctggaggcggcttccaaggacattttgcatgcagtagagctggacgcaggaagtcactcagctctgctgtgacagggcacaggcttggactagaagatcacagtgggaaccaagaggcagtggtggacatggtgcattttccaagggtttccgcagaatttggtgactagctggatattcctggcataaggaagccaaagggaatatccgtaaggttagaatgctgtttgctcctcagagcaggcgctgattcaagggagaccttgttgagttcaaagtgatgctaagacgtccacatggaatattcagccatggtgttaggatggtaattgtgctgcctcgtaatggcacgacagtccccttcaccaagggcttgcacatggaggagctggccctggctgggagaatgagcaaaaatcccaaggaggaagaccagaggttgggactgaggtatcatgagcagagatgtctgaatcaaaaatacatgtgaggttgaaaggattttgggtgcaaaatccacagcctgggtgtcatatgctgccttgggatgagcctgtggtggagggtgtgtggctgcagtggggacagcaagggaccctgggctacatggtacccagtttcacagcttagatgtcagtgcaggcacctcccagggaccaggaagcaacagtcttagctgccctctcccacctaaattgggtcctcttcgcatttcctgtctgttccagggatttacttcttagaagacatttaaggggtctgttccaggaagagctatctatggctgtcatctgtggacatggggtcagtctgtctgtctttgggaatggaccctggattcctaattcattttgagatggctgtaggcacaataatcagtttctactgcatatggggtcttcagatgaattaaatggtttaaaaagtaaggtattttttcaaaattgtggttgacatagcatttaaaaagctttgaacaattttgataattcctgtctagcaattccctgccagttgtttttatacagagtagttcttaatgactttggtagttttttaaatggttcctgtcaaaagagtttaaaaaatactagtctctttcctctctgctctagattcatacatctcccttggggaccaaagactaaaatctatttcaataacaacttttctttttctctagcaagaatatctgcttgctgttgctgggttcagaggttgatgtgaattttttaggatagcatattacactgtgatgtgtgttttggaaaagcaaagcccaaaaacggaattcctggcaaatggaaacaaaggtcatggtgtgaaggaaaaccgacgtccagtggagtcgacgcctggagccacagcggccttggatgtttgcgtttttaaaaacacaccagtgttttccatgtcgttttcagaaaagcggtgtggcgcgtagacttcgttatgaacttattttaaattatcccttccagggttctcggaccagcagtgaccttcaaagtgagcgccaatgtccaaaacgtgaccactgaggatgtggagaaggccacaggtgaggctgtttccgcacacacgtacacgcacacacacgtgtgtgcacacacacacgcacgcaaacacgcacatgcacagccagggcagagagagactcacactacccacatggggcaacccagaggaaggtctcggtttccgtggaaatctggtgtgcagtgaggggacgaggggcagtcacagggcaatgtggctatccgtgggcaccatctgggatttcactgtgtggagagggactgggctgccctgatgtgtggaactggctcagatagaaggcaggagacacagggctgcaagtgaccgagaacaaatccggcttttggaaaagcaagatttggtgtttgtagtaatcccagtgtgtgcagagcacgtgcaattttgctttgaggtttttcattttgtaccagaccaggagcacacaccggccctgctcccgactgcggtgggcagagacaccacaaagtatctgggaggtttcagtaaaaaccggccgacttccagacggtttcactgtttagagcccagggttctgggcattgcgaatcacacatttttgagatgtacttacagatagagcttgagtaatctttgttatatgattaataattgtcattgagtgaaaaacacaaagctttactctccagagtcttgaagaacagaatgggatggtggacacaatgttgcattttcctcaacctgccttttttttttttttttaaacttgttgaaaactcttgtagagtgtattgtttaatcttcctgcctagtaagaaaaatacaggaagcataacagaaccttagcctgatggttttcagtgcattagggccattccgcaggcagggcgctcccgttccgtatcattgataagacaggacggaacacactgacccagccacagcgggaaatgacacttggttttagccagtcctttatattgctaaatctatgaacttgtctttttttttttttttttttgcttaaatttgtgtctttttttcccagtgtaaaatgcagcaaaatactctggtttatttcgggatttcaatacttagttctcgttgattgaggcgtcactgtactggcaccctgtaaacttgaagtttctttttccagtgagagtaatcaaggtgtgaagtagccaccatgttctaagggatggagcgaattgctggtcctatctgttttggctgctgcgggttttgcttatgggatatcctcgtgccctcagtaactcctttgctcaaggtggtgatttagggggctgagaatttgtggttgaaatacagtgctttgcaaagttgtactaaacttctgcagtctgatttaaggtttgtggagacttgagtccccagtctcactttgttgccatactttgctgtgaggcttgtggagctggggtacaactcggaaaagcagcccagcatcctcactccagctgggcggtccagtgcggtcccagcatgaaaagtcagtgggatccataccaaacactcccacgcaagaggaatggggggtcccaacaacggcttcagtgcctcgtggctgccagagctccctccctccatggcatctgtttcgcttgctctagttccctgtcagaagtgattattggagatatttaagaccaaatccgtgatcaggtattatgcagaaatgcattgataattatcccatgattggcagtttctccagtactggggagcaatgccactggaattaggtttgcaggacctcaaggatgctaggaatggcaatcttgttatatttttaaaaatcataacaatatactcacagacaaggacctttgatttattttatggctctctagagaaaatgaggttgattatttgaaagctagtttctcagtcatttcaaatgtgttcatgttatttatcgaagtgctgcaccaagggggagccacataggaaatgtacatttgagtctcatattgacaactttctaaacacctgaatttgctaacttgcaccagtgcctccatgttaactcctgtggctgtgtgagtcagaatgtttcttgcttcttgaacgtgtgcaaaattgtttacattcatgcatgatttttaaagaattattttgaataattctatggtgtcatgaacgtgcctgatgctatataagaaacagattggccgggtgcagtggctcacacctgtaaacccagcattttaggaggccaaggtgggcgggtcacttgaggttgggagttcaagaccagactgaccaatatggtgaaaccccatctctactaaaaatacaaaaaaattagctgggtgtggtggctcaaacctcagctactcgggaggctgaggtgggagaatcacttaaacccaagaggcagaggttgcagtgagccaagattgcatcactggactccagcctgggccacagagggagaccctgtctcacaaacaaacaaacaaacaaaaaaaacccaagagattataaaaaagaattttgtgactgtgaagatcttgcaggtaggcagtggacatgcccatgtgtggtgactggcccatcggcctcaggagagcgcttagcacggttggtgactggtgactcgcccattggccttgggagagtgcttagcacagtgactggcccatcagcctcgggagagcgcttagcacggtgactggcccattggccttgggagagtgcttagcacggtgaagaggagcctcttactgagtttcaggtgagacgtagacaggctgacatgatagcagggaagaatttcaaattcaaaaggagtttcttatggtttgtgttttaaaagatgatgtggaatcctaatagtgtcatcacaaacgccctgtggtgatgggcggacacctatggaaggacgtgtggtggtgcctgtgttaccaacatacagaactcaagagcctgctgttgaaattactgggagtgctgggtgctgcctgcacctgccacctgccagctgcctggaagcccaatggctgctggcgtctggttccctcaagggcctgaggacctgaggctgctgttattaatgcggggagatcaccctggcggtagaattcaaagggcattcattttgctaattttatacaaaatgatacaaaacctaatgaataggcgtgtagttaatcccacattagtccccatcaaacgtcacgtggtattgatgccgaatgagaagggcagctgctgttcattactcagcgtctcctctttatcgtaggcaatgctttcccgggaattctgctaatttatgaccttgggtatgagcacagggtattagtgaatattaaaaataagtgggttttgctcaaggaggcacttactctaccacaaagtacatagaaatgactggtagctacgtttaatctccgtggctcagtcacatagttgaactggcagaagagaaaaatcctttttattcttcatttccttggtagtttcttcttaaatagtatatttctgatcaatttttgtattgctcctttcaaagaaaaggaaattcatcatcctttagaaactgtttgcttttgctggctcccagtctgcagagaccctcacccggtggcctgtggggctgcctgtggtttatgagcttattgccaggaatcccctcccatgctcggccgtttccttcaggccgagttcaggctgtttcttcaaacattccctctcgggcgccacggagggtgtgtctctggcactcagccctgtgtggtgggggtgtggctcatagggggctcctgtgctgaccctgaatggtggggtgaggctcatggggggctcctgtcctgagcagtttccccctttgacctcagcatcctccacctgacagcctctaagacacggcattcagctgccattgtttctttcagcctgttggagaggcgccccgtgtcatttcagtagcggcgcctctgtattcagaggtacggtgactttccgtgacgtcctcctgcttctgcctgttcggcatctttgtgaagctggtgagtgtcagaacagggtcgtgtctgctgtgctgctgtctgtgtttcacgtctcatatgtagcgggtccacatggaggaagaggctcccctcctctcttgtgagcctctcttgaatcccggctcagaactggactctgtgccgatgcctggaccccatagcccgcagcgttctgcgttagtcacaggcctttctgctggagcaagggctgcccaggcttctggcctctcataaagcagacaaacgtgcttattttgaaaagcgtaatggcaaagtgaagtgaattcctttataacacatacttacaatccagccagccttaactatcgaccccaggcaggcatcggtgcttcacagtctggtccgctccgtgcggattctgtcttcggcaatgcatcacaccttcctaaggtgatatcactctggatgtcagtggccctgccctccagaagctccccccaaccccggtgccagggctgttcagacgggagttcttaggggcagtggatggcacatcggggagggcagggcagggcttagatgaggctccacagagaagctggcctttgggcagagcacagggactagcgtgggtctcaggggctgaaggtgagaggaatgagaatggtgcagcctggatgtggggtccagtgtgccaaggacatgccagtaagaggctggcaaggtggaattcagaatcggacttcatagtgtgggaacttcatcttcagcagccactaagaaggacttgggcctgagtttcactgcagctgatggaatcagctccgctgaggtggacacaggcaggttggccccgggggagggggaggggtgccttgctgctgcagcattggtccacaagcggcagacgttcctcatctgactcccatgcaccagctccccagggaggccacgccaggtggagctgcatgctggtcaccagcagtggggcctaaagccatccacgctcccacacacccactccccagggaggccaggccgggtggagctgtgcactggtggggcccgaagcccatccgtgctccggtaccaccctcatgattaagagattggagcaagacaagaggaactcctgagccatgagtgtggaagggaagttgcactcttattagaaatgaaggaggatgctttggaaatgttcaaaacagccacttgctgagaaaattgcctccatgtgcaggtgaatgagacacctgtcagactgatgaaagtgactctccaaggacctgcactctcctcaagggtcttccaggcacagggatcccagcgctccccttcgccagacctccagggtgcagctgagaaacagcgccagagcagtgagactggaggtgtggcctgggcagcccggctccaggttccgctgcacgtgggccgctgtgtcacgtcctccatggagctgagctgctgccaggatcaacgcaggctgggggctcctgggctccagctgtggctggcgtggggctcgtgctcatcctgctgctccgcagccatgaggttgacgatcccacagctcgcctggctgaggtgtcacccagagtgggcgagggagatgctcagagggaagcaccacgctctcctcctgctcttagaacgtccctgactcacggcacagacacagacgatgaggagtaactaaaaagaggagcctctaagagaaaaagatgaagaagtggagggcgcggcgtgggaagcgtgggccggtggtgctggtggggtctgcacagtgggccccgcaggctcagtgcccgtctcctgctggacctgctgcgttgggggcggggagggggcctgcagtgtgtgaaccagccccagcttgtgtccagggccacgtgggctggacatggaacaagaactcccacctgcacgggagcgcctcccctgggctgccggagagaccagcagacaggaacattggtaaggactatggcgaggttctgctgccaaagagcaggtgccctgtggctgcagccccaggaggttgtaaacaagtttcggtttggatggaggctttagggaatcggagatggtaggagctgcgccccatgactccattctgaacagccaggtaattacttctggcattttgacaagtgtttgcaggagtggagctcagggctggcagcacccaggacctgtgctgaccttcccggctgcgaggacagaggccacccatggctctgtaattacaagtcccgaaagccgccttcatcatggctttaccctgagcgcagacaacacaacgctgtggtagaaaataattgcatcgccatcgacagggctaccagcgtggaacgccaggagccgcatgtgggggacactcggggatactgctaaaccaagggctaggaaactgcgttgctcagcagccacttttctgtgtttatttttacacagagggggtttatgcactggacataccactcatgggagcagctcgttctcacctgcaaatgaacgagcaatgctgatcctgctggcagagggtgctgccttgtcccctccgactcactgctggggagcacctggcccccctccaactcactgctggggagagcaggttccatttcatcctcactttcacgttcatttagaattcataccctgatcagggagaagagcccccagggcctccagcttcccctccacctcgggagccacgtcagcacgtctactgcgaggggctgactgtcacaggtggccacgggagctcacccctagttggctggggtttgggagcagcctagataaacacccatagaaatgccactaagaccttttcatgccaaaagttgtaaaacccgcttctgaaaaacatgagtgagagttttgaagtgcgtgggattctctgcaggctttcacatgtgcaggaggcttccgtggccagaggacctgttagaaacacagtgaatcaccaccacctccctgcgccttctgttgcctgggaagctgccgagggggtctcagctgttctctccacggaacgcccagcctcccagcagagggatcgtcggcaggaggctgtgatgctggtgcagtcggctgccggggcaggtgaaatccagcagaaggccctgtaccctggatgtgcaggagggggttttgctgacggtgtgacggtcatggagcacactgtgggcgtcgctgagtttcccaagtattactcttccctgcacatgggtttctgtcttcactgccccaggccccgtggggttagagactgacgggaggacggcaggatggctggcggctgtggccaggacacgtatgtcctcctgtggtagccgtcctagcccactggagatgagctgtgctggaggggagtcccaggggagccgcgtctgctggtgaagatgccgctgggctgtgggcctgggggacgaggcctcaggttttgctggaggagcctgctgtccacttggctctctgttttgctgtgttgaagccctggtccttccatgatgcgaggctgccatgcctgttttcacagccttttcttttcctctttgtccataagcgaatgctgtttccactctttccctcacctctgaatagaaagggcagtgtcttcataccttagtaggaagcggcctcatctccgcatagaaagggtagtgtctttataccttagtaggaagcggcctcatctccgcatagaaagggcagtgtcttcataccttagtaggaagcggcttcatctccgcatagaaagggtagtgtctttataccggagcagaaagtggctcattttaaatcagggctgtgttctgcagggcagctgggcagggcatagctttgagacctgaaggaggaaagcaaggggtgcccgaggaaggtgcacttggagcctgcagggagaggccagtgcggccctgaagccaacgcatgggcccacaccctcccccgggcacctggagacacaacttccagccagcacacaggtgcccaccatgctccttcctcctgcagccgcggctcacaggctgtctctgagctgaggggaggccgatgtctgccagaagccacttcttgggagttcttctaccaatatcagttcccatggcaactcgacagaagcagtaggggcagaggagccgagatggttctgagtgcaaagatggtgctgagtgcaaaggtggtgctgagtgcaaaggtgatggagagtgcaaagatggtgctgggcacctacctccccagcagatcctgcctcagctacagccgagccactgccctctgtccctggtggtcggcccaggagtcctgccctgtagctgcaccaggtcacaagcctgggccatcttgggcagggcagagggtttctcctgctctgccatacctatgggccccttgggacaagctcaggtcttgagacatgaattgtccaaatattatgacttttgagagactctgaagggctcaattatttaaaaaattatgttccgccagcccgttggcatctgaaactctcccttgttgtctccttgtgctttggggaccctacagggctacacagcagctggagtgtgtggcacaaaccccttggcagttggtgtcccctgtgagtgcacagttgatcagactaacacagagttaccttggtgagcccaggaaagttcctcctgacaccaggactccggagaagcagctcttggttggaaggcaggggaggttcagtgaagtccgagagctgcctgggatgggtagggaggggtccctgagcacttgggaccagcatgaggctattcagcacttgggaaacaattgctcagaagcttgtctgctggggacgcttgtcacaggcaggtcttacctggtcaacacctgcccaaggcccctgggctctcaggccttgcatctgattctttgcacttttcctcccagcacgggaatgccaaagctctgaaggcccattcttgaaaatttacatgatgattcacacggcaaggctggcatctgagtcccctggccctgtaatcgttcttaataaggagggcactgcacaccatcaggcctcggacttatcggccaggacagcattctacgtatttgcattattggacaagagtccttgggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctccatcaccacgagcatctccaccaccaagagcatctccaccaggagcacctgcaccatgagaacctccaccaccacgagcacctccaccacgagcacctccatcaccacgagcatctccaccaccacgagcacctccaccacgagcacctccaccaggagcacctccaccaccaggagcacctccatcatcacaagcacctccaccaccacgagcatctccaccaggagcacctgcaccatgagaacctccaccaccacgagcacctcaccaccacgagcacctccaccaccacgagcaactccaccaggagcacctccaccacgagcacgtccaccaccacgagcacctccaccaccacgggcaccttcaccaccacgggcacctccaccaccacgggcacctccaccatgagcacctccaccaccacgggcacctccaccaccacgggcacctccacaccacaggcacctccgccaccaggggcacctccgccaccacgggcacctccaccaccaggagcacctccaccaccatgggcacctccaccaccaggggcacctccaccaccaggagcacctccaccacaggcacctccaccaccacgggcacctccaccaccaccatgggcacctccaccaccaggagcacctccaccaccaggagcacctccaccaccacgggcacctccaccaccaggagcacctccaccaccacgggcacctccaccaccacgggcacctccaccaccacgagcaccaccaccacgagcacgtccaccaccacgagcacctccaccaccacgggcacctccaccaccaggggcacctccaccaccacgggcacctccacaccacgagcacctccaccaccaggagcacctccaccaccacgagcacctccaccatgagcacctccatcaccatgagcacctctacagcagttggctgcttacctactgaagctgagggcaatggagcctccttactctaggtcagtccctgcttttggatgtctgctgtgttggccatagtgcagtgccccatggattaggcaccaatctaggtcaggtatcagcctctccagccctgcctggatgttctgtgccacttcatggcacctgaggttggcaaaatggaagaaggaaaaacaagagcttggagtttagaacttgagttcacagcaccctcccagctatttgcttgttttgtgactttggacgactcattgactgttttcaaacctcagggtgccttctctgtcagctagggccaatagttacactccgcgaggctgcattcagatcaaatgaagtgggaataatttgatgtgagagcaaaatgtaaagtctgagcagtttataagttgttggttgccattgctcactcaagatgtccattggccttgcgtgcctgggcatcccacgaatgcctggagtgggaaagatgccatggcaaatcctcatgaagtactctcttttcagtagtgttctttacttggctacaagcagacagtaagatgtcatggggttagaagaatagcaacaattgtgggtaaagaatggaggaggtggggcgtggtggccatgcctgtcatcccagcactttgggggttaagaatggaggaggtggggcgtggcggccgagcctgtcatctcagcactttggggggtaaagaatggagaaggtgggggtgtggtggccatgcctgtcatcccagcactttgggaggccaaggcaggagcatcacttaccaggagtttgagaccaggctgggcaacatagtgagaccccatctccacaaaaatatttaaaaatttagccaagcgtggtgatgtacctgtaagtcccacacaggaggttgaggtgggaggatctcttgagcccaggagttccaggctgcagtgatctgtcacaaccatggtcacaaccatgccactgcccctgagcttgggtgatagagcgtgaccctatctctaaaaattttgtttaaaaagaatgggagaggatcttgagctgataagacccaccgtgtcaggcactaagacatcttcttgcagtgctgctcactcctccctggactgtcttcagtgtcaagatgaggccgcttcactaacgagatgcgatgattcgtatgatgcaaagcccacggcttacagagagcacgtgaagatggtgtcggcagcagggttatcacatcctctggcaggcagcttgggaagggaagtttcaatctgtgttgatattttagcactgattaaaggtggatgtacaattagaccttttaaatttaaagacagtttgcactctatcaacaccttgtcttattacagttgtaatccatgagaaagcaagttaagaatgagaagtcatgggcaaaagtaattacacaatttcctcatgtggtataaaatggtacaaattgaaaatcccatcagcttcacagcccttgaccgaccaaaatgacatcccccaatgaatgctggtggcaggagcttaaggtgcttcctgcttagagagatctgcatttctgtttagaatgaagcaggtgtagataccttagttcacagtgatgatttgggctgagtgctcacattcaataggcacccggttccagtggtttgcggggtttgatgatgcatttttaaagtgaagccgtaccaatgcaggcccatgcttccctgaggacgcggcctccgttctgctgagtgcaaaggtggtgccgagtgcaaaggtggtgctgggcacccacctcctcagcagctcctgccccagctgcagtccagccactgcactgggtccctaatggtcctggcgtgggagctgtggcctgggcctcctgtgcactgcaccgtaccctcggctgccatgagcacgggcaccccacggggacagcaagctcagcacccagtgggcctgatcagacagccgcctgcgtcgtttcatggctttctccttcatgttgaaggagtgacagggacactgagggatgaagtccccacgctctggcctgctctgctcagtcagggccgctggcatgggccgttcttcccctgggactgcacagcctggacccccaccaagtcctgttgcccaccctggctcagctctcctccagcccagcatgcctgccttcctccctcctttccccatacccggtcctgccatctcccagctgcaaggtccatgccaccccacaggaagagcctcagcggctgtcctcagaccccaccctgtctgccccgaccctgccgcctcaccaaattctaagcacaccatgacccggcctgccctggtgtgctgcccatggcccggcgtgacccagtgtgctgcccatggcccagcgtgacccagtgtgctgcccacggcccagcctgacccgacccggtgtgctgcccgcggcccggcctgacccggtgtgctgctctgggaaggaagcctggtgggaacagtgctcactcactcactctgtcactcgctcactccttcacgccttgtctctggcagctttcgccacaggcagagctgcgtggtcacggtggactgcccgacccacaaagcctccgacactcactctccagcccgttacagaaaccttttctcaagattgtagaacagcagttctgcaaacggggcccctgagcaccagctggaggtcgttaaaaacgcagactcttgggccccaccccagaggttcagaacatgtcctggaggcaaggccagcaagccattgggagcagcccccagggacctcaatggcactggagccgagtaccactcacagctgcagtccaagagctcctgaagacaaacccctgccccctgccagctgggagctcctccacagtagacactcagcaaatgcctgctggccggagcagcggcagggaaggtagacgactgcaaggcattggaaacggcccctctgcatcaggagacaccctgggtgcaggaggaggcttcgctgaaaagcattgcaacagcattatcacatacgtggaaataagaattgcatctcaacccttcccttgccctccacccatctaacatgcctcagccctcctgtggccatagtaacctgaacagtaactacagcagcaggctgcttaggtgccaggtgtaagaagagaaatttcatgaaaacaggaaaatatagcctgcttttctccccagctctaacctttcaacctataactactccctactgtaatttttgtgggatttgctgatattgaaggaagatgattgaaaatctgcttaagatttcgtctttatttcccgcttgacaggcctagggccccactgaggaagtgtttctctctgcagagccctcagccaccccatatgtcccagggatgtgctcaagtcacgaggaccagtcctttgtgtcacatcctgaggtccagagtcacctgccagccttgccgtctgcttggcattattaattttcccataaagtatacaatctgggtaaggatgtattcgtaagggacttcaccaggtgagagtcaccacaactcaggtgtcaggtgtgtgttttctaaagccgatcttagcgttaacgttctcctgtagggaaaactactttctgtctctctacagtgcctggttttggaatttctccacggtgttttgtaaatgtcttgtgacaccagctgaaaaggctgtgttcctttgagcactcagagcccttccatactgaggagttgggaggtggttgaaggaaaggaagcagcacagcttagagcacattctgtggcaaaactgccagagagagcctggggtagccatgctgcaggtcagtgtgcctgtcggccctggccctgagcctggcagcccatatttagagcctcatttcatcctggagccagaagggtggctgtttgcagagaaggccttgaatggaggggactcatccacctcatggaaggtgccatcccaggctggtggttgggaacggagagggaggcagagggggcacaccatcttgctgacggagtcttattttttgtgatgcctccgagcctcaagacccccaagctcacagccattccttgctagagaaacaaagcagcatattatgtgattttcagaggaaataaatggaaacatacaacgtcatgtcagagggacgtgggacacataggtaaactgaggcatggaaagaaagcccgtccctgtgtgaggttagagagccagggcaggatctttccctgaacgaaactctttgcatgcattcctgcccatccacctcttcccttttaaaaacattttcttcaagaattgaatggccacataatttcttattctaaaataagacagaaagacagtgccattcccatgctctggggtaatttccattttaaatacgcaatttctcctcttttaatagaagtcagatttcttttatctgtaattaaatccagaatatggttttttttaaggtcctcgtggagttttgactttactgttctgaaaatgaataagagttctgagcgtcagtttagtgaacaactcaactcattatccgctggttgtgaaatacaaaaccttggtctgacccgtgggggccgtgtggtggtggcagcccctgccctccccccgggtctgatggctccatctgccccgccagccactgtctttctggccgcagcccgttagcccagggccctttcagcactgacctgagacttggctctgacttggtcagatgaccatgtgaacacagctgcttctggaggcccatattccgcaaaccatgcccctgctcactgcaggattctgcacgttgcattttggagtaagtcttcggtagaccttacaggactcccccatgatcttatgtccttggttttcatgaagggtgcgaggtaagaaactcattgagaaaactcacctgaagctgctgaggaggctccgccaagtctctcagccaggacacgcctgagtgcatcttggggcccatgaccaggagagacgttggtgttcctggtgaactgcatggttcctgccaccagacagtcagagccactgccatgtcaggcgtttctctcgtcccgagtcggcaatctcactcccagattttgtgctcacctgcttagcttctctcacccagaagtatgccagattacagtcaattaccagatgcgcagcaccatctttctgcctttcttcccctggattacttgtttctcagccttggtctttattaagctgagtgtttatgcctgcgctgcctgcagcccctttggaagcaggtgaagcatccatcatccataaaattggccactctgtgccccatccccaggaggccctggcactcctttccccagggacacccgacagcccagcagtcatcacagagccacgctgtgacttggaggagaatggggttgagccaggagtcagttctgttgcggggagggtgaccctttctcttccctcccctgcaagtagaaaatgtcccccccaccagtcagcttctggaaatcactggcacagggggggctttggtgagtgggagatgacagaggccctgaggagaagaaaaaggagcatctggggaggaaggagtccttggcgtccctcagacacagtgtgtagatggctctctttttagcagccagattccaggaaacagctggacaggaaaccatggggcagtgtccggcgtgaccagtgtgtccaagcaacctcacagcgctgggctccccaggctcccccggctcccccatggctgtgaccccagtctctggccccacagctccctcatgcacctcccatgctctcccgggggctgtggctgtcctgggcatctcgtcttggtcgtctgggtaacaggtcctgagagacgtccccaggagaatgctgtgcatgtcccgggctctccagctgcttctgagccctggacttggacacccagcacatgttcaggttgccagagtcaatgcggttaaaccccaacttgctcgggatgcctgtttgttagatgaactatgtggaattcaccccaggtttctctgtcctcgtatgtgggaaggtttgtacttagaggctgagacctcgtcgcctctagcagcaggcacaggcccctgcatggccacattctgctgagatggtccctgctggtggaattgtggtatctcactgagcatgtgtgttgtcttgctgtatgagcccgtgtctcactgtgtgtgtgagtgattgtatgtagtgtgtgtctctcactgagtgtgtctcactttctgagcacatacatatgtgtgtaagtgtgtagaatggtcattagctaattggtattaggttttgtcgtggttgccttctggaaactctgtagggcaccccattccctgacctgctgtgtccagaattggtgggttcttggtctcactgacttcaagaataaagccacggacccttgcagtgagtgttacagttcttaaaggcggtgtgtcccgagtttgttccttctaatgtttggatgtattcagattttcttctttctggtgggttcgtggtctcgctggcctcaggagtgaagctgcagaccttcatggtgagtgttacagctcataaaggcagtgcagacccaaagagtgagcagcagcaagatttactgcaaagagcagaagaacaaagcttccacaatgtgaaaggggacccaagtgggttgccactgctggctcgggcagcctgcttttttccccttatctggccccacccacatcctgctgattggtctattttacagagagctgattggtctgttttacagagagctgattggtcttttttgacagggtgctgattggtgcatttacaatcccctgagctagacactgagtgctgattggtgtatttataaaccttgagctagacacagagtgctgattggtgtgtttacaaaccattagctagacacaagagtgctgattggtgtatttacagtcctttagctagacataaatgttctccaagtccctaccagattgggaagacacagagtgctgattagcgcatatataattctccagagggacatgaaagttgtttaagtccccacccaattcaggagcccagctgggtttcctaattggatcccccgccagcgccacgggcggagctgccagtcaccgcctgcattattcagccgttgggcggtcgatgggaccggtcgccgagaagcagggggtggcacttgccggggaggcttgggccgcgcgggagcccaccgcgggggtgcttagacatggcgggttgcaggtcccgagccttgctctgcggggaggcggttgagtcccggtgaaaattctagcgcggcgcgggcgggccggcagtgctgggggacccggggccccttccacagctgttggccggggtgctaagttgttcactgtgcagggccggtggcgccggccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagatggagtgtggctgtagtgatgtctcactgtgtgcagatggagtgtggctgcagtggtgtctcaccatgggcagatggagtgtggctgcagtgatgtctcaccgtgggcagatggagtgtggctgcagtgatgcatcaccgtgggcagatggagtgtggctgtagtgatgtctcaccgtgggcagatggagtgtggctgcagtgatgtctcactgtgggcagatggagtgtggctgcagtgatgcgtcaccgtgggcagatggagcgtggctgcagtgatgtgtcaccgtgggcagatggagtgtggctgcagtgatgtctccccgtgggcagatggggtgtggctgcagtgatgcgtcaccgtgggcagatggagtgtggctgcagtgatgtctcaccgtgtgcagatggagtgtggctacagtgatgtctcaccgtgggcagatggagtgtggctgcagtgatgcgtcaccgtgcgcagatggagtgtagtgattctactgcagtaagtggctagattttcatggaagaaaagaaaactcttctttatgcagatttacttacaatagatcattgtacttatttatttctagataattatttgtaaagcctgcaactaaggaagcattctgtatatgggttgtgaggagggaaactttcccattaaacagattagcaggaaacaaggaaaaaaagataatgtcgtattcgtagacctgaggactttaactccttcacggcccgtgttccttgggaagcttttgctgtgtgtctttccaggtgtggtctggctgccgttgtggaccttgtgcacatgaacatggcagatgggggcagatgaggggtcccaagcagccacgctgaggagctttggggagtggcggggatgctgaggctgggttcttggagactttgctgtggtccttttcctcatgaggaagtggggcctgggctctctggggtcctccatgcacccacttccctttgctcaggaggggagggcagctggccgtctgcctcacccactccaggccacagtgccacagcgttacgtgtgtttcccaaacacagactaggaaagaatccagaactctgttgtggggccagcaggtgagactgcagaggctattcctcgggtgtacctgctcggtctgtgactgactgtgttatggaatccaaatgcttgtcctgaaaaagagaccatcatcattgggctttgctgcctgtaacgtggaagttcatctcaaatcctgtttttccccaagtttgacgattctagcagaacagtcatgggaggctgtcaggagattcagtttcctgtgggcacagcagaagagcaaagtttctggttcattctgtggttgccgagaggcagatgtgctgggcaggtgtcaataggaaaaagcaaaaaggagggaaaggtgggttaagggtcatttctgtatttatcataaaatagaattgcagaggattgatgatagatgctcccgcgtccacaggtgctgagcggaatcgggagctgggcagcatccccgagttgccaataaccacagagggcgtgaccttggggtcgctgggtgggtctagtgcatcttttgtttttgtttgtgaattttaaaagcttgatggacacatccgaggtggctgatcatcggataagggcgacattgtgagcctggaatgccacgagtggagcacgcgtcccgatgtgggtggcacagctgcacctgcttccaccatgctggatggccactcaccgtcccctgacctgggatgatgcgtgggacttaatgtgcagcttctgtaaggactccaagggggtcaatgagaggcactgccagggagagccactgtcctgctgtgttgattgtaggcactgaacaagaatcactcaaaagcattggcaaaatgtagctataagaaataggcctcactggacgctggagaagcagcagcaggagtccagcacactcctgctccagcagctgaccgagctttgtggagaacgggtctgctgtggctggtgacgggatgcacacgaaaacatcccatcgtcaaaccgagcaccctttcaggggcttctcctgcccatcctaaacccaggcacatgtggaagtattttgttctgttgaaaaatgcacacaaaagtgatttttacaaatgtgtttttcccaacactttcccctgggctcatgggaggacggagagagcacccactgtttgagcaccaaatccagtgcctgccgcccccatgggggacagagaacaagccaggtgtgcccccctgctcccggcctctgtgtggatgaggccccggggagtgcctggtggccatgctgtgatggctcagggcatccattaaggagatctgaccttgtctggggcagggtgacactccttggcagaggtgacctttcaggcgagattagcaggacctgcgggagttaccaaggccaatacgaaggcaggaggagcttccaggtggagggagtgtgtgggagaaggtctgcattagagcagagcaagagcctccaaagattccagactgaaaaaagcagcaagaaccagacagagaggaaggggcctcggcccggactccatccacaggcagtggggtctggaacagggccccgttagaagtatcgctctgtgtagggtccagccccacagggtcagtgggtttttctccccgtgtgtggagacgagagatcatagaaataaagacacaagacaaaaagataaaagacagctgggccctggggacaactaccaccaagtcacggagaccagtagtagcccggaatgccaggctgcgctgatatttattggatacaaaacaaaggggcagggtaaggagtgtgagccatctccagtgataggtaaggtcacatgggttacgtgtccactggacagggggcccttccctgtttggcagccgaggcagaggagagaggagacagcttacgccattatttctgcatatcagacttttagtactttcacaaatttgctactgctatctaaaacacagagccaggtgtacaggatggaacatgaaggcggactaggagcgtgaccactgaagcacagcatcacagggagacggttaggcctccggataactgcgggtgggcctgactccacaagaggtggaggagtggagtcttctctaaactcccccagggaaagggagactccctttcctggtctgctaagtagcgggtgtttttccttggcactgacgctaccgcttgaccacggtccgcttggcaacgggcatcttcccagacactggcgttaccgctagaccaaggagccctctggtggccctgtctgggcataacagaaggctcacacccttgtcttctggtcacttctcactatgtcccctctgctactatctctgtatggcctggtttttcctaggttatgattatagagcaaagactatgataatattggaataaagagtaattgctacaaactaatgatgaatgatattcatatataatcatatctatgatctagatctagtataactattcttattttacatattttattacactggaacagttcgtgccctcagtctcttgcctcggcacctgggtggcttaccgcccacagctctgaccacagtgaaggggacggctgggcagagcacgaaggatggggagcaggcaggggccacctggcctgaccttgggcactggcgtgcaggctgcagtctgcaggtgtcttggaggtgccagcagtgggatttggtgatggattggacagaggggaagatacaggaattaatggtgcccgcgcccccaggcacatcagctgcaatcatggaaggcagggctgacggtgctacggggcacactatgggcaggacttggtttggggtaggtggaggctctggtgcctgggagcagccgtgtagaggtgtgggatgggcagagaggtgcatgcacccccattactgggcccgccaaagggcctctcctggttgccagattctggagaggaggctgcacctgcgagacctcacccatgggccacctgaaggtgttctgacgtgttcgttgcatgaataatcaaccgcagaaaataatctcacggcatgtttcatagactcgactcacagacaaaaacagccggtaaatgtgtgtttttccttcgtgtcttcctctcttgctctgtcccccatcccacacagcagtctttttgagtgtctgcagaaagggtgtggcctttctttcctgaggagtgtcctgtccccaaccctgtcccactttgggacttcagcagttttcttcttggtctcaggacaagcacacagtcgaatcggcccacgcatgggaaaatttcggagagctgtgttcacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtagtggtgatgtgattgatgatgatagtgatgatgatgatagtgatgatgatgatagtgatggtgatgatggtgctggtgggcatgatatgattatgatgcttattgatggtgatgatggcaatagtaacaatgatgatagggatatacattattcctatgtaacttactcaccttaaaatacatcattcaagttttcagagtcaagtcatgttcccttgctatgaagaaaacttaagtctaagaaaatgtaacatgaggaccaagaggagatgcccgtggctagcaggacctggtgatttatagatgcatgtaggacttttccccacatgtttctacatggtctgtaagataagggagagtttctgatgctatagagctctcacattgcagagatgaaaaggcaccatttccccaatattttgtgatgaaaatatacaaacagaaaagttgaaagaatggtactgacctgtgtgtgtgtgtgtgtgtgtgtatacatatgtgtattcatgtatgagtttctatctagacagaaagtgtccttagaagaaagtgtgtatgcaccattcttggccaccttcgatatccatcgggtcccctgtccctgttgctctgaattcggccccattctagctcttcctgcctcatgcctgaacaaggagctgccttacgtgtgttccatgtgctcggtactcctacccccaggtcaccttgcactgccctgttcatcctcctgtaatgccacattggtgggttgctgactcacttgagagctcccggcttgcccattttgcactgagaaaagactggctgcatgttgctctgtgctttgctgtgcaacccagcctcagctctcctttgcagaatggacctcaagctgctttctagtgcaccagctgtgcccagcagctgtccctccccggtggcctctaacatgccatcggctctgaaacgccagatgtgccgtgcctcctctcccaagcgcagtgactgcaggcagccctcacatgctcagtgactgcaggtagcccttgcactctcagtgactgcaggcaggcctcacacactcagtgactgcaggtagccctcgcaccctcagtgactgcaggcagccctcacatgctcagtgactgcaggcaggcctcacacgctcagtgactgcaggcaggcctcgcacagcacaagtggcctctccttccctgaggtgtgcagtggctccagcctctttggttgtggttactaagattgcccttggacatgatgtgtgtatactccttgtttattctcctgagctgaaagctccttgagagaaagggaactgagtgacctgccctcggctcctggcctgttctgcatggcccatgggctccagcctggcttttttggacttcggtgactgtgcttcttccctgctaaacctgcccatggggactgttgtattcatctgtgtgttcctcagaaagtagcagtgtgtgtcacacagagtctgcactcagcaaatgctctgtgaccagatgagtttgcatgagagaggaatgggatgtggtttgagttgagtgtatctggaggctccattccggggcgaggggcgggggcgtttttaggccaggcctccctcgcagccgctcgcctcccttgtgtaaacctgattgcctgcccctgtactgatcctgcaggattaaggttaaattaaaaataagcatggatggatttagatggactttttggtgagtgggcggaactggtgcaaagctagcggtacacacaccaggaaggaagacaagagctcggcgcctcaatggcagatgagggattattgctgagaaacccgtcctgccgtctccaaaatgtcaggttaggaaatctgcttcaggaaactcaagagcatgccaaggtggctaacagggatggcttttccctgtgttctgacacccagcccggcatcctctcctggttcctgcagccacagtattttaaagtctcgacatcctttagtcccagagctgctgcataacagtgcattcttagaaaccagctgggcctcaggtcatggtggaaggtgtggtgctgagaacctgccacatgagaaatcgcgggattgcctcagtccctgaagggcagtgcacagaacaagacagtgtcaggatgccaggattgcagtgtcaggatgccaggatcgcagcgtcaggatgccaggatcgcagtttctgctcctggacagaacaaggcagtgtcaggacgccaggatcgcaggttctgctcctggacagaacaaggcagtgtcaggacaccaggatcgcagtgtcaggatgccaggatcgcagcgtcaggatgccaggatcgcagtttctgctcctggacagaacaaggcagtgtcaggacgccaggaacgcaggttctgctcctggacagaacaaggcagtgtcaggatgccaggatcataggttctgctcctggacagaacaaggcagtgccaggatgcaaggattgcagtgtcaggacgccaggatcataggttctgctcctggacagaacaaggcagtgtcaggacaccaggattgcagtgtcaggacgccaggatcacaggttctgctcctggacagaacaaggcagtgtcaggactccaggatcgcaggttctgctcctggacagaacaaggcagtgtcaggatgccaggatcgcaggttctgctcctggacagaacacggcagtgtcaggacgtcaggatcgcaggttctgctcctggacagaacaaggcagtatcaggacgtcaggatcgcaggttctgctcctggacagaacgaggcagtgtcaggacgccaggatcgcaggttctgctcctggacagaacgaggcagtgtcaggatgccaggatcgcaggttctgctcctggacagaacaaggcagtgtcaggacgccaggatcacaggttctgctcctgggtctctcactgactagctagccaactattggcaagccctttgcactctctgttccttaggtttcaaatgataaaacaggatgtctgtgctaaacaatctctgaaatctgcaattcagagaccgtctctgaatgtgccagctgcgcccacgtcctggggcacacctctctgattcttctttcctctccttcctgtttctcatgtcttgctatggatgtgagtatttagaatgctgacacaaggccaagaccaccaggagatgtgggtgctctgagtggcatttatctggatagctgggatctttaccatggagaagtgaaaaattagaaatctgattaatgtaaactctttccaattacttttttaataaaaaatttatttctccagnnnnnnnnnnnnnnnnnnnnnnnnnnnnnnnnnnnnnnnnnnnnnnnnnnnnnnnnnnnnnnatgggctgctgtgcgccacatgactgctgtcccaaagccaccaactttctttaaagccgggtcagatatcaagcttccagtcatggaggcttttgggtggtttcagcatcaatctctgatcaattcaggggtcaatatcatgcatatgtgtaagttcagcccagtagggtttaagtggatagcaccatattttaatttagaaaggctttctgtaaaatataaccgagcagtggttattgacataactctcaagggtgtctaaggaagagaagttgttgttattgtttggggctgcccttcactgtttataatttttcctgtctgtgatgctcctcctggtgtcctccaggtgctctcgttgagaattaaatgttgctcctgcagcagactcttttgtacttagtcatcgccgaactggcacctgtcggcctatggtgcaggaaaagatctcttttccaagtagcagagaagatgttaacctgggccacttgagccctggacactgtttctgaggcagagctcccatcttggtcccctgggaccagctgtggtctcttcagcacgggttctccttgtcccctgtggcctcctgcagcctgtcctctgactggtgagtttggttgcagcagagtctttacaaatgatcgaggccccgagctctctgtgcctgcctgagagccagaggctgaccctgcctgagccctggagactgtgctctctttggtgatgcagataatttagaccaagctccaacacgttcccatttagtaggaaaaagaaagacacacacattggagtgcttgctttgtttttatgaattcctatgcaggtgcaggatgtgcggggagaaggggccccagagtcctgtacagattcagcagcagtgaggacgccccccacccctgcctcagggctgtggccgcccacagtctgctggttcaattttctcctccagaggtgagctccccagacgcaccagcttcaggattccccctcctgcctctgtgccacttaagtgttttttatttaaccaagactttctggacatttcttcagttgctgacttttaaaattgtgtaactcagataaagctattctaaatttttttatctgaaacaccctgcagggttgctttgggagttaatgacttttatgaaaatcatgtgtggcaggatgtagtccataagcataagatttacatatcctcactgcccatcacagcctcggcgtgtggcctttctctttatgctttgctccctctgccacgtccagtgacgtggtcagcgtacgttaggtgctcaacacattttttgagcaaatgacaatcagtctcacacattttatgtaattgctaaatgctgagccaactgtgcaggatggtctgtgcgcttctcccctctcaccacactgtgaagtgtcatttctgaagaaatgggtgggtctttccagaagtgtctgcagtgccgggaaggaaggcttgcttacttgggtgccctggcattgagaacaaaggctggtgagtaggtttataaatgtcaagctgcatttcctggcaacctgccttgtgctcagaaattggcctctttaatgcagacggccttgcagtgaggtcaggcccttctccttcccattcacggccatgtctgccacccaaatgccattctctcctgcaggagcttggtgctggggagatattattgttggtgagtatttttgttgaaaaacttaccaaccctttaaagtcaggtgacgagaatgggagtccctctgatgttcatccctgatccctgatcctcctgtccctggtcatgagagtccctctgatgttcatccctgatccctgatcctcctgtccctggtcatgtctacacccaggacacatctctgatttaactaataggtaagaatgttgttagtaaaggtgacacttttttctgtccatgggattaaaacctgggatttgctcccttagattagaggaaagtgttcccctccacatggcacattacttttatcactaggaacttttttttggtatttttttcttcatgagatggggtcttgctatgtttctgaggctggtgttgaactcctgagctcaagtaatcctcctgccttagcctcccgagtagctggaactatgggcatggccaccacggcccatcaggagcttttcactgtaacttcccccaaactttcctccatttttttggtctctgtcttggaatggcagatgcgttgcacactgaaggattcccagaacctccaagagtgttttgctttgtattgaaatatggaatttataaatgaggaaactgttacaagcttttcttttaattatgaaaaaagcataatacaaataaattcagaggcagttcataaaacctgttttctagtagtttcagccgtaagtctctgcaagccagtactccctttcttccctggcacagtgggcagcagatgctcgtcaccctggccctgagacactgtcacagacacccatcggattcttcactatggtgtctatcagccggctgtggctcaggacagccaggtcccttaggaagccctgggcctggcctgcccctgccctcccgaagcttgcaggcaggataccagcagcacacagcaaaaacgtgaactcagccgtgacgggatactgcaaagatgttaagtgcggggaaagtaaatggaaatgttatatttaggattagttcacagttccatggatctctcatctctttctgaataaatgattcatgcgtgtggtagagagtgcattaccctgtgctgcagagagtgacgtggatcctaccctgtgtctggtgcctgaacttgtgcagttctgagctgtgtttggctttgctccgaagcggctcaccattgatgggaacactgaatccaccggaactcccgacccctctgctggggaagagtcaagcacgatggggcagtcggatgagctcctggtctctgcgtttcactcccctgacttcttttttctggacgtttggaaatccattctctggtttctgtgggtatgaagtatgcacccaaaagctggtgtttcagtgcccgtggcatcttggtgcattgcatcaagagatggaggcccctcacaggctctttcgtgggcagaaagtgcgtgtccagccgcacgatctactgggcctgtgatcgttcttgtgatacagacatctttcttttgacattggtctttgctgaggcttaaagcaggtacatttttacataaagaattcaaaatgatgtgattactaagagtgttgcaagatacaaggatagtaaaggagcctgacatggctgaaggaagtctgtcctttcaccacagactcagccgtgggtaggaagaagtgtgattgggaagggtcacatgtcaatgacagcaaagacttagagctggcctcagaatcaccaagatcatgcaatactcgtttcgcttttttggacccaagcacgcaggtttctctttggccatagatttttcaagagactaaatattgactatttgtagccttcaattgtttcttttcttttctttttgttttctctctcttttttctggagacatagtccctctctcttgcttagcctgtcaccgaggctggagtgcagtggcaaggatcttggctcactgcaacctctgcctcccaggttcaagcgattctcctgcctcagcctcctgagtagctgggactacaggtgtgtaccaccaccccaggctaatttttgtatttttagtggaaacagggtttcaccatgttggccaggatggtctcaaactcatgacctcaagtgatctacccacctcagcctcccaaggtgctgggattatgggcatgagccaccgtgcccagcctcaattgtttctttattgcaatgttgttaagaactacttagaaaaaaagcaataagctattattgataatacagatgatgcatttgtattcttgctgtgaacttccctttataactagtagatctcttccaagtaccctggcttccttgctgttcctcaaacatgccaagcaggattcttccagggcctctgcagtggctcttcctggtggtgcctggaatgctttccctggtatctgctgtgtcttgtttagatccgagtgtcggacctgtgtcactttccttctgtcagaagagcttcttttaacactacttgaaaagcaggtggaccgggcgtggcggctcacgcctgtgatcccagcactttgggaggccgaggcgggcagatcacgaggtcaggagttcaagaccagccttgccaacatggtgaaaccctgtctttactaaaaatacaaaaattagccaggtgtggtggtgcatgcctgtaatcccagctactcgggaggctgaggcaggagaatcacttgaacctgggaggcagaggttgcagtgagctgagattgtgccattgcacttcaggcccgagcaatagagtgagattccatctcaaaaaaaaaaaaaaaaaaagaaataaaaaaagaaaggcagatcaactgctgacaaattcctttaatttttgtttgcctaaaaaagtctttatttcttcttcagttttgaagtattatttcactggacatagaattttaagttgggtgttttcttttaacattttcaatattttacttcattctctactcgcttcttcctaaaaagaagtccagcataattctctccgtgcttttctatgggtaaggtaaggtttttcccccctctctggctttgtccaaaaattcctgtctttgatttttctgcagtgtgtgtgcacgtgtgtgcatgtgcagtgtgtttgtgtgtgtgtgtgtgtgaagtgtgtgcacatgtgtatgcacgtgtgtgtgtgcatgtgtgtatgcatgtgtgtgcgtgtccgtgtgtgtgcatctgtgtgtgtgagtgtgaatttgtgtgtgttgtatttacccttcttggtgttctctgagtttcctagatctgtgatttggtgtctggcattaattttgaaaatattcagccattattacttcaaatatttcttctgttcccttttctctttatctcttcctggtattcctattatgcatatgttataccttttgtaattgtcccacagtccttggatattctgttttgtctttttcttttttttttctctctctctttgctttttgtcttggggagtttttattgatagatcctcattctcactgattattcctcagctatgtctgctctaccaatgagcccatcaaaggcattcctcatctctgttacagtgattttgatttctaacatttccttttgattttttcttagagtttccagctctcaaatcacccatctgttcctacacattgtccgttttctcactagagcacttctcatattcatcatgggtatttgagattcattgtctgataattccaatatctctgctatatctgagtctgattctttttctctttgtgatttttttcccttttagcatggcttgtaatttttttgttgaaacctagatatgctgtattggataaaagaaactgaggcagattggcctttagcattaggttttatctttacctggctgtgagttaggctgtttactgtttgctggagctgtaattgtcagaggctaaaatttcttctggtgtccttgttttatctccctacttttctttgggtttccctagagacttctccttaaataaagtctgatgtgtgcagttcttttatctgtaatcccctgtcattatgtgggagccctgttggtattgatgtggtggtctggtgtggaaggagggcagcatcctctggccctgtgatcaggtctctgtctcagcctgaacctgcacacctgggctgtgacctcacgaggacttctcagctttttcttttcctcccataagtgaaaggaaggccagatgggttggaattgggtattttccatcccacaacattctggacttatttcatgactggtttcatgctgtagctatcctttcaagatgtgtttttcacacagaattatattttgaggatttatccacgcagatacctttagatctagtttatatgtaactatggcatggtattacagtataatttatgcattcttcctctactgcaggatatttaggcagtttttacattttttctatttccccacaatataatttaattaggtgttatcagacctctctttagtttatgccaaagggggagggccataaacttgtatcttattacaattttcatttgtctgtatctggcagacaaataaaggtggagcagctttctatagctctgttagccattcaaatttcctcattagtgaattgcttgtttgaacacttcaattttcatgctgtgtttttttttgttattttattattagaatgtaaggattcttaatatctgtgtcattattctagaaatacatattttacatattatgtataataaaatcttatatttctatattttatactttattatctaatataaatactacatattatataatataaatatacatgttacatataaatatatatgtagaccatatttatatagaaatgctatatgtgttatatatagcatagtattttattataaaatgtatgtaattatatttgaatactagttcttggtcagtgcattatatatgttataaaaatagagatatagcttatcttttatcttttttatggtgtctttttaatcagtgttttccatttgaagtctttgggtttcatcatggcatctttctctagtgatttcataaaaatatttgcccttattttcttctgaagttttagaatctttaatctgtcaggaatttttgttgttgtgagacaggggttgaattttatctttttctacttagatagggagttgtcctggcccttgtatttaattgttgaaataccctttctcctgcagtgtatgtcttcacattggttgtctatccagtccccatgtgtgtacttatatttctccctcctcagttttattccactggttctgtttgtcagtctttccaaaaccttgatgattttcttttctcaattcaactttctcatcttactttatacatgaatttctactggagtataacatatacaaagtgtgcacatcttagtgcagagcctgttgactgtgctgtgtagtcaccatccagctccagacagagcccttggcagcccagaccctcccctcagcatctcctccccaagtgagacccaaagcgggaggttagcggattcagacatcatgcactccatgtgtctggcttctctaactcaccatacatctgtgatactcacctgctgtggtacagagtagacacttggtgtctcaatcgttctgacaatgtgaaatctttctgacaaggtgaattgcaaccctcccccattctttccccaaattatctacatgtcccttattctaaaatcatttttcagatgagcttgtcaaatttatgaaaaaagactgattgggttttttgttgaatttcgatttaatgtatagtttagtttggacaaaactgtacaaaagtacagtcattgccacataacagcgtttcagtcaactactgactgcatacatgagggtggtctcctaagattataatcacatactttaactataccttttttattagatgtgttcagacacaaatacataccattgtgttagcgttgcctacagtactcggaacagtaacagtaagctgtgcaggttagatacgcaaatacataccattggttacaattgcctacagcactcagtacagtgatatgccgtgcaggttgtggggtgtgcagtgggctgtgccagctgggtgtgtgtaagtgcactctgtgatgttggcacaacatcagctaacgatgtatgtctcagaacatgtccccatggttaggagacctgagagtgtatttacgacatttggtcttcccatccacttctgtacttacatggcatgtgtcttcgctgagtgagatattcctttgccattcaatgaacttttagtatttttaaatgtaaagttcttaaaatattttattaaaattttttgaagtagcttaacatgatcaggattatttttaaattaacttctaactatttcaagatattatataattggttgttgctggcatataggcacattggtttgtattttgaccttgtgacctgtatctttgaaggaatcttatatttgttataattgcttgattggcagttctcttagattgtccatgtaaacaaatatgtcatctgcagctttcttcctttctaatgctgtatatcttaacatttgtcattgcattgagtatctagggtgttccaaatagtgttgaatcaaaggggtcaaggaaggcttcattatctatcccaagcattaagaaaatgtctttgacattttaccttgttaaaggatgattatttctgaaggattttattagataacttttattgggttaaggatgctttattcctagtttcttaaaatttaaaaaattttgaatggaccaaatcttattcttgaatctctaagatattactggactttttctccctttaatctcttagtaaagtgaattacatggagtagaaccagttttgcatttttgggatatacctttttggtcactttttgttttactgatttccctctgttatatttggttgctattattttttgagaaatggaattcccttattttcattgtgttactgtttttcagtgctagtatcaaagtaatactcatctcataaagtaaattgtgtcctagactgaaaaatctaaaatccgcataggaggaaacagatgttgcttgaagctttagtaacagtgtttaagtcacctggctttagtgctgtttatgagagttggtttttgaatactgatttaactaatggttacaagtatagtcagataccattcctttcaattcaattctggcattttgtgtttttgttttttttcctaaaaatgattcatttcacttatgtcttccaattacgtttctgttgtgcgttgcagtttcttgtggttttgcatatctccgatatgttattggtatgcccctaattcatttctannnnnnnnnnnnnnnnnnnntatttccttcatatttttaaacagtcaactctgctcatgtctgtgctctctgctgctttctggtttgttaatttctgccagtaagtctcaggctatcattttatctccaggtcagatggggttaattctctagtttgcgttttcttttaaattttgctcacactttctcattacagattgttttctacgtggtttataattttttattacatgcttgtctttgatgtctttcttttcttatgagaatcctgtggaagtcccaagaactctcattgttggaaaggttcctccaacattttataattagcaattcaaatcaatgtgttatgttagatatatgagtattttattatattaggatttgacactcatgtgggatacaggttcaggcttctatttctaatgagaggcatttgtgttttcatcaagagcctgagaaagagaggctcttctgcccgcctgcctgtggacgggttgttggcattccttttgtgcagggcaggtgtgcacagtccttgggggtgcgctgccagcacctgccccctgccctcctgtgggcagaccccaaccccagcctgctgggccctaacagacccccctgcctgccactgccgcactcagctgcctcccttgcctgctctttgccccagctctgtgctttctctgttctggcatctgggatttctccttccttcctttcacgtttactaatgcttcaaaatttgtgcctgtccctttttatttacagtatttatgcattagactgggagcagggtctgtgctgtttttacaatgtgtgctcgaaatggacatctctagactttcttctcttcttatagttttatacttgagacacttgttgactatgaagtgagagtatttaaaagtgcatatattgtcatgctgatgcgtgtaaacacactatcgtgacgatgcgtgtaaacacactgactatccacactgggttttctgggcagtacaatttcaaattttgttcctcctaagctcaggccacatgttctgatttggagttttaaagaaatggagagtgagcctggaagaatttactaaattgatcccagctttctaatgttttgctcagggcagatagcagggaagcattgcaaatagggttttggctgacaggcaggctcctgtgtgcacacacaaagcctaccccagaaaagtagagtctgcttctccgaattcaggccactctctggcagctgaagcctctgctactgctccctgtcagcagctcccagctcttacaccccaagtggcccaggcctcagctacgatgcaactcgactcagccctgttgtgtttgggggactgaggtgctggactcagggtgagacactcacacacctgccctgatttccagatcttggcctagcatgggcccctcccagcctgtgttagttttttttcacactgctgataaagacatatctgagactgggcagtttacaaaataaagaggtttaatggacttacagttccatgtggctggggaggcctcacaatcatggtggaaggcaaggaggagcaagtcccgtcttacatggatggcagcaggcaaagtgcagggaaactcccccttataaaaccaccagatcttgtgagacctattcactatcacacgaacagcatgggaaagacctgcccccatgattcaggtacctcccactggggtcttcccatgacacatgggaattgtggcagttacaattcaagaagagatttgagtggggacacagccaaaccacatcactgtgcagccagccacacacagagcattgctgaccagggatgcttgcccgggcctcagcatgcagagtttctattgaggtctcagtgtgcagccagccacacgcagagcattgctgaccagggacgctcacccgggcctcagagtgcagagtttctattgaggtctcagtgtgcagccagccacacgcagagcattgctgggcagggatgctcacctgggcctcagcatgcagagtttttaatggggtctcagtgtgcagccacacagagcattgctgaccagggacgctcgcccaggtctcagagtgcagagtttctattgaggtctcagtgtgcagccagccacacacacagcattgctgggcagggatgctcacctgggcctcagcatgcagagtttttaatggggtctcagtgtgcagccacacagagcattgctgactagggatgctcacccgggcctcagtgtgcagtttctatcgaggtctcagcgtgcagtcagccacacacacagcattgctgaccagggatgtgcacccgggtctcagagtgcagagtttctatcgaggtctcagtgtgcagccagccacacacagcattgctgaccagggatgctcacctgggcctcagcatgcagagcttctatcgaggtttcattacattggtgtgagggattgaaccattggccacaagctttaacccacccaccagccctcccctctcctgagatcagactatatcccacggctcagagcccccactcacccatcacattgttggtctttttggtgtggacagcccccgtcctgtcacctcatttgcataaacaatcaggtgtggtccgaggggcccaccacaaatgacctcactcccgtgactcaggaggctgcaaggactcaggctgcttccaggaacaggaccaaggctagccaaactccttatcacacaacatggctaaaacgacttatcattccagctaatcaccgactcgtttcttcctcattctctcgtcccacatcctcctccactgcccaggtagtcaagaagatcaccacggctccatgtgtggccctgatggctccatcaggcttggtggccactgccgcttaggctgacatccttcagattcatgcctctagccctaaaccattctgactccagagcaaattcttatttctctgagcacagcacctgggagacagaagttggctgattgcatcagtgagcgacttacagaaaaaaaaaaattactgggtaagcacatctgaagaaacaactcattgaggtttctgataatgagactttcccttcctctgcagtaatgccttttgacaataagcttagcctattcatctctcccagcgtggtgcagcagagctcctctcctgaaaacctggaggcatggaagatgtaccgtcctccacacggtgctggacatggggccgttgtggtcctgggtttactctgctcatgtcattaagccccatctgccctgcatgtgtccctctgagtggtcagtggagccaaatgcctggtgctctgtgattttaggtctaagccattttagaatctctgcatttagcgttgtatgaattcactgctcactgcacaatgcgtcctttgctctgaattgacccagttgagattctcggtgtccagcccgagtctattgcatacggaacgtctctgtgcatcagaggcgctttttcacctgccttgggtctcttggcatctgtctctcaggcggaggagccactcactgcatccggccttcctcctgtcattttgtttgcctttgccctcctctgaactttaattctcctccaccatgagaactgaccagaacttgccccaaatgcagcacctctgctttcaaagccggggaaggaggggcaggagagggccaggggctgtgctgtctctaatgtggcctagaggtcagaggaggggccttcatcagagcatcagccaccccttcctgggcccttgcttccccacagagggcatcttgctgctcccggcgaagcaataattgctgaaaatgggaagttaattggatgtgagtgcaatgccatttggctttttgcttagccagggccaggcgtgggggcaggtttccgaaagggaagccgaagactccacacagcagctggaatgccggggcctgagcagcccccagaatggccgctcttctttctcagcagtgctggagaaaacagccaaaggtcccttgaaagtgagagctgggctgctcaccatgtccttctgcaccatgaagaagaaacaaaggagacccagagacttcagaggctcgcgggcccccggagcgccggctgcagagcagcaccgtctttgtagttttgcagcgactgtaattaatgcatcttcctgaggctgctgtaaacagcccccgcgtctgacttccgcccaccttttttactcgatgatttaaattgtttttctgactttatctgtcactttatttaccagctcttaacctttcttctttttttaaaatataaatgagtataacatccactgaagattacgatgccttctggaaagtgtggctgaggctgtcttcctggagaatatcctctgcttgccctccatttatctttttctttttttcctgaagtctaataagcattaatttcccaattcctgaatatgcctaatgattatattttttcatttaacaagtaaaaagcagcttaaagggctttctaaatctctcacttgggtacactgtattctcacagagtgacggaatttggcacaaacatattggttataaatgaatattttatgacaattaagagcatttctgtggctttattatttgttgctccaccctctggtgagacctgtctttccttcaaaaccaaatagaccccaaatgtcagatactggaaatgagtgagtacagggatgcaggaaaaaattcaggaaggtgcaaaagtcatgacctcaccattgatgtctccatcacggtgagatcgaggtcgtctgtcagatcacacagtcttccagaacagacattcagctctgtttttacattttagaaaacccaggaagactgggaaaatattaaaggccacagtggtccagtttatcagcaagtggtgttttattcatcattcttgtccctggtttgtcaaattaaacacattatctgtggaccttcagcagatactgcagatttatcactcgaggatattattcaacgtgatgccttctcttctctttctgacttagcaacaacagtttagaaaggagaaggcttgcagagagagaaaacgagggccctgaggaagagctgtgggcctggctcatcgctgagctctggctgtgtggggccagagggtctgagatggcgcgtgcagtgcccaaggctttggcaacggagccccgcacactggcaggcttagaacagtgcaaagctctccaggccctgcaccccccagggtctgagatcaaggtcttagcggggccgtgcatctctgaaggctccagagagggtccttcctgcctcctccagcctctggtggccctgacacccctgccattcctcggcttacaggggcctccctcccacctctgctgggtcaccaggtgttctcgggaattctggcctcgccttcccactgggcacttctgtctctgtccagtgtctccttcttagggacaccagtccctggattaggagccactctgatggcctcatctttaactggcttccctcttcggagaccatttccaaatcacatcccatacacaggagctggagccaagactcagacgtgctttcctgggggacatagtccccaagcagctggctcagctctgtgctttgctgggggacatagtccccgagcagccatctcagctctgcagggggtcaggtgcttgcgcagagctgcctcatcctgcgggttctcgggtgcggtgaaggatccgtcctggggatgcaccatgcctgcttctggtgaattattttctgcagtcttctacctttaagagggacctggctccagacagaaggtacaattgccctaaggaaatgaggtcaccaggcgggctctgcactctgacctggtcacagggagcacgcctggcccgtgctttccactgggaccccaggtgatgttgcttctgtccaggaaaaatgcttctaatctaacaaaatagtattagaattatcattgttattattacctgtgtatgtattttctctctacatgtctttgatgatgtcgtaaactggtagatcgagtactgtttacttacatagagcccatcctcattttatcagctgttttgcagctgagttgggagtggggaggagaagcctgtgaacgtgttatttctggttgctatgtttgctgtgtggatgggcaggacaggagcctccagcccctgtgaacatgttatttctggttgctgtgtttgctgtgtggatgggcaggacaggagcctccagcccctgtgaacgtgttatttctggttgctgtgtttgccatgtggatgggcagggccggagctcccagcccctgtgaacgtgttatttctggttactgtgtttgctgtgtggatgggcaggacaggagcctccagcccctgtgaacgtgttatttctgcttgctgtatttgctgtgtggatgggcagggccagagctcccagcccctttgaaggtgctttctggaccttctctgcttggcaaaaacagctgaaggtagaaggcggttaaaggcttttcttctatttccaaatggcatggccatacacatatctcttctttttcttcaggcggcctgcagagattaggaagcctgatgttgagaaatgtcactggtttctttggggtagaattcggaagaatgcttttagagggaaatcataggattggccttaagtttaagggacacttagaggagacagaggacaggatatgaaccccatgccctagcaagtggatacggaccccgtgcccccggcgagaggatacggaccccgtgcccccggcgagaggatacggaccccgtgcccccggcgagtggatacggaccccgtgcccccggcgagtggatacggaccccgtgcccacggcgagtggtggggaggctgccaggcaggacagaggtgtgggttcttctttgctccagagcaggggtgttcgagtctcagtggctcatgtcacaccaggtgactggagcaaaatagccccatgtgctggtttgaacatgaagacagctgattccaccaggttaaccagccttcagcctggtgatgtggtggttctggcctggccgtggtccccgccctttcagagaccctggtctcctaatgccgcaaggagaggtggcctccctccttctggtgcacgctggactctccccacgctccctgagccagcagaggctcctgagggtctgcagctgccccgccctcctgggcttcagccagtgttgccttgcgcgggacatagtagctctgggtaaagaatggcccccggtcagtgttcaaaaaaattagggccttcttcctaaggccactactgttcaaacagtgttttccttctgacagttaaatatttactttctccaggtggcgtcggttggtcagtggagtccgcctgtctccgctgggctgcgtcggttggttagtggagtccacctgtctcctccttgctcctggcttgcggttctctcctctgccgtctctggctgggccttgcaggctccggctgcttctcctgcagttcattttgttgttctttcctctctcgtctgaaatggcctctgtcctagattcaggagggaaaggaggaaaccggtggggcctggccgctgcttctcctggccttgttcttcaagctccctttgaaggtttcgagcttctgctcttgctctcctgcctcttcctccatgcctgctgcttctgcgagctgtagtttacattctggctggccgcagccgggtcctcaggacttgaggagagggtcctgtcagggccagcgttctggtggggttttcagccatgaaaatgtccagagaattttggtctgagctggagaggagacagcagcgtggatgtgacactggggagaaaaagcttgggccctgattcttgtctggccatcttggatcatagacgaattattcacaagagggtctctgcctaaaactcaccatggtggctttcttggtgtacttttcatgtctaaaatgtaagtaaagttcaaactttaaggctgcagaaggaagtgaaggcttttgatgctgtttacaaatctctggtttctgactcaagaccatgacggtatgggggaacccaggcctgaccttctcccagttttgggggagctgcctcctgcgattctccctcggtggccctgttggggtggggcccatttcctctttgaaaatgacatcccagtcatcttactttctcggctgtgaacactcacaatatgttccacaggatgccagggctctgctccgctggagaaacctccgtcccaaactctgtcttgctttctcaatcatatttttagaaagtgaggctgggtggcttgtgggttccagaagcattgaggttgaatcacaactgtgaaaatatgggagtgaaaaacacagtggagacacaaaaggagcatcgtgtcaggatagaggattgtggagggtgcccatgtgttcccactgcagctggccccaaggttctccctaaggtttttggtcccatctctttccctctggaactcacgatttggccaagaatgagcactctcaggctgctcccaaggaggcccaataccagcccatgggggccgagagccacgtcaatccacatctgcccctcctggcatcaagggtcagccagtgccctgccttttaattttccatttatttaaacaggatcacatgatttcatttgagagtatttcctccaccacttctgagtggaagccaggagacgaggtggctttcagttccatttgacttcctgccacttacatttacctttcacgtgtctgtggaaggatgaccagggcccggcctaggcatgtgggtaaagtcctggctgtggctgggcactttccacaggggccggctctgcctggggctggggtgggtgagccctgttggttctaggaccccggacctgcctggtcagcggagatgatggaggttcggtatgggaggagcaggtgtgctgtgcccgtgaatggcagttcctgggccaaaagggtcgagtgtcacgatggtggggtcatttgaaccgtttgtcaccagcatacctagggcagtgccaactgacacagtgcccagagccgagtggctgctggaccatcactgctgtgtgtcctgtgttcacgcagccctgcagaggacagggccgtgtggtcaggcctcttgatggggcctccttgcacctgacctgtcacggtatacgtggagggcactctgccttcctcccggtgtcctgtacgtctgagtggaagtgctttgtggggtgagggcacctctgtggggctcagggggcagctttgaaacagtggccagggtgctccccacagccaggcccactgcagctccctcctgtaccgtctcacgtggaagagggtctcggttttgtctttaattggtaaaagttgttttagtgtatgattatgtaagaactatgaacacaaggaattatcttacattgtaaatatttgagtaaaaagaataatttcgatcaataagggtgcatatagcatgcatcactcagcttcgccaaaatccacgccatgctgtccggctggcatctgagggcagccttggtgcccgtcctcggccagtggaccttcccacatggatgttgtttgctttgcgttattatggtcccccccagcgagcccagcccaccagatcagaccatctcctcctgaatttttgcacaaataccttccatcatccctggtattttacctgtgaattactgttagggaaaatatatcagtagcagagatactgattctgtaatttttcctaaataggcacttactccggatgaaaccacaaagcctaaataatacattggcatgcgaagctcaccgagctccttccctccgcgccgaccccggtttccatctaaatcgatatctgtgctgcctcgacggggcccggcatgggccgtgcttggcatacagagcagctgcacctgagcagcagctgaggggtcttagggaagccgctgccccttccaaacatgactgcctttgaagcccctattaattgtcaataacaactgctacctccattacaaaaggaattgaaagcaaaaataagacccggacaatagaacgtaaacggaagagcaaatcccactccagattggaattgtctgccgggctcgttaatccctggcctggcgctgggagtgtgggtgccgcttttcttagggtttgctttctgatcttgtgtcaattactgcacaaagcttcacaccacacagcgaatcctttttataagtgttttagtttttgttcaatattttatgtttctgcttctaaatcttacttgccgatatccaactgataagctgagcagggaaatacaaatacaccagccatcatcccccaaggtggtcacatatgtgtgtgtttctttagcttaagtgaggttatttgatactcgtgtttgttctgtgtggagttaggccttgtcacatataagcagttgtgttcccacagggctattaaagaagtaaaccaagttggccacacaattcagcctctaaaatctgacattgttttctggggaaggcggccgtgctgggggtgccaggagagacttggggatgtcggtatctctcagcatggccgagaacaaacacccatccagttgtatcataccatgggggcctttgtctgctttttaaaatattaacaatgtattttggatgtttaataatagagcagatgagggtacatcaactgcattgtggctttacctgccaatctagttaccaaccatcacactgacaaggaggcgcggctctcccactctgaaatgatgcctttctcttctgagctcctaaagtgcagggtgtttttcagactcaaaggtcaagtccttcttagaatagggctgcatgtgtctttgtccagtgcatgtttgcctgctttcctcggggcacctgtcactgcaaagcccagctgcccgcttacccatctgagaagaaaagcttattctgacattcacaaaccacccactgcccacaatcaagcagacaaggactctgcaggccccaaaccccactcaatcttttcgtttctgttttcctttttcttttttaggtaaattttgttgcttattgaaaacttcctgtgtgtatgacatttttctaagtgcagtagcagaaagaggcagtggaaaggaattgaggtcaatgttgagagcacaactgaagttgctcatgccttatcctccctggaaagccttcatcagctcctgccaagctggccttggcccccttcctgctcctaaagcagttttctcttccattgcttgtttgtcacaaggtgtcttagtttctgccccacagatcagccccatggggtcaggagccacatcctggtggtcgtcttcttggagggcctaggatgcactcctggcttacaatgcctatgaccttgtggaggacgtgggcagcgagtgtccctagaatcacagctgcacgggtgccctgtgtgcccagggaatgcccagtgcatgtcttggcaatcattttggcatttttttcctcttaaaaatctaaatgtgtgtgtttcactagagatcttgaagttacggagggctgcagagcgattatttcagctgagtggacagctcagggaacccgtgttcttctgattgatttgcttcttggaaggaactgactgtaggtttgctgagactgaccagtcaattaagtcagcactggccatccagatgcctgggtttctgatgtgcaagtgctgaatagcagtgaggactcggaacctcaccgctctagagctttgctgggatgcactgggcatgttcacaacatcccggagctttgttggggtgcactgggcatgttcacactaccccagagctttgctggggtgtgtttggcattgtcatagaagacaaaatgaccctcacacatcaagaggaattgaaactgctgatagataccagtggttagcagctctgtttggaggtaatggtggtatctaccaaatatagaacccatgtgccaggccctgtgtgtgtgccggcatgtgtgtctgcatgtgtgtgcctgcgagtgtgtgccaggccctgtgtgtttacctgcgtgtgtgtgcctgcatgtctgtgccaggccctatgtgtttgcctgcacgtgtgtgtgcctgcatgtgtgtgcctgcttgtgtgtgcctgcatgcatgtgcatgactcaggagggactgacatgactgagtggcttgatgagggcaagggtaaggaggagatgacaaactgggcatgaagatttgtttactcatttcaagataggttaagaatgtgtgtgtctgctgaatgcaagctcagggtctctacgcaactgtcttccttagtttcaggaaatactgtagtccaggcagtgggggacaccgcaagaagggagcagaacaaggaactcgctcctcggctcttctcctttgcagtggatgggacagtgctgcagaatgtgcgtgtttgaaaacttctgcttgagttatttcaaaatatagattagagaaattttttttagagtgttaattactgcaaagaaaaatacacacagccacagtagaggccaagatgtcttcagatattgggagcagcactggccacggagtgcagccatgggagcagagcctcacctggggactgagagagcagagactcacctggggtctgagagagctgtctgtcagtgtttcccaggacacaggcctgggagcgcttacgtggtgagctcctcctttagcgagatgttggagaaataaaccaggattggcttctggctactccttgtcgacatgggcttaggtgaattcattaaagtggttttctgtgctaaattgttgagagttttccaagatgaatgagtttaaaacttgttaataatgagtcacaagaaaacagccaccgttctgctttgtgccgtgatttttgtttatcagggataaatgcacactgaaaacaaagccctttcccatttcccattgaggactaaacaggagtgcacagagttcagactcaccagggcgaccctgctcttgccatcccctgcagaacaaggtgaaattgggcaaccgtggagggaaacgctactcttgatcattgaggtttctaaggtccagggatattgtcttctttttcttcctatttttcaagtaacccaacagtgccctgctccaggggtgctcagaacgcattccagactcatggcggaagcctccgtgggggaaagccttctggcgtgggcagcctgatgctttgctgcatcattaaaagccagaggctgccccagacagagtgcccaggtgcctgggccttggctatgaacacattacgggctgccccagacagagtgcccgggtgccggggccttggctatgaacacattacgggctgccccagacagagtgcccgggtgccggggccttggctatgaacacattacgggctgccccagacagagtgcccgggtgccggggccttggctatgaacacattacgggctgccccagagtgcccaggtgccggggccttggctgtgaacacatcatgggctgcgctggtcttccctcagtaatcaccgtgggaaatcatggaactggagagtgggggtgcttccttgggccctcattaaaggatgacctgaagtctcgtggtggaggccgtcaggaaggatggaaaacgctcggaaccgtgtaggaaacggagtcatcatgctgtagggtcagcactggggaaagtaaaagcactcaggtgatgccccttgagtttcacaatttaaattcatccttgaatgtctcctctcaccatgtctgtggaagctgctgacaagcagaggatgcacttggctgggaaaacctttcctaccaggacaagcccaagaccgaagcttctggggacctgtcacccatctggcccttcagggaggaggccagctggagtgtggggtctcgcctcatggtggatgggcgaggctgcccggctcagccagggcagtagcagcagccatttctctgcctctccacagggaccttgtgaggtcacctcattttttattttaatacttactaggacagaggtgggtagattctaacccatggacagccccacctgttttagtaaataaagttttattgaaactagggttggccgatgtagtggtcttttctggtggactaaaatgctacagcctgggcagcttcagcaacaggagttcatcctctccccactatggaggctggacatcagagatcgaggtggggcagggctgctcctcccgaggcccctctccttggttggcaggctggacatcagagatcaggatgtgggcagggctggctcttccagaggcctctatccttggctggcgggcagcgccttctggctgtgtcctcacagtgctgtccttctgcacccatctctcggggggagatttatattctgtgctaattaccaatatattcccttctttttaaaatgatatcctctgtgtgtgtgcgtgtgcgtgggtgcatacacacacatttatgtatctatttaggtatttggtttttgccggcatcactgatgaagtttctcatggtcttgtcctgaattagaaaagcattatatgcattggtcattatcttccatgtttcctccctcttacctgctgctttcactcaaggcttttgaacttgttttcccttataattactgtggcttgaatagcatccaattctttcctaatacctgctgtgttctaacaaagcaaatataggcattagaaccttagaaaccagaggatgtcaacaaattggaggaaattcagagaaaagcaacataaatgattaagagactgaaggatttgtttgtgagaaaagtggaaaggaactaagtgtgtttgtcttggtaaagcagcaactaaggcagggcaataaatgcctttaagaattttaagtatagaaatctcaaggagagggaattatttttagggtggtagagggaatttaattaccttaagcaaaaaccgtctgacccgatgtccgtctaggaacagcctcctctatagagggggctccggctgtcgggggagcctgagtgaggacggcatccacacttccggcaggaccagggccttggaagaagaaggttattgcagtgatcccagtggctcaggcttcttccctttttattcagcaaaacacaactcctgtgcactcccttagacttgacacaggatccctacttttgtctttcttacctattccgtttctgtatcagtttctaccataatcattgggtgttggctggtgggctttgggagctgagacagccacgtcagaggaggagcacatggtgcattttacccccaacatggtgggcaaggctgccccagcccctgactgcttctgccctgacggcttcaccatgaccccgggccggcctctcctctccgcacccactatcaagcccacagtgacctcgggacgtaggatgcaggccaaaccccacttctgtgccctcgcccctccctctcctcttgtccctcacgttccccgcaacccagagctgcaggtggcctctgcccaggcatcacctgttcctgggacaccccctcaccccctcatctctgagagctcagttcaggcaaagcccactcactgtaagaagtctttctgcgtctctacccagatggctgcacaaggccaccctccctggagctcatgtatgtgtagtgttggctgaaggaggtaagttgcagtagctgagaagcacaggtgtaactcacagagccacagtgataatgacagtggcagcaataacgggcagcactggggctggggtcaccccacctgggctctggccatcacacagatgctcctgagttcaaaccatgctcaacaaggacacagggccccagcttgggctctcaccaagaggatgagctgcagtgcagaagcctcagggctgggcattgaatctgggtcctggatggccggtgtggtttggagcaggaccgcggccaatggctggacctgaggagcagggtctgggatccagggatgtctggcgaagctgagggactggtaaaacagtggaaaaccgtgtcctgcggatgccgggggccgctgtgctgtgtctgtgcggccccagccacaccaaggccgagctgtggcctcaagaccgagcacagggtccgtttcatgctgcgcggctcccccggcattgccaggcacagccaggcctgcagatgtggggtccctgagaccaggtgggacttgggggggacacagcccgctcaccatcttccactgaacactaactctacagcctggtttgctcaatataggtcttgtctatgatgggacctcaaaaaatcctgctgatttaaaataatttaagcgccctctttcattctttgaattttttagaagaaagatactaaggaaggaaaagaagtaattgcacaaataaaaaacagttaatcacgaggccttgtgggcatcctgtgcagccccatccctggcctctaccgcgctgtctgacacggtcactccagctcacgtccttgtagccacccttaaagagaggcggcgtcagaaacaccacggcctctgccccctccttctatcgcatgtcctatccatgtgctatttaattacatgccgattgatttagcatatatttgttcattggaaataatgcttgaaacaaaataaatatcatttggtgacaaaacgcactctattacagaaacagccccaggatcggggaggcccctgcagctgtggtctgagtggcattttgccagtgctgggagcccgtggtgggaggatgggcctgcgtgagcccttcggtggtccggctgcaagtgcttccgtgggggatccagacccagtacagttacatggtatctcatgctagcgtgggtcacgttagagtgagtttctacttcctaatgttaatgaattaatttcactctgtttatactttcttatattctctttttttttttttttttttttttttgtttttgaaacaaagtctccctcttgtctgccaggctggagtgcagtcgcatgatctcggctcactgcaacctctgcccctgggttcaaatgattctcctgcctcagcctcccaagtagctgggattacaggcacctaccacgacgcccagctaatttttgtatttttagtagagacagggttttaccatgttggccaggctggtctcaaactcctgatctcaggtgatcctcccgcctcagcctcccaaagtgctgggattacaggagtgagccactgtgcctggcctactttcttatattcttaaagagaaacaaactgaacgtttggttaggaaccgtctctaccacatacggtaacagtacaccgaggcagccactgtgggacaagagatccatttcaagccgagatgattttccttgtagaggcctcattttctgaaacaaatttcaaagttaagtgcacgtcactagtataggctaaaaatgtgaagctcccagaagttagcatttccaggcagatccagcttcacggttttctacgtcacaaacagggatttatatgctcccggttataaattccatcagagcatgcacgctacgcctgtcttctctggccaccttagccgtgtgttagaaacatcatacaggcaagagccttttccttctgcagacagcgtcctgtcctgttgtgctaatttgtatggccagcggcgcctgtgaacaagcacacagactgttccagttacccaccacttcagcagcgcatgtggcctagctccagctccacacgttccttgaagaggaatcaggctggtccttttaaattcccttccctagccatttagaagtccgcaacacataccccatcttggctcagaatctctgggaactttcaaacccactactcgcttggccccagaaactgtgaggtgcagggacacatggaatccgagagtgttcacaacactggggagtgcacatccaggccccagcccacagtgatgggctcggaggctcttctgaccatctctgagcagaggcttccattggaactcccggggctgactgcaatgcaaaattaaaagaaggggaccccgatgggcacagcctcaggtggcttctgtctcggaagctccttgtgcgtgtgtgaaatcctgaggtgtgagttgtggagccgtgcagagtcctgcgtccttctgtccctgctggccgcccagccctggctgggtgctcctcctttgtagcaccccagacccctctgacaagggtccccacgtgggctgctgctggggagtcagtcattccctcctgttcccagccctgttctcggctgctgagttagtcaacgtcagcatcaatgctgaaactgtgtggttaacatagaaatgaggaaaaagacataaattctcatggggcattttgaaagctgacctcaccccttaaagtagccacaccccatttcagaactgcctctgctagttcaggcctggactccctgcacacaggtgctcctgggcacccctctctgcccccaagcactgggatggagcctggagcctagacccttctccctgctcctgggcctcatcctcccctccccagggaggggctgggcactgggaacctcaggagcactggactccctgggaagcctctctctagtgattccagcggggcctctttgatgttcctagctgggaaagccaaggtctataattaccatggccctttcttctgaaacaagctccttcattttgagccactcttgtcagcatgtgctggcgttcatttgcaaatgcaccttgctatcgttttaaagcaaaaaatgcatttcaagaagcaccactgggccctttgccatggcgtttgttaacgctattaatctgatttaaatgaaaattatcctttatattgcttcccacataggcacactttttttctctttaaaattggaaggttataccaaacgcaatgttttcctttcctgcaaggatgtgtggggctgttttaatacagattagtgagagtgcagcagcagggcactgtaggtggtgaagcccggttatcatgtgtatgattagtttcaccttgtagctatgtctctgaaaatgcaattaacagtttcatattcagcgtagccagcttttattcctgccgcatggtgtgcaacatttgcatcataaaaaaaacctaattggtaaacacggtcttgccagcttctctgcgatccacccaattctctccacgttaattggctcagcttcagcacacgctggatggaatttcaaaggacgccgcagattagagagctggcaagcacttgtgtttcacggaactgactccaaggagactcggggaaaaatattttaaattaatgccaattgcaggcgacttgcttgtccaattgttgccatggagaccgttgggtctgctaatctgatgggtgtgtgtgtatttattgggatccatctctaatgaccttcagagaggaagtcagccatgctgggctccgcgcctcggacagggaggcccctgagtggccccttctcgactcggcccttctctggtgactttcttacactcacagcccactccccctcgcccttcagccaggcgcgtctgtgctgtgggcccggcggggcacaggacggggtctaaacacacacaggccacgcaaggcatctgtggcttgtgaagtgtgacactctgcccgtgtccgtggggaaagtcatccggacctcccgagccctgcccatcctccccacctcccttgtatgagagactcggaatcatcagggggctcctgaaatcggaagcatcgttttttctctgagaggcatccgtgttgatttgctgattacgagtctgaatgagagttcttgggagtggctcttattccctgaacgaggaaaaacagcgggtgtcaggccatgcactgtgcgtgttttccaccgaggcccccagaacctgaaaaggccacgcaggtgacacactgggaccccacagccgtccctgccacgtgtgaggaaagacatgaaacttccccagggacgtggctgaggctttcttagcggaacgtgacccttttgttccccctcctcctcgatcgcggcttccgtgtctatttttgtcttaattactaggctgtagtgaatggatgtgtttcccttagtgttggacctgggaccattagacaattgtaatagacagacatgtttgtgatttgttttgaactcctaataatagctggttgcttaattgcagaaaataggaagaaagacctcgtacgttctctgctactggcaaaaatcagttgtctttagttaaaaattaacaatatgaactgctggtgagtaaagagaaagggctctgctttcccctgaaagtggattccagatgcacatacaggggtgaggggcgggggcggtgaggacctttctgtcttcctcccacccctccctctatctccctctctccctctctccctctcttcctctctctctctctctcaccacccctcctctcactttttccctctctctccccatctcttctctatttgtcacacattaactaaaaagacctcagagtttttaatcggtagacaggggatttgttcattttaggttaaaaacaaaatgaacaatcagagaacaagtggggaagagggaactaaaggtataatggcttagagaagttcaaagatcaacaaccaaatcactagattcaaagattcaacgtggagtagaaatgaggcacagactggcactctgcagtgctcatgaagaaaggtcagctgaccgcctagaccccctgggtatctggagctgaattgttttcctctgctctatctgagcctctcatttcagcaacccacttttatctgagggatttgcaagatacaagggaagaaaaagagagacaaatgagagagcaaaaagggaaaagatgatattcgggagaagttcttattctcttaaaaattaggaaatgaaagtaagcttttgcactaaaaatacttcataaaaacaatcaaatcttttttgaaacaagaggaaagacagatggagataggtataggtgggggatggatggatgaatgaacaggtgaatgggtgggtagatggatggatgtgtggtggatggatgtgtgggtatatggacgggtggatggatgaatgtgtggagggatggttggttgggtgagtagatgaatgggtgaagagatggctggctggctggccggatgggtggatggatggatgaatggagggacagagggagaaatggatgggtaaatagatggatggatgatgaatgatggatgatggatatggataggtgggtggatggatgagggatgggtggaaggaggaatgaacgggtgaatgggtgaaaagatggctggcttcctgaatggatgggtaggtggatggatagatgggtagttggaaagatgcgtggatggagggatggatgactggatgaacaagtgaattgtttgatggatgggtagatggatggagggatggatgaatggatgagcaggtggattgtttgatgaatgggtggatggatggacgaacaaacaggtaaagtgatggatgtatgggtgtgtgggtagatggatgctgaatgatggatgagggatggatgggtggatggatgctggttgatgaatgcatagatgagtgaatagatgggtggatggagggatggatggatggacaggtgaatgggtgaatagatgggtggctggctggatggatgcatagacaaatgacggatggggtagatggatggatgaataggtgagttggtggatggatgaatgggtgggtgattggatggatggatagagggatagatggatggatgaacaggtaaattggtgggtggatgcaaggatgggtgggtgagtgggtgggtgggtggatggatgggtggctggctggatggatgcatagacaaatgatggatggggtagatggatggatgaataggtgagttggtggatggatgaatgggtgggtgattggatggatggatagagggatagatggatggatgaacaggtaaactggtgggtggatgcaaggatgggtgggtgagtggatgggtgggtgggtggatggatggatgggtaggtgggtgagtgggtgggtcgatggatggggtggtgggtgaatggatggataggtggatgagtggatggatgaatggataaatggatggatggatgggtgactggctggatggatggatgggtgggtgggtgaatggatggagagatggatgggtaaatagacagatgatgaatgatggatgatagatggattgatagatgtatgatggatggatagatgggtgaatgaatggatagatgaacaagtgaattggtagattaatgtatgtttggatagatggtaggtcaatagatagagggatggatggatgaacagatgaattggaggatggatagatatatggatgggtagatgtgtgggtggatgggtggatggaaggaaggaaggaaggcaggctggagggatggatggagaaatggatggatgaatggaaggatgtgtaggtggatgatggatggatatatagatgaatggtttgctggagaatattcagcaattgcaatagctctgattaatgaacactctcttggaaacttgccaagtctgtgcagggagctgcctggctaagcaggaaaagaaggcacagggccatgattctgaagtggaattcaaggaacccagtatctccctcaaggagcctgctcttcagcttatggaagccctcctaagcttgagggggtaacattaacttttctcctttatggttgattttccttcagattcttacaggtgttcactggccttacgagtcatatatgagaggacaaacatggaagtgcttgatatcccgtctgtgggtggaaggatgggcacatgaacttttctaaatctctacttctgtctgaccacctccactctccatggagatgtggctgagcctaaggtctactttcctcttctactggagagatagaactgagggtttgatttgggtcacagtcacccctacttggagtaaaatctgcatttgccagctccctttcatctaggtgtggccagtggatctcagctagaaggttaggtatgtgcctttgctccttcatttctctttctcatccctgctcttggaatgcagatgtgatggccggagctgatgctacaccatggtccaagaggtgacctgggaatttcaagaggggagaaaggagggcttcatggatgagtccccatattagccccgacctgcctgctttcacatttttatatgagaaacaaatgtaccatgttcttcaagcggtggtaataagagctggtgccagcagaggcagcagtccagggccactgcccgtgcctccgtacccactccaagtcaatcactggacatactttttaacaatcttctttctacgctttgtgaattttggaaatgcttccatacagatttgttactccttactttaaaatgttcttctgtggcttactaaacactatggattttttctttgaaatatttgccgtctgagtgatgtaagcttgctggagtcagtctcaccgtgatgtggtgtgtaaagccagcgtcgtgtcatctatgtatcagcccccggcagttcccccttcattccctaaccttttacctattcacgcactcactgagcagattgttttaaacatctgcttccgaaaggcacgtgtcagacactaagaacagtgcacaaagatgtgtggttcttgcccccgacacgtgggactctctcagccaaggagtgggagggagcagttatccaacaatttcaggacgaatggctctcctacaaactcgggatcggcgcagcttcatccacattcagaaaaggaagctcttctcaccgaagttgattctgaagtctttggtgagttatggaatatttgatctcttattgttgtagtttttcaaccaaaaaaagaaagaaaccatgatttgaccaagaaagaactgtggggaaaaagcacctcagtgtaaaataacgatctatgaccaactaatccagctggattttttctgagtaagattgttctttttctctttttaaaaacaaaactcatctcgcatatatctgctctcactttctctgtgggtccgagggaactcctctgtgagacagaaaattagatgacagttttttcaaaccccttgtccccgattattagtttgtaggataagttcccaaaaaccacagaggggacaaaatataaggtgtagtttcctactttcattttcactttcagtgttatataattttatatcctcctttgcttatagctccttaagaacctaagcatcatgatatgttcttaatttgtaccattttctatcacttaatatggtgatcgtcggtgacgatggtctgacggtttgggggtttcttttaaacatgtgctccctcttctggttgaatggatgcttcaaactggaatgaaatcaaacacctgtttatcttttgtgcatctttgattcaggccattggtatttgttaaaatcataagggattttgaaacaaagatgatagagaagaggcctctaccaacttttaacaatcaccgggagacatagactctggcatgctcttttgtaaatttccccttctttctatgttgtgagaagacgggctgatgtgaaaaactttcacagcatcaaacaggcacatctgatgtctttagcaatgacgtacagacccaggtggggttttgtgtgggtaaaatcaccgcagagatcctagcagagaccactctgtcatttgcacaccttcctgtcatttgcacacctttgtggtgtttgctgggatctctgtgcaaggtgcaaggtgacagtcctatttcaggattctgtctgtgtttacaaactggtaacttctaaaaccttctccgtggaggcgattgttattctaagtggaaagatcttgttaaaatggggctcttcctcccctgcccacctgggaccatctggagtggggggagcagacccactggtctttgcagcatctgaggtgctccatggggggcccaaggcctcactgaaatttaaaggaggagtcttagtcatcaggaataaattaacttttgtttactgtgtgtaaggcagcagagaaataaacaatactttttttaaaaatagactttttaaagtatataaacttctcatactggtgttatgtgggtaagtttaagttatcctgaaaatatatttatttggaataactttaactggtgctatataaatggggtgctactgtatcttccttaaaacttgaatttttttccatagtttctcatagtttcaagatttcttcattgcctgttagcctaaatgcacagtgggcaggacaaaacagaactgatgtttgtagaagtagctggtcagtggtgtttctgaggttttgagtaaatccatccatcttggaattcttactttttcaagtgtagaaatgatgtagtgtgtaccccactgggaaccacccaatgctgttaacacacttttaaacacaggttatttgtgtgtctgtgggttcactctctagatgtctctgtagcacctacaacgtctgaggcctgaagtaggtgctgagctggtggatgggtgagcagaggaaggaaaggacggacctggaggatcctggccccccaggatctcgtggtagtggaggaaaatgaactccgtcctcccgtgttgaggctttaccttgtgctgagcttgctgagggctgctggggatgccggagtaagcagggcagttcacacaggcccctgcctcctccacaaggacagggacaagatgaagtgctctacggggtcctgcaggggcatggctggaagtgagggtggagggtctggggcaggcaaaggccagcctggtcttgaaggatgggtgggagacagtgcctactcagtgggtttggctggtgcccatggtggggcaggatggcatggggaattctgggaatggcgtggcatagatcagtgatgatgagtgtggaaatccaagagtttcaagtgtgcagtgagtgtgtcattagcaatgctcatagatccaaatcagaaatttaaatgcttggttggtgttacctcgtgtgctgtttccaacaaagctcaaagattgatctctttatcatgtgctatacacccagaaagagctgcgcccaggcaggaaggaggtttggaactcccaggataagctttgctttttggccagaatttaaatgtgtccttatactcagcttgatgtcgtggtttttatattaagtgggaaaattttactcatctaagatttttgattaagattatccaattattaagaatcctggccttatcattggaaacattttatctattatatttttaatatgctgttatttacaaatcacatataccaacatttctctcatttgcgggttctgcttgtacatgctgaatcggcttcatttgcatttaaaataagacactatctttcccatggataagaacaagttgctatgtagaatgaagacttcttttgggaaattcttggcaaagaacctagctgagtggtgacggttaataaatagcatgtattgtgtataatcgtgcctcagaactgcttgcatttgaattgggtggaagcagatttgatcattgatcagagcgttttcaagtccgacctggagagtgagatggtgaaatgtctgaagcgtcgccttgtgcatgggaacctttgcaggttcactgagggggtcggtcacgggcaccaggtggggcctcctggggctctgttcgtttggacaaatgagaagaattcctgctatgcctggtggaactgatcacataggaagctctgtgagtgcagtgacctcggggaagtgcagggagtgcggggagctagaggcaggaagagcatcttggaaacaaaggtgaaaggagaaagcctgtgtctcatttcagaagaagtctgagtatatcaacgtgataaaattgaacagtaaacatttactcaccacatttagtagcatatgtacttagtaaaactttttaaaaaacaaacttacaatgactagaccatgagaaagacagacacgtgcgtggaagagaagatagaaagaaaacggtgatactagagtcactgaaattctaaacattcgttagaggcccgcatgcgccaagcgctgtgtgaagataaatcacaacgtggccctgaaggtttaaggccccatggagacacgtcactgctgcctgctggtggggggcaggctgctgcttttggaatgacttcctttattgttcaggtgcaatttgtaaaataaataagaatcagtggaagacaaaaatatgaaataaatgctaagctgctctttgatagtgagaaagcacctgagggtgtttccgccgtgtaagccgccaccacgcgcgcgggacaggttcatctgtttatgaggaaggacagaactgagttgaaatgcacagacctggcggggagcccccgcggccttctctgtaaacaaagccctgcgttttggtgtctcactcctgttttctttctcctgaaaatgaaaataagaatgggcaattattccatattttcccatcatgcaatcagtagaaattttggtgggtgtaatcattgattcatggatccgttcattcctcagaacccatcaggcagtgtgtatacacatgcccacacacatacacgtgcaatgcacaccccacacacagcacacccacacactcacacatgtgtacatgtacacacccacacacacagcacacccccacacacagcacacccacacccacacacagcacacccacacacagcacacttccacacacacccacacccccacacacagcacacacactcacacgtgcacatgtacataccccacatatacacaaagcacacccacctacacacccccacccccacacacagcacagccacacacaccctcacacacgtgcaatgcacacaaccagatacatacacacatgtgcacatgcatgcatccacacacatgcagcacacacacacccacacacccccacatgtatatacccacacacatacagcacacccacccacacacagccacacacagcacaccctcacacatagcacagccacacacaccctcacacacatgcaatgcacacacccagatacatacacacacatgcacgtgcacacagcatagggaccaggctgactgtgatacttttctttctagccccttcctgtccccttctgtgtcttcatgccttcatcagatgcacctggcgcttcctccacagcagggccacatctcatcaccactggccatcgtccgctctctgctccctgtgggaggtgccctgtgaggccccactgccctccgtagtccctgcgtctgggtcccctccatcactgtcacaccctgtgatcactctccccttgtcctctctccttgatgtggccttggtgttgggtgggctcaggtgaggtttacgagaagcaaaggaaatgttagggccaggacacctcctgcctctgatccctcgtcccctgcttacccttcctgcccacccccagcaccagccacaccccgcactgccgcagctccacctgggatgggctgacgtgtgttccccaagttcacctgggaagcgccaacacccggggccgcataaggcgactgtatttggagaaagtgtctttcaggaggcgattgaggttatgtgaggtcgtggggtgggcctggctccagcaggactggtgtccttgaaagaagagacactggagaagaagccacgtgaggacacaggaggagacggccgcccgccagcctgcgcagtctcaggagaaaccgaagcccggacctcagacttcagcccccagaaccgtgacggagtacatttctgttgtttgagccgctcaggctgtgaggcttgttagggcagccctagggagactagcaggcttcccgccagaggaccacacaggaggccctcctggtccaaaatgtcatgaccgcatgatggagctggggtgtccatggggtttcctgtctttgagacatgatgcgttacaggtttacttttggaaatgtgggtacagccagggtggccccagtcagacccaaacaagtctcttggcctaagggaccctgggcctatcttcctctgagtgacaaggacactcagcgtgcacagccacaccaggtggctcccaagccctggcatctatctccataggggtgggatggcccttaaggaatccattgccgtccacagctgcaaagaaatgaggttgtggaaatggcaagtgagtgataagtgtgtctgcatcccgggcggctcttccctcgccagatctttgcctggcgctgggactcacccttgctgggactcaccgcaggtgtccagcaagcttgtgaggctcaggatggcaggaggtcagctgtgtttctgggttgtcagggagatgttctggatgccaaaagaaggctccagggccagaccaggctggcactgaactgtaccagcatggaggagcaaacatgatttggactttccttggaaaagttggtaaaaatcgatggagtctttgcatttccattcatgctgcctataggatctgtctctctaaaaaggaaaagggatgtgaactcagtaattccacgaggaacacagtgttggctgctttcttagggtgtcacatctgcaaaactccgtaagttggttgcaggtgcctgtgctgccccaggagaggcaggaggaaggggcagcaggtgccccaagaagggagaggttcacagcagaagccttggtgaaaaggagctttgaacatgtttatttgggcagtggctgctgctagtaccacatttccatcagatttgacatgagcattccaaagaaattcagatgcaggcagaaacccctcagcctctaaggttttactttccttcatgatcccatagagttaaaaggagccgtgcagacttcccactctgagtgcactagagacacgcatttgcacacacgtgcattttagacgcagtgtactgaatactaacagcatccacgtaagatgtgtgcctcagcgtgcatgaggacattgctgtgggaaaccacggtgggcccttcctgtctcttctggggagaacccctcatgggccacgagcaccacctgagccttctccagctgtgcagtgactgaccagaggcctcaccgcagatgcttcctgccctgcacctccccctgcaccccatcttccagctctctaagacaacgtggacagcaaaacgctgcagctaatcttattttgtgcatatcaagtgggctttactagcccctactttttaaactctagccagtgttagattagtgaattccaaaccagcttaggtcttttgcttagtgacctttctctttgcatttttttttaaagaaatcagcgaaagccaatagtaacctttccatattcgccaccataagctgcacccaccttaagagtgaccacgactgggtgcggtggctcacgcctgtaatcccagcactttgggaggctgagttgagcggatcacatgaggtcgggagttcgagaccagcctgaccaacatggagaaaccccatctctactaaaaatacaaaattcgccaagtgtggtggctcacgcctgtaatcccagctactcggcagactgaggcaggagaattgcttgaatccaggaggtggaggttgtggtgagccgagatcacaccattgcactccagcctgggcaacaagagcaagactccgtctcgaaaaaaaaaaaaaaaatagtggccacacagctcagaccgcaggtacttcatgggtgccaggccgattttctcaagccggaaattctgaggcttgtgaggaaagggggaggtgtgtgtttctcccgcttccatcttactgtttatgtatctattagcatttagcatttctacaacacacttcataccctaagaggttttaaaatcagccatcataaacattaccattatcatgagaggaacagaaacaagcattttaaagatgaaatttggcaaagtagaagaagattttctaaaaccattctttaaaaatgaactcagagtcacagaagtgaaatttacatgcatttgcttgaaggagatggtttgtaaaacctctgggaatcaaatactgtcatgaattttttaaaaaatgaaaaatttaggaagagcagagtatagtgggatcaatattttccatataagcacacatagcattatcagatcctgaaaatgaaactgtcaggaaagtgataagatgtgcctctttctgttatctcagagaaatataacgtaaacaagcagcaaacccagtgaaaaaggattgttttgaattactttttttagagtccactaaggtgttatttatagcaaaggaatgcatgcagttctttaaaaatagatgctggttaattttttaatctgctggttttttaaatataaaaaacctaaaactagaaccaccacccagctgtggacacacaggaagcatctgggaggggttaggaataaaattcgggtgccattgagggtagctctgagtcctggggccacacaggaagtgggcggttccctctctcatcctctgggatgggaggaggctaggatggcccctagaccctgcctacttctctcaggcagaaacatcatgtgaagtctttttggtgataaaacccattctttactcccaaattgggcactggaagcattaacagagcaatttttgcttttcctgtcaccttagagagtcaccaagttttccaaacgaggagccgaaaagcagccatgggggctgctcccatccgagagccggagtcttctggaactcagtgaaatgaaacactggccgggctcccaaggtgctgacacgtttcctatactgctatgacagtagcaaatgatttttcgtagcttgtggaattgtaaatgaagtttgctgattaagtcggcaacagtgatgaaattaatagatgctctcagagtcattagacaagctattctttaaaaaaagcagaggcccgttttaccactggccttggcgtgttgggaggtgccgccaagcccatgtgagaagctcgccaccaccaagaaacctggatcccgccaaccgcagggctggagcccggatggcgtgcttccccacccctgtcagtcagctcgggtggccacggtgaagccccacaggtggggcagacatccatcctctgcagtccccaaggcctgggtctgggacgcctgtgggcagggcttgttcctggggccgcattccctggctcacggtggctgcgtcgtggccacgtcctcaggggctgtccttctgtgtacatgcaggctgtgtgtctcttcctcttcctgaagaacacaggtcctattggattggggccccctcaggacctcatttttttttttttttttttttgagacggagtctcgctgtgtctcccaggttggagtgcagtggcgggatctcggctcactgcaagctccgcctcccgggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctgggattacaggcgtgagccaccgcgcccggccttacctttacctctttagaggccctgtccccaagtacagtcacatgagggttcagggcttcccctgtggattttgggggacacaggtcagctcatgacagaagccaaacatctcctgccctctcctgtgctctttcctcctcccctggatccaagcggcctgtagcagacccccacttgtgctgccaaaccccggccaggaccagggcactccatctcctgccaggagttccacagatgagatccagcccagccgtgtccacgccagggtggtccaggccagctccccacctcacggggcttgttgaagagccttgtgtggctcctgctccgtggacctgctgagctttgaggcagccgggagttcctccccggcaagtccatttctctcgctgcagctgacctgcccgaaacgtcctcagatctgcttccagggagcaggccccggccccaggattcctggacatttcccaggctccctgacccccgtggtgtccttcacatcctcctcttcacccctcagatgaaccctaagctccagggagggaggggcgcagtgggagcttttgttttctccctcatccacacctgcggcatttggccccgttgttccttcactgcatgctggccaggttgccatccggctcacgaggcgccgtccactgtactggggattcgggcaacaaaagtgactctccccaccagaggttttagtttacaacatttcccctcaccgtgaaactggaagctttttaggggccgaaactcagtggcactaatttttcatatgaccttctcccaaaacacgtccctgcctctctcatcctccgtagaaccaactcttaataaaggggtgagtgagtgaccatccagagcacagcctctgcagggggcgggtctctaaggcagcactcgcctgacgaccacgccgtgtttcccgcgggggctgcttgcctcaagcccccgctttgcacctcagttcccataaaagggcatttggtggtgagatgtggctcccgcctcggtggggggcagagctggtcagtgctggccatgggggccaccccatgtcacccgaggtgactccaagggaagaggcactaagtgccatttctgaatctgaagctggcggccatcgtctccactgaaacaacgtgatcccaggacctggagacagcttggccagcttccggctggaggaggatctccaggagtcccagtgcagcagcgggtgcctccggatgacctcaaatacgatgcaaccccatagtttactgagcacctcctcggtgcctggcacggttccgggtgagggcacaacagccagtcacgcagactcatgttcctggaaggccagcgggcccatgcctgctgtttgtgtataaacagatgaaaagtgtttgctaatctccctgaggcagtgccgggctctcagcacggattgggagttggcatcatgacagggcggtcctgaggctgctgatggttttcggccgttttaccatctactacactgcctgcgtctgtctgcatggtgggagtgcccgtgaggctgaagtgccgccctcccggtcctcaggtccccctgctgtgcatgtccccagccgtggactcaggccctgtggtcctgaggggtcatgggtataggaggtaggtttggaatcagctgtacctgcttccagattctggctctggcttttgctgctgcctgaactttggcaaattatttaaggctccagcttcccattctttgcacgtgaactctacctctgggttgctgtgagtgtggagtgtggtcccctctgtgacatgcacagccaagagcaggcctgtgggagaaggccctctgctctctacctgtggccgaacctcagccccaccctgtacgccacctacggccagatcccagccccacccttcaccccgcctgcggcccgacccagcccacgttgcaccagactgcggccagacccagcccaccttgcacccacctgcgccaaacccagccccacctgcacccacctgcgccagacacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgctccccacctgcggccggtacaccagcccccaccctgcaccccaacttcagtcatgcttcccagtagacctcaaagccgaaatgtcaggcagcttcctgttaagaaataaagaggaggaggaagaaggaaaggtgtgcagggcgttagtggtgaccaggtgctttcatcccggcctctcgacggctttctcgtgttgggtgattccagctgagaaccctctggcctgaaaccaagcatgcatggccctggggcttttaaacccttctcttacgggccttggcgattgtttttgaagtgatcactttaaccttttgttttaatcctctggttattcccctgactggggaatgcaacctgagaagcatcctttggcaaaagagaagttttattagtgaggcaagcagttaattaaaaaaataaaaactaggttgggcaaggtgactcatgcctgtaatcccagcacttcgggaggccaaggcgggtggatcatttgaggtcaggagttcaagaccagcctggccaacatggtgaagccccatccctactaaaaatacagaaattagccgggcatggtggcactcacctgtaatcccagcttctcgcgaggctgaggcatcagaatcacttgaacctgggaggtggaggttgcagtgagctgagatcctgccattgcactccagcctgggtgacacagtgagactctgactcaaaaaataataatgaaaaataaaaaaaaaaagtaaaaataaaaaccagaggccagagttcatcaggtaaacatctgagatcaagtgtggtatgtcggagctgcgaaccccagtctgcaccccacctttgagtggctgagatttaataaagtgcagtgaagtctcagacccacacccccaccttgatgtttccagttacggaactcgttatcaggtgggccagggactcgcggagaacagctgcagacagcacctcttccccctggtctcgtcgtgtggacgagtctcccgatgacaggtttcctggaggcctcatctccggtgggtgccagcaagtccagccagggagcaggtcccagaactcaggttcccaggccaagctttcccctgcctgtgttggtggaaaacgcagggtaagtgggcaagagtgagagaacacaaaagccttcagccgggtctttattgggctgctttatctttgtgtagctccgtggcacgtgaaaacgagagcgtctgaggttggtgagaaattcgggcagcacacggtgctcagtcaccatgaaactaatttcacattgggagctgagttgtgaaaacggttttgctgtttatttaaaggagatgagagtggacaagccgactagaaccccctgatggcttgagcgagggagaaggagggtttgtgttcaggcaactaaatctgccttctcttcttttaggctggaaataaaagccggtcagtgcaggggtgtgaggggctggctgtgggttctctggcatgaggctcacgtttacaggaggtcctcttggtgggcatagtgtaggggccagggcggacccctacggccgctcggaggaacagccaggatcggacccgggaccgccccacactgtcagcactgtaggggtcactgttgctgcagctcacagtcccctggcccccggatgcctcgcaccccgcacaaagatgacttctctacccagaacacaaccctcttacgtggggcatgaaggatggagtccagccaaacgtgcttcaaaatctcagaattacaacttgaagtagagttttttttttttttttttttgagatggagtctctgtcacccaggctagagtgcagtggtgcaatctctgctcactgcaagctccacctcccagattcaagtatttgcctgccacagcatcccgagtagctgggattgcaagtgcctgccaacacacccagctaatttttgtatttttagtagagatggggtttcaccatgttggccaggatggtctcgatctcctgacttcaggtgatccacttgcctcggcctcctaaagtgctgggattacaggtgtgattaaacattacatttactgagcttgaaatgtgaggtagcttattcggtctacatttagactctgtccaacacagcatctacgttggaggctggacacgggctcctctcacggcagagctgctgctcctccgcgtctcacgcaggtggtctgctgtcctcagcggatggatggcgtggtcagagcccaggagcctccgggccagccctgactgctgctcctggctctgagctagtgttttaattctttaattattccatggctcttttcctattccacagaggagtacaaattaattatttggtaaggcacttaattaaaagtagagctctgaggctgccgggtaaaagctgaagccaggctgcagcccgggccctgggcctctcccttggccctgcagtccttttcccgggccctgcattcctctcccccagccccacactcctctccccctcgccctgtactcctctcccctgcactcctctccccccaccctgcactcctctccccccaccctgcactcctctccccccaccctgcactcctctcctctgcactcctctcccctgcactcctctcccccagccccacactcctctccccacctccctgcactcctctcccctgcactcctctcccccagccccacactcctctccccctgccctgcactactctcccctgcactactctcccccagccctgcactccactcccctgcactcctctcccgtgcactcatctcccctgcactccattcctccggccccacattcctctcctctgtgcaggggctggtctgggggctccacagggtccctatgacccactggtctctgcctgcccctccctgcactcctccccccaggctctgcccctccctggcctcctctttctgtagaaacccggctttctgtcatgcctccccccacgtttatctgcagggacattctggctgctgacgtggctttgcccacccagccaggctaatgtggctcccttctcctccctggtccttccctcttgagtgaggcccacctgtggcccttccagcccttgcagggccagtgtggatggcaggaatgactggctgtgtgggaggaacctgggctccaggcgccagccagggggatttatggaaagagcagccccctgtcctgaagtcaagggtctgtctccgtggccttcccaggacaggcaggaactgctggagggggtcctgccctgtggggcctgccccatccttggagctgaatgacccaggtgctgtgacctcagtgggagcccaggccaggcgggcccaggggcgcagttgctccacagacacagagcaaatggagccgccaggcagccccgcagggcacgtgggcactcaggaggcagctctgtgcagaactggcaggcatgacccaggccccatcagatgtgcccccaaccccgtcctcctggggagggcagacaccccacgtcaggggacctggggccgagccctccctgggcccccgtgccggcctcattgcactgtgggactgctcctcatgcctgttgagcagacagcaggacttagagcttggtgacagatgggcaagcaggcgacagctgctggtttccagagaagctcgtgcctccccacacccgccccgggcctaggatgtgtcagggaggttgggtctcctgagggcctggcgtgggggaagatggctcaggtcatacatggtcccctggggcaagggaaaatggtttgctaggagaagaaaagatccattctttatcactggatttgaaacaaaatgactttttttctttgcaagcacagattattttcaggagcaataaatgccttaaaaaaagaaaagctagagacgaagaaagctagagaagaaagctagaaggtcccctgaccctgttctcagttaagggcttgtccacaccagccagagcaaacccacaccaccctccaacaggcatgggggaccggccctcggggtggtgggagcccccatgtgcacgcaggagctgcccgccttggaaggaagggctctaagccgtgtgagagaccaaagctcccctggcactgactggcaggaaagcaaagatctatctgaccagtaggttctcttagtaatatttgttactgtatgaatgtttggggtccaagtgcggtcttactacgtggatctgttgtgtagtggtgaagtctgggctttgagtgtagccatcactgaataacatagatgggcccgagcggcgaattctcaccctcctctcccttcccagcctcccgggtctgcagcgtccattgtcccatgtgctacatccatgcacgcatgtaatttggctcccacttaaatgtgtgaatgtgcagtatttaactttctgattctgcattgtttcactcaagataatggctccagttccatccatgttgctgcaaaagacaggatttcatccttttttatggctgaatagtattccattgtgtgcaaaagacaggacttcatccttttttatggctgaatagtattccattgtgtgcaacagacaggacttcatccttttttatggctgaatagtattccattgtgcgcaacagacagaacttcatcctttttcatagctgagtagtattccattgtgtggacacaccacgttttctttatccattcatccactgatggacacttacgtcgatttcatgttttgctatcgttccagtgtgcatttccgaagggtagtctacttttgcttaaacttgagtttgccgtagaagtcagatttccatggatgacccctccttctgcacctccacatgcacacgtggatcctcccctctgacaggaggtgctacgccgcctgctcatgtggacgctgaggcaaagcaggctgcccatgccctttgcggggctggcaagcccttggtccacacccagatgcacgttcaggggctgaaaggccccatcctactctaagactgcaggtttgctgccttccaggaatttacaattcatggcaacaaaccttggggtgtgtttaacaaatgctcattgaattgggcatttttatctcccagatgtggctggactggtgagatctctccctgagtgacaggcaggcctggagagagttggatgaaaataaaaccagatagaaaccgtagagtgtgacacagcgtttgtaagctggggacacagtgttgatttaggaacaaggagctgtaagctggggacgtggcattgatttaggaacaaggagctataagctggggatgcggcgttgattttaggaacaaggagttgtaagctggggatgcagcgttgatttaggaacaaggagttgtaagctgtggacacagcgttgattttagaacaaggagttgtaagctggggacgtggcgttgatttaggaacaaggagttgtaagctggggacgcagcgttgatttaggaacaaggagttgtaagctggggacgtggcattgattttaggaacaaaggagctttatagctggggactacggcgttgatttttaggaactaaggagctgtaagcctggggacacagcgttgattttaggaaccaggagttgtaagctggggacacagcgttgatttaggaacaaggagttgtaagctggggacgcggcgttgatttaggaacaaggagttgtaagctggggacacggcgttgattttaggaacaaggagctgtaagctggggacgcggcgttgattttaggaacaaggagctgtaagctggggacgcggcgttgattttaggaacaaggagctgtaagctggggacgcggcgttgattttaggaacaaggagctgtaagctggggacacggcgttgattttaggaaccaggagttgtaagctggggacgcggcattgatttaggaacaaggagttgtaagctggggacgcggcgttgctgattttaggaacaaggagctgtaagctggggatgcggtgctgattttaggaacaaggagctgtgggccaaagtggaaggcgctcgctctaacgctgcctcagattcatcccaatgactgtgggaaacacaggcatcttcctctcgctccctggtctctgtccttgtctaaattcccttccctaagatgtgttgtttgttttctgctggttattttctgtcagctttaagaggagaaatatgaggaaactttgctgtgctgcttcgtggattaaattaaaaaggaagcagtggcgggttaccattgccacccagtgttaagtggctcagagcgagtcacctgccctgacctgcatcggtattttctcctctagaagcagaccagtattaatggcctgtagtgaagtatcgctgtgtcaataatatttaaagaggaggaaaacaacgtgatacattaggtcttctctgtgggtttcaaagcaacacccaacacactggtcactgacacagggactttgcgataaattattcaagccacagctcagggtgtaaactgcagccgtgcattttgaaattaggcagtaaaataacagcattgtgtatgactccagacacgggcgcagggagacccagtgagctcagtgcatggggggccactgaccccccttgggttttgtcttccgaggccattggcattttagggagagatcgtccagctctgggcctgtctgctcaatcgacgctctccagagaggccttcaacccccgtagggtcaacactcatctcaaatcagagatttgaacttccgacctaggatgggttcttcctgctgtcctggacccgtgctgggttgggggtggctctccaggacctagctctgtggcccaccctgcccctctcttgcatgaaagtggagccagggcggggactcagggacaggacacctcccggctggccgacctctggctctccaggcctggcagatgattccgatcgccacctccccatgtttcctgagccctcatgggagtttctggaagcttcccactgctctttctcttctgtggttcctggccctgggtggacgcgtcatggaaattacatttctgaaaggggaggaaaaaaaagcacatggggtatgtcctggctctgaccgggtacgggatgtccctgtggggtctttttttgcggaggctcagggctgcttaggtggtttttttttttaatttcataaagtcatacaacctaggaaaaaatctattttcctcttttgtccttggtcttaatgtgaacacggacaggtacgcaccgatataggaaacctgctcttcagagaaatccgaatctatttacgttttgatagaaaatcttatgagccgcccataatatgttgtgggaaaatgagttagagctcgtgatcagaaaatggaaagttgcaactcacacctcaatagaggccacccacctgcgatgatcctcctgaagcgtggcctgtgggaggggactgtgacctgggcagaccccgtgggatccgtcataagggaacacctcccagtaagacgggggctccaggctcaggcgcccaaaccacagctccccactgggagtgacccggccgccacgcgtctgtctcctggcgtctgtgtgtccccttcaaggggcctgcgtgggcaaaactgaagatactgtctatgcttcctgagcagaaggagccaaaaggtcttcccatcgcatacttcttcttagatttaggcgtgggcagtgattccagctggactctggaggacagtccacaagctcggctgtcctgtggccacggtgcctgggggctcctggtggagtgtgaccccccacatctgcctctgctccctgctctctgttgggccaccccaacccctccaggggacccccagataaaggcttgtgtgcactggtgttttccagagcagaaaatcctctacagcttttgtgttttattttgttttgttttatttttatttagttctgtgtattctaatgtgttattaaaaccttagcaccataaggcgctgatttcaggagccctcctgttagaatgaggtggtgctgagagacccactcagtacagaccgtgtggccggtcccccaacctgccagctcttcccacaggcagaagctcagaggctgcaagggactccgtggccatggcgattccactcccaactcatcctggagagcgagagactcggggccatgagcagcccctctttccagagaacgtgtcgccatgcagtctttgatcacgtttaaatgaacaaaatttgggtgttttgttttcatggaactcacctttagggtggccttctcacagcaatgattctgcttttcatttacagtagtgatacacaattttccatgtattagatgatataattaaaaagtgaggctttaaaaacatactgagtgcctgacagctcgggtggcacatggggaccaccagtctccctgggcgaatgggctgtgggccgagtcccggcactcaggcgtctgttctcaaatactggctggagcctcctgcatgtctgggctgtgcctgtgctggcctgatggtgatggaggccctgactgtcatgcaggcctgcgaggggcacgggctgtgaccgatgctgggagccttttttgagccccgggagggtctgatctcactcctgctcagcgcttaggtgcccttggcctcgtcctgggtccccagccttgggtgcatcacttctgggagggtctaatctcactcttgcttggtgcttaggtgcccttggccttgtcctgggtccccagccttgggtgtgtcacttgctgggatctgctgagaacagccccgtgcagctctcaccccaacactccctgtagcccatctccacagatcctcactgggtcccaggcaggctgcaagtctgtgctagctccagggtttaacaggaaacaggtccgccctccctcgccctccctcaccctccctcagccagagggaaaccggccctgagtttctgtgccctgcacgggcagcacccggtgccaccagggctctgtgagtttccttcagtgaagaggacgtgtagaggagctgggtggggccaggactccaccaggaagtgcaggccgggcccacggcattgggttcataacaagtggcaagacccatttgtcaaagagaatctgttcctggttaggaaaaggaaacctcagaaatgccggccattgccctttttaaagtgtctctgtggcaggaattgtccgggtactttcctggggatccccttagccaccctccgaggatgggattgcgactcccatcacagggagactgagaaacagcagagcccgtcatgccccagcctgttgccctgtgctgcatcaggctgggtgcctctcagggaagctcggtcgccttggcttgtgacaggctggagcatatccagcagccctggcagtggagatagcagtgcccctgcatccacaccccaaagcctggcagtggagatgagcagtgccctcatgtccacaccccgcacaccttcagagtcagatgtggactctggccagggccagggaagttcgctggactctggggatctggggcacatcttgctggcagggttgacaccagcagctctctctgcctgactggagactcggcccccctccccagtcctcctcggtaagcgctgggactgggctggtcactcctgcctgtccattcactcacccactgtgcgccaagtcctccctcccactgtatcggagggaagctcggtgacattccagtgtcctagtccacgtgctttgtgccccaggcagccccagctcctgagcaccggcccagcaacatgagaggctgtttcctgggacttcactgggaaggggaccagcatgtcctactgtcagcaccgccctgagccctgacccccagcctgccctgctcccccatccaccgatgtctcctcccttgccttgtgtcgctctccccctgcccagaacttgccagaggtgggtgcagggcggggaccgttgggcatggtggcatggagtgtggcccaagccttggggagagggtgggtgggggtgccctgaaggaaggagaacctggatcccagaggacttggagcccctggaggccacccctgtgcgcaggtgccgtgatgcattcctggcccgtgcccaatctctgctgcacctgtccccgtccctcccctctgtgctccaggtcactcgcctgcttgggaagctgtgtcgctacacgaccctggatcctgcttatgatctgttgaactccacgagtgcccggtcttccccggtggcgctcatgaattatttatctgggcccgctctgccctgggctcgcactcacattaactcgtgtccccagctgcagcttcacctgggcttgttttcgtctcggtgtatttggagcgcagaagagcaacttgcatttttcttcatagagggatggagggcaggttttgttgagaaatacaaatttgatttatttccaagaaaacaacttttactgtcaaagaagggacacgaagcagctctgcatttggcagcccccagaagagttttctttgcagctaatgaggaggagggggagaaggcaggtcagcgcagccctgggcagggcggggtgggatgcgggggcagagaccttggccgagtgtggaaggaacacagccagcaggcgggggattgggcagaaggcctgccctgacctctcaatgctgcttcccttgagctacctgagccccggtttcccatctgtgaagtggggtggacgtgacaaggatgtgtcattccggcccgtcaggtacccgaaggtgaggtggcacccgcccccgctgcctcccccagaccatggtgtccagcagaatcatggctaagcagccacgaaggcacccacccccctcatccctccaccccttagacgcacttggtcagagcggtgcagaaaggaaagggctacagcagccctggtccctccgacccagccacagatggtgccccccacaagactccgctttcttctgccctctgagtcttacccccttatgaaaaccgctgtctttctttcttttctttttctcttttcttttcttttttctaaggtgtggtcttgctctgtcacccaggctggagtgcagtagtgcaatctcggctcactgcagcttagacctcctgggctcaggcgatcctcccacctcagcctctcgagtagctgggactgcaggcatgcgccaccacgcctagcttaacttttatatttttagtagagacagagtttcaccatgttgcccaggctggtctcaaactcctgggcttaagtgatctgcctgcctcagcctcccaaagtgctgggattacaggcatgaaccactgtgcctggccaaaaaccacggtctttcgactcagcctgagctgtgccgggatcttcttgcccattcagcctccagcccgggggtatctgcacctttagaatgtcagttccttagcgcagaggaatgtgttatagcggtaggagttcaggatttaggtcttgcctttttcttcatttaactggcatgaaagagacatgtttgcatatgaggacacagagggtgtccctgattttcctcaggtcacactgcccattcctggctttagacacagatgtgagaaggggatgcaccccaagaatgggacacgggtgtggcgatgctgcccagagcagccctgcccagggtgcagcccagcactgacattctgcaccccactgggggccaggaaacaacccctttcttgtaggtggttttttagaaagtgtggacgtgcatgacctgtggaccgggtcatgggcatttctcgcctgtgcatccctcccccggttccctccagcccccctgtgctccctggggcttgcagactgagtcttccaaagggtttgcacccgtctgactcactgttgttacttatagtagcactaagaagggtccctgattcatcactgttctgatgtacacacctgcccgggaatgcgtttggtgtgtttggtctatcagcacgtgaaagacagggaaccctcctgtggggccatgtcaagacgtgcaggcaggacactgtcctctgctctggaggttcagttgctttagctgggcccggccactgcaaaccagcctcaggagagctgggggcacgcctgggagttgcaacatgtggcaatttagggggaaatgagagagagagacagagactgcactgataattctccgtgtgaccaaagcacaaagaagcctgtctttgggagacaagctggaaatggccaggacgccagtgggggctccggggagagacagcatggtgttccctggtgctcccatggtgccacaggacatgcatcactcacagtccacaaacaattcgggaaaggcagggaacgcagcttctcctctccgtctgcatgaggcagctttgaccctggcttggagaagacaaaagggggagtggtgaggactccggtcccctgcatgtccggacagtgttctctggatccctgctgcagtaacgcagggaatggcaggtgtggggagagctgggggcatcagtgatgtccggagacccttctctggatccctgctgcattaacgtggggaatggcaggtgtggggagagctgggggcatcagtgatggaggtgtcagaagtgatggggccaccccactgggatgctgcattgaaaagcagattccctattgccctgaatgtcccactttctgcagaatggatgttcttagtcccccatccgctctgtaactgtggatcccacactgcataataactgccccatctctagagaaagactgatagcatttaggacaggcccgaggaacctgtattccaactgttcacccagtgtgaacaaaaccagcaggccgcttcctccagctattcagcatccagacataaaactcagcagtgggaccaggcagctcctgctgtccaccgggtctgctctgcccctgggaagtctcttatgcaagagataatgactgacaggtcatcacaccctattagtgaccggacactacgcccccattaatgacctgtcatctcaccccgtttagtgaccgatcaccccattagtgaggggtcatattgcccccgttagtgaccggttgtctcacccccactagtgactggtcatcacgccccctttccctttagtgactggtaacctcgccccctttagtgaccggtcatcttgcccccgtttaggttccagtaagctccacacagcaccttaccttaagggaggaagagatttcagaagcagatctggacacttcgtgcttcctaatcccaggaagaaatggaatctctgtgttgccgaccaagcgtgggcggcgtgctggggcagtgcagctgtttcatggctggctgtgaccttcacgggctcattccccactggctggtggagggggatcatcactccctagatgtgtaccggcagctactccagtgcatgaacccgttatatcctaaagcggggttctcctgggacacaggtgaaccccagcgtgtccagcagcctccctctcactgcggctatagctgataccgtgcaaatgaccccaaagtcactgggccccctcgctccagattcactctggagggtcctggaggaggggtggagtgggtcagaaaccggcagctcctgtcagtgggtgggcaccgaccacctgctccaaaatgtctcctctgcccagttacttccagtcctgccaactggatggtccttgggtttcattagttcttccaagggcagaaccccgtggaagagtgaagccttcattatttctaatttagcactattggcttgaatcaagcagtcctaatatcaaaccgtggtaatgctgagtgaatgggaattttgagtgaggacgaaaggaagcgtgatgtctgaatagtgcagatgtcgcagaaaggcaggcaggagggaaaggaccacagagaggagatgccacctgggagaggcaggcatggcctgtgcttggggagatggagacggatgcagccagttctgacctccagccccacctctgccactgaccacggtgaccacacacggggtgccctgcctctctgggcgtcagtttctgcgtgtctacaaggaagcaattggactagctgacctctcaggccattatctgccgccagagtccatggtcctaaagcgaagcctcatccgcttggcagtcttgcctgggtcctagtggtggagccttcacgttgcctcacatccaacagtgactcgtcagaggcagacatacttgctggcagctttgcagcaccctctccatagcttcccccggacatacgagagcggggctgtagatgagggtatctatctcatgctattgcctcactgagcaccagagaagatggtcagaacccctccctcctcccacctccatccatctggaagcaggaagtgtgtttgtgttctggcctttctcttgtcagtagtgagagattcgttacatttcaaccccaagcatttcacatgcggtggcatcttggaggagctttctaagcgaggccgggtctcgtcagccaggtgggctgtctggctggtctccctgctctcgagattcaaccccaagcatttcacacgcggtggcatcttggaggagctttctgagcgaggccgggtctcgtcagccaggtgggctatccggctggtctccctgctctccggatttggatgcatggtttccgtgcacctccctcaggagtttgttcaagagcagcgctggctgtgcagtgagtagaaaacacacttgctgtatctacacagagaagtttaaaagaacagaagaaggacagaggcttcaggaccacagtgatggatctgaggggggcctgaatcttaaaccctatccgtatagtctccaagcagggatcatatatggtataactacattttcatctctaatcactggggcggcatgtcagtatcttctctttctttcccattttgagtgacatagtgtgatatgtctaatgacaactagaacaaattctggtaatgaggtcaccttgggccaggatgactgtctgacggctgttttccatagaaattacttgtgaaggcacaccacacacacagaatggcttcctccaagtgtaggtgtcaacaggcaaatatgctaaactcgcaagatggaagtggcttgcccggtctctctagtttagaccgataaattggtctacattgagagagctgctgcttttttctaaaaaaagagtgattggttgtgattatttagtttcctccaggtgcacgctttttatgtggaatgcactggatggcttaaatgcaagtagggcccaaacatctgatgtcactttgttaaagggagtgttgagtgagcacagtcgacgctcccagaattgtggagaggatggctgcagcagaaagctgtcagtcaaggcccatgaaccaagaggagtgctagagaccaccacctgcaggtgggatttggaaaaggggaaagaagtgtgggcgctcagccaggggagtagcaccgggtggggagcagcacggggtggggaagccaggaggcctctacacagagagcctgggcctgaggccgacagtgaggggcaggaggccagtggctgaggcagggcctagtgcagaagtcaggggcagacgtgagtattgggctcgccacgtcctgtgactagggagcttctgcaggtctttagaagcggttggtgggataagagcccatgtcggggatgagctgcatgtggggagagctggagtcagggagaaaagtgaacagcctcaccgcgtggtcagctcgtggctgctgagcacagcccggtgtcagagagcaggactgagagtcagcttcatggagggcgcggcgggaacagcgccagcccccagcacccagcaaccatcactcaccactcacagggcccctggcattcacaccctggcctaggtttgggaaccttccagccagaaccggtgccgctggcttgggtggagcctggcgtgggatggggtggagcctggcgtggggggggtggagcctggcgtggggggggtggagcctggcgtgggatggggtggagcctggcgtgggggggtggagcctggcgtggggggtggagcctggcgtgggattgggtggagcctggcgtgggatggggtggagcctggcgtgggatggggtggagcctggcgtgggatggggtggagcctggcgtggggggtggagcctggcgtggggaggtggagcctggcgtggggcggtggtttcaggtgaagaggactcaggcagggacgctggtttacacaaggtcattgttacctggacaactccctgagaatgatgagaaaatatgagccagaataaagaaggctgctgggttcccggctgtctccatggctaatgaaatgccattttccttcttggtgcttggctgtgcaagtgcaccctgtcaggcagattctccatctcacgggccccctgcgagtcaggaagagatgctcgcggcgctgggtgagccggctcctcctcagggattccagggaggctgcagggcttactgtgccgcagtttcagcaacagccccagaacatccgtgtgtccaggcaccaggacactagcgctgttggctcacacagccagacccacagcttttgagctgatgaactgcattacgtccagacaatttccacttaacagttgtccgtaacgctcctccctgggccagcagccacatgagaacaactcagcacagggattccagggactgggtcggcagcacggtctcaagcccacactcacaagctcacgtgtgcacacacacacgctactcctccggggcatgcaggcagcgtccctgagaatccctgcctcagactcactcccagggctggtggacacatgtgggcgggggcgggggaggccacagccctgaaagtcatgggttcaggtttcagctgtgtcagaagcacctggaagctggggtgggatgtgatcagcaccctcttcgtctctgtgactcggggttttgggggagaccccgcactctgcattcccctcctcatctctatgactcggggtttaggggggaacccagtactctgcattcccctcctcatctctatgactcggggtttaggggggaccctgcactgcattctcctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttggggggaacctggtactctgcattccctcctcatctctgtgactcggggtttagggggaacccggtactctgcattcccctcctcatctctgtgactcggggtttaggggggaccctgcactctgcattctcctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttggggggaccctgtactctgcattcccctcctcgtctctgtgactcggggtttgggggggaccccgcactctgcattcccctcttcgtctctatgactcggggtttaggggggaacccagtactctgcattcccctcctcatctctgtgactcggggtttaggggggaccctgcactgcattctcctcctcgtctctgtgactcggggtttgggggggaccctgcactctgcattcccctcctcgtctctgtgactcggggtttgagggggaccctgcactctgcattcccctcctcgtctctgtgactcggggtttgggggggaccctgcactctgcattcccctcctcatctctgtgactcggggtttatgggggacgctgcactctgcattcccctccttgtctctgtgactcggggtttagaggggaccctgcactctgcattcccctcctcatctctatgatttggggtttgggggggaaccccacactctgcattcccctccttgtctctatgactcaggggttctgggcggtaccctgcactctgcattcccctcctcatctttatgactcaggggtttggggggaccccacattctacaaattctaacaacctccaggtggcacctggcgtaagggctgcatttggagaactgctgctttgcaaagcccttgaagaatgggctgatatgatagggaactggtgttatattaactcaaagccttcacatcatagcttgtgcctttccgaagtattgctaattaattaacttggaaacgcccaagggtcattttagatcaaaccttattttatgaaatagatgtaggttatgagccaataaaattttgatacattgaagtcattaaatcatttggtacactgagttattttttaaaataaagtaaactgaattactacaaaaaaaaatggaatcactccctgttaaattaactgaatgaaagggaaaagctccttttaaaacaggaaagaaactattgtttttactattttatcaatgactggagtcaaatttgtgtgtgtgttggtgtgttgaatatattgattggtttagttgaagttgagtttcatctgtcctggaatagcaggagtttgagcagtttcacccgtcccggaatagcaggagtttgagcagtttcacctgtcctggaatagcaggagtttgagcagtttcacctgtcctggaatagcatcaccgactatggaaggcttctccatgtctcgtccacacacattattgtctaaatggttctggtgacaccactgtctgcagttcctctgaatttgtataaggaccaagaaatgtgtgggttcttgcaaactctgaggtcactcttagggtaaaaggctgtttatccactcaactttggtatatgaggagcctttctgcaagttactgatctaactgtgtgagtgcctgacaacacagccagagtgcgcagggcatcaccagtgcccgtgtgggaggcggggctccgtgggaactggctacttaccccccacctgtccccagagcccgtgtgggaggcggggtttggtgggaactggctacttatccctcccctgtccccagtgcccgtgtgggaggtggggcttggtgggaactggctgatcatgtcacttctttaagcctgggtttcctcaggcttaaagggaggagcgtctgcctactttccaaggctgtgggcagatgtgatgctaatacaatcacgtagtatcttttatttatttatttttttgagatggagtcttgctctgttgctcaggctggagtgcagtggcatgatctcggctcacttgcaacctccgcccagccaggttcaagtgattctcctgcctcagtctcccaagtagctgggactacaggcacgtgccaccatgcccagctaatttttatagttttagtagagacggggttttgccatgttggccaggctggtctcgaagtcctgacctcaagtgactccccacctcggcctcccaaagtgctgggatgacaggtgtgagccaccgtgcccggccaatcacagggtatctatggctgtatcttatggctgctcagtcctagaagtttcttttccaactccgacaaatagctggagtaatttagtttggctttgaaacacttgactgaatttctaagatatttggagaatgttcttccctgtaagttgacataaaaagagacagtggtttaagaactttcttactcagatgcagagatactgaattaccctctggtgtgcagcctgcctatgaagtttgcatctcagcctgcataaaatgaataccctgatcaacaagttcctgttttgcagagaaacctcagtgatgtaataatatggtcatgatttccatcagtactgaatttttaccaagtcatcaaaatgtgatggtcactgaaacttaatgaaatgaggattacatttcaaagactaaggagtcctcagtgattatctttatgaggcttttgggggatccttgtattgctgaggaaatagactctattagttatctgatgctatacaacacactaccccgaactcaccagcttcgttcctgttgtcacagatcccccagctgcccagtcgggggctctggctctgggactcacatgagggtatggttggcttgctggcctgggctgcgattgagcaggaagctgagggacctcttacgcctgtgcatcacgcactgtattctatgcaacggatgcgagtcataaagtccagcccatacctccaaggaccggcattcagcggcaccccctgcagagagcagaatacataagcaggcgttgtcagccaccgggagcaccagaggtagataaaggaaccggaggcagcgtcgctctggagccgggctgcatggctcttctgtgtagtgaccaagtcatctggaccagctgcctcagtttccctatctgcaaaatgtgggctcccatagtgtctgcattagaggactgtcatgtgttaaatgtgatgtgagaacttagaatcatgaccagtgcatagcggacactcagcaacgtgcagttgccagtgtcaccgtcatcaccaccattgctgctgcagccacagcgacgtgaagtgttttctcagatgtggaatgttcttaactttggtggtttttccagagaaaaccatggattaaaggataatattttctaaactgagagttagcatgtctttctattgggaatttcattccctgataacttaagcaatgtcctctcatctccttcaggtattttgaacatttaaaacatttttctttttttttctatccattcagcagacattcattagccatctgctgtggactgggccctgtagtaggttctggttgtacacagaaagagaaacaatccctcctgccagggccgcgggggcgatgggagatggcaggtaggcaaggccaagcaggtgcagtaggcctgggggagggcggcccttggtgtatgcagctctggatcctggccttgccagtgctctgcagagtcaactccagagagccacccccctctgggccttccgctgggcaggtgtcgtagacaagaacatccagccttgtgagtcgccaggaaggcccaggggatgtctttctcccatcatggcgctatgcttcctggggtctcgtctgtcagccccacgagcagtgaggttggccccaaaaccaggaccgacttcaccacgaatgcaacctcactgtgacagaaaatcaggggaaaaggcttcccttgaggaagggaacagaaagtgtgcagtcccagagggaagtgggggagctgaggactcttgttcagaaagaatcatcactggggacccctgagctggatcagctgctcacctctgagcaaagtctagttctggcttctgctttcatgagtgtttgtgactttgaagggtttgttaaagatgccagcattaagaccttttcattattttcacaaatgctgtagctttaggtgtgaatgaatggacttgccttgccagaaactgtcttgagctcaaaagctttcaaaagagtaaaagactcagagcattgctaaacaatttcccgaatggtccctggctttgcttaggaaggacgtgaagccatagtatcttgctgtgtcttgtctaggaggaagtgtttggctcttgaaaagaaaggccaaaagacatgcggtcagcataagacgtctttgcaaagccactcctgacggcggagatggcggcagcaccacacgggagctgtttgagaagcagatcaggcagagtttcaccgacgtctgagagctagtttcacagccctgtgccagaggagccgtgtcttccacaaaacacacctgagagctggtttcagactttccgggaaactgccctggcccaaggcatctgtaaacctcttttatcctaattagtggtaacaattcaggtccacctgacctgtcattggcctttttagaaaactccttggtatttagtctgtagatgtgcatgcgacgtacagggagttcaggatctgttgtgggcctagttaccaaaggtgcctgagcctgctgcctgcggcggtgagtcctgccggcccacagacacatcgggaagctgacctccttccctcctcctcagccacgactcttgtcccagctgccaccagtcttgtcagggtgatcccccttcctgctcccccagcagcagcaacagggagctcttaggtgtcactagatcttcaagtgtccctgctgcagcctctcgagatggtaccagatcctacctctcacttcctcccgcccccacctcccctgctcacaggtactggacagagcagcattctctctgctccctgaacatgctcaattcatcccacctggggccttgtacactactccatgaacacactcacgtcatcccacctggggccttctcacgtcatcccacctggggccttgtacactactccatgaacacactcacgtcatcccacctggggccttgcacgctctgggccctccacctgccaggcacaatcccacatttgcccaggtggctcttggcattcaggcatcagcttgagtatcccctcaggagacctttcctggctcccagatctctgataaacccctcccacccctgtcactccagagcacattaacccctcccacttgacgcagagctcagagccctgatcagaaatcaccttgttcattgaatttggatcagtgccaccacagatggtgagttccatgcaagcttcatggggcacagccaccctacctgtgggtcacaccagggagtccccggtgctggaacggcacctgtacgcaataggctctctacaggtgtgcttaatgaatatgcatttcgttaatcagttaactaattattagattcatggactattagctgtggttcctacccttgcatctgttttattttccatacctactcatagtttttcatggaaactactgtgtttatggcttttcataattacatatacctctgaaatttgacgaaatctataacgattcctggcatgacagctatctttgttaataaacttcgatttgattcaacttctcttccactatgcctggctttgacgatttgggagcttaagcagaagtgtttatatcctctgtgacttagtaaaatgctaccacacctctatacccccacagtttaatatcaacaagacaacatgggcttaggtacatttaaaaacaaaatattacttagttttgtgatgaattacagtttgaagagtgtaccttagttatctgctctaggattatttaccccaatctgcggcacaagtccacggctacgtgcaagcatggtcggcagacgctggaggcagggagagggatggaccagtttgcgatcttggaggccccagggtctggtagggcagccgcacaggcacatgcgtgactatcccaggaggcagcacgggaggcctcatggtggaggctccagtaaggtgctgggcagagtgggcgagaacctgggaactctgtagaatgaaggggtaattggtggggggggcttgcatctggattttaacccatggaactgaggaagaagcctcataactgaacaataaagagaacagaggccacagaggagagtgccagccggtgccaggagcaggagaatgcccaacacaggaacagccagaggagccgctgggtctcaactctgctggaactcggctgccaggctgagcaactcatcagcgcctcctgggaatcgccgagcacctcacatcagagaagaaagatcagagcttgattctgggaagattcgtttgctgataacgcgatgggaaccagccctaagctgccatggccctggctgaggcccctttcccggcgtttcaccaggacatctgagctggggtggcttttgcttccagctcaccttgtgctacaaggacttggatggtgagcactcaggtgagggagggccctgtgctgggctgctgcccagctctgctctgccatcctcgacagaagttccctctctccacatcgcatggggtacaacaccccacctcggccacactgctttgtccaaagcctatctctagtttgtggctgtccttggaccaggctcagagcagctggacctccaccctgggaactcctgcagacaggcattgtggttgggaccctctgcatccccagtgcccagggcacacagtaggtacctggtggttatttaaaggacatgcaatggaaaaaaaaaaaggtaaattcacatggaaaagacagtgaggttttagactcctttgaacatgaataccagacacggagggcaggcaggggctggtggggctgatttatgccaagcctggcaccaagggctggcctcatccttgaatctgacacccatgtgacatctatgacactcactgaaaagcacagttcgggtctagggagctcgcccaagtttgtgtagaatgaagcacgtctcctcgtggggccgtgggaatatgaatagctgacagctgaggaatgatttgcctgcattcagggactcctaggtgcctgacccaggagagcaagaggacacaatggtgacctgagccgacatcacagggacgaggagattggggtgtctggagatggagaggctctcagacatgaggagacaggggctggcatccagtccttatccgaaagtacaggattgaaacttgaaggaaatctgggttagagaaacggatacagggtgcagatgctcggatccagtggttggaatcatggggtggacaagagagtggacagcagtgttggcaggaactggagggccccagcgtggacagcagtgttggcaggaactggggggccccagaaaggcctaggggaagccaagatcgaggtcccaggaggaggagaatgtgctgggcctgggctgcaccctgctgatggaggcagggtccgggccaggcctttagtgtgagttcttatccagaaacaccctctgctctccccagcccctcactagccctgcccagaggtcacaggcgtcaggaggcatttctgactagggcttgttccataccctggtcctctgctcactcccagacatgtgcgccatgatggtgaacatgcctgaggggctggggatggacgtgggcacctcttctcagtgcccgcccgcacagctcttcacccacagacactgcgcccacttctgccctgtgtctacacttgccagaccccccaccgccctggaaatttgcaaatccaccatgcccagcaacacctccccagcacctgacccgctacctgtgtcttcccatggagccctgcccaccccagcccctgccctctgtgtcttaccacagagccctgcccgcccctgcccaggctcccactgccatcacccgctgaggtctgaggtcccacccacccctgccggctgagaccagagatgtccacgacaaggcacggacgagcccccagtcacatcgtcccatggcaggaccgacggttcccactgccagtgaacactgttcttgaggcttcactctgtctctgtcttctcgaagtggacccactaactccacagtagggcagccccatgctcccaaggtgccacagggaatcaagggcaggtggaagggccctgtttgaaattaaaggggatttccccgtgagctggggaggagccccgtggaagaccttgtgggcagggtggcccggctggagtggcaccattgacaccgtgctggagatgagaaaatgctagtgggaggcaaacagacttgactgcagggtcactctgcacatcaaccagggtgctgtccattctttccacaatgatcatcgccggatccgcagggccggcgctcatgacctgtgcagcgtcaacaccgccaacccaccgtccagcagtgcaagtcaggcagctcagcctgtgctccatgttacggccacacctgctaccccgccaacgtcaacagcagtggtcagagagatctaatataaatgtatcatttggcattcactctggaaggaagctcaccaatggcttgtaacaccactgacaatgaatggagaaatgtgtttccagtccccccaacagaaggaggacagcgcgagaggccacttttcataccctgtggttccagtccaccctaacggaagaaagacagcgctagagactgctttccatgccgcgtggtcttctaaaagcatgctatttattttatctttgttgctatgctttcatctttttaaattttacattgccattacaaaaaatagtacagattttaaaaatcttacaacagtgctttacatcttatatcttggccattacctgaaaattagggctttgattcaaggagagccatctaatccagtgaggccatcctctgctgtgcagaaggatattctttacagggtaagccccacccggctgtggctgtgtctcatgtagacagcttgtttggctctatgcacatctttctctaagacctctgattatttagcaaaattatttaaatggtgtatataaatattggaaattcatttccctcccatcaggaaaatgacataagaagtctgtggatgtctggaacttttaaatattgaagagcctaccccctgttatttccccccaccctttccccattcctccccacagcatgctatttgttattttacatctgcaggttttatgtggttctatttggcctttaaatcctgtgtctgtcctatcagcccatgaactaaaggcaggccaagtagggctgtcttccccaaaactgccagcaaagctgcttcatccctcgaaggcccctgcacaacctcctcccacccactgctgctccagggcatctcatggggcctctcctgcaggccagtgaggccgctgcagcccagagtgcaggcttatgtcacccctggcttcagtggggccctgctatcacagtgtggaattcctgaggtctctgaagcctgttcttgtggtgtggagttcctgcagtctctgaagtcctgttctcgtggtgtgaattcctacggtctctgaagcctgctctcgtggtgtggagttcctgtggtctctgaagccctgttctcatggtgtggagttactctggtctctgaagccctgttctcgtggtgtggagtttctgcggtctctgaagccctgttctcatggtgtggagttcccatggtctctgaagccctgctctcgtggtgtggagtgcccatggtctctgaagccctgctctcgtggtgtggagtgcccgtggtctctgaagccctgctctcgtggtgtggagtgcccgtggtctctgaagccctgctctcgtggtgtggagttcccgtggtctctgaagccctgctctcgtggtgtggagttcccgtggtctctgaagccctgctctcgtggtgtggagttcccgtggtctctgaagccctgctctcgtggtgtggagttcccgtggtctctgaagccctgctctcgtggtgtggagttcctgtggtctctcccacagggcctggacccccttctcttgggtgacataggcattctctcgtcctgagctgctgtcagtcagcaggttaatgcccatgtgctctggtttcatcctttaagacccgaggtcccatttgcctcattccaggtgcctctgcatgtgtctgtcatccttagaatgatgtgcatttgaaccagtggagaaaaaacacagaatgactgacgtgagttttgacacgattttcgttaggaccttggcatgctgggtgccagagaacctgttctagtgaacgccttttacacttccaagctgtgcaatcttgtgatatgctccattttcttctgccttgatagccaaatgccaatcattggggagaaaaattctgctgctgaatgaggcagcgcacgatttgccctctggaaattgaacatttaccttaagtggtaaaaggtgttttccataccttgatataagtttgcataggactctctgctttcatagttctcacttgggtatgcagaactgacatctttgtgaattattctcttttctttcactggagtgtttaatatgcattttaaaattgcttctgtacatatgcagtggataaattaaggtacagaagaaggtttctcagtctacaccatccctagggagttctttttgcttcacttcaagtagtagctattgtcgcctctggcagtgaagtctctgttactttaccaatgctctcattactgcattctaaaacggtgggttttttttctttctttctttcccacttttttttttattggcttgggatttgtgtcttaatcaaagtgtgcaagaaatgcacttaatcgtaaaacagggtggcagttttacaagatgcttcagttaattagcacggaattgctggggaacgttccaggggggttcctggtctccattacatcaaatgagtttgctgtgattaatgttatcataggaaataccaaagaaattaataacgattaagccattacttccaagtggcgctcattacagcaagagctttaagaaaccccaccaacttcaatttctctgtcctgaggtgtgtctatgctgcactggggtggaatatccccagactcacctggatattctgaattttctgattcatttttcttccagaaatcttcaaatacggattcgtgatggataagaaaaaaataaccttttttattgaaggtctgatgcttcaaaaatgcatttattcattccaaaaaatattcagtacaagtacaaatatttagtatgtacaaagctctgagttggatactcaggggtaagaacaaagatgaacagaatccagctcttttcttgaagaactcatggagaaaacacccacataagcaagatgaattacaagggtgtgttattaaatctgtgatagaggcacaggcagaggaagaggtggtgaactttctctaggattatttcagctgactttactgggtaaatgggatttcagctgcttccaaaaatggtgcagatttgccaggcagatggaagtcatgtgatggagtggtgcctcgtgcgtgcagggacaagccagctttggtcactgggcagagagggggaccagggagtgtcaggggcactgtgagctctgaagaatgagcttagaattagggtaggaaacacgagaatgagccccagagagggcatgctgggcacagaagccactccactggctgcacagctacccctgctgggctgtccatgtgtgttgtgctgggcacaggtcccaccaaggctcaccaggatctaggtcttgccctggggtgggcaacctgtgggggggggggtccgctctgagcgtgacaatgaagcacactgctgccagttacagtgagaggaggaaacatgcccctgccatctgcgcagctgcatctggccacccacccgcaccaatggtgaggacgccatcagcgtggctctggcacagcttcactccctgctctgctctattttcatgacttcagacccttgtgctggaatagagactttccccttctttcttcccctgggattgtcacctccctgctagttgggatgctgtctctgtcccccggttctgctgagcagagcacctgggacagtgtgtgggtctaatgagcattgcttccacgatgctttctatttgcctgcagatgaccttgggtacttgtgtgctggtgtttctcaatgtgtgtcctgagctcttggggagttcatagggcaaaggtggcaagtatattgtgcagttatccctaaattattatttccaacagtgtggccccagtgtctaatacaaaactgagctggtagagccctggccctgtgggaaacaaatgtcttttacctttccctgtgtgttcctggaactgagcctctgcaactcccttgccagggccaccaatttccccaggccagcccagtgatgtttttcctggactcatcctctcacctgcattttcttggtggctgtgttaagtccctgcaccttcagggatcccgttggcctcaggagtctggcagtgtttgtttttgctactcacttatttcttggggaatttcccccaagaccctccgttcatttcttcctctcctctctcccttaggagatcaggagagtcaacatccaggtctgtgactccagcctttctcctgtgcaagctccaggcctgttcaggagcttttctgcttgggcctttctccaccatgcacagcccaatctgtctaagccaaactcccaggtgcccaaggtttctgctcccaccaggactcaactccagcttcaggctcagccacccccattcagaccctgtccacagcttccttccaagcatctcgcctcctccacaactcccaactccatggctacccctggcccccacctcaggaggttctgatgaaacccaggcagcacccagcctgccaccacctcccagctccccactcatgcccttctcatgatgatttcacttgagaaatcagaggtgggcaagtggccactgacaagtgcaggatgtgtgcaaagaggaaatactggcagccaggcacagtggctcatgcctgtaatcccagcacattgggaggctgaggtgggtggatcacttgagcttaggagtttgagaccagcctgggcaacatggtgagatcccgtctctacaaagaatacagaaataagctgggcatggtggtatgcacctgtggtcccagctacctgggaggttgaggcaggcagatcgctttagcctgggaagtggtggctgcagtgagctatggttgtaccattgcactccagcctgagtgacagagcaagatgaaaaaaaaaaggaaacattgatgccatggatattgcaagatgttaacccttcatgtgcagcatctgacatgtgcagtacagactctcataatttatcctggattaaaaatttcaacgagtatacatttcaaaaggaaattcctttgtggctacctggacaaggaggtctcttgctgtttcttcggcaccttccactgagccgacagaggtcacttccatcgcccatgggaaatgtgcctactgctcgttttaactcatgcatggatataaaattagttcccatatatcccatctaccaggatcaacgggatttttttctctcactcttttttttcagcatcttcttcactctacacacagcaataaaataagtaaaatgatagcaggaatttacttggaaaaaacaaaacacaaacccttctaggctgtatgatgggtcaggagacacccaggctggattcttcatctgcaaggatgaccctggagatgtgccaaatagagaagtcagtgtttcaggtctgaggagcccagccccagccggcacctgctgagtggtcgcagacacgcggctccagcgttcaagccttgttagatcccctggaaaaacagaaggaggctggttcacatccattcacacaaccccgagacccagaaactcttgaaaaccaaaagttttcacaactcactttgcagcaaatcatgccctgaacagattgatggaaggctctgtgccctcctcacttactgcagatgatgccagtcagcacaggcatcacaggtgctgcccaaggccacagaggctgaaatgcagtgagtggaatggacaccattctgaaagctctgcattcctaggaaaggtaacctcaaggtttggagagaaggcctggtcctgtatccccacttctcacagttaccgcttgttacatggtgtcagatgttcaaggctgccttgtaaaccataaaacaccatgtgaatttttttaatattgagtcaggtgccacccccacaaatgatcctggagtagtgggtcctcccctgccctccgctgtagtaatttactagtgctaggtggtactgggtaaacatccagctcccagaaagccaagtctataaagggaagatactgaagaatgaagccagtgtccaaaggtatgttactaacaaatgatccaactaatattgtatttacactggtcacactggtgttcatcacaaaaagagaaccgtgcatgagatgagctcattggacctccatggacttgtgtcccatagctttgtggctgcccagaccccttctccctggattcagcctttatttttcctgatcattcatcccaaggtaaatacatcttcactcacagagggtcagccagatacttttcaatgtccaccctcctgtttgttgagtttttctctttttaggtatgactgactctcagtaaactgcacatacataacttgtgcgagttgatgacttgtggaatgggtcagcatcgttctccttttccccatgtcatggagtatttgtctgcctctgagtgaggacggggacacacagccctctcagcccacagtcagatttcacccactcctccattgctttacggtccaacaaacagaagaaactcatggcatttacaactcccagccacgtaaatgagatagaacctgccacacagagtctctacctgcaccttccatcccatttaccgtcatccgcattcagaaaggagtgcagctcagccgacaccttgacttcagcccagtgagacccgggctggacttctaacctgcagaacaataagtttgtctgtttgttctgaagagatagggtctcactctgtcgcccaggctggagtgcagtggcacaatcacagtgcactgcagcctcgacctcctaggcttaaggggtcctcccaagtagctgggactgtaagtgtgagccaccacatctggctaatttttaaaaaaaatttaatagagataggatctcaatatgttgcccaggtggttctcaaactcctggtctcaagcaatcctcctgtctcagcctcacaaagtgttgggattatgggcatgagccactgcacccagccagcctgtgggttttttaagccactaagtttgtggtgatttgttacaacagcagccaaagaaaacaaatatactttcaaacacagaactttttagaatgcaatcctttttaaaaatgttgatgagagtggtgatgaagatgatggtgatgatgatggtgatgacagtgatggtgctgatgatagtgaccattgtgatgatggtgataatggtgatggtgataatgaagatgatggtggtgatgaagatgatggtgatgatagtgatcattgtgatggtgataatggtaatggtgataatgaagacgatggtggtgatgaagatgatggtggtgatgaagatgatggggattgtgatgataaagatgatgatggtgatgaagatgttgatggtgataatgaagataatggtgatcataaagatgatgatggtgatggtgatagtagtgatggtaatgatgaagatgatggtgatgatgatagtgataattgtgatggtgataatgaagatgatggtggtgatgaagatgatggtgatgatggtgataatggggattgtgatgataaagatgatgatggtgatgaagatgttgatggtgataataaagataaaggtgatgataaagatggcgatgatggtgatagtgatgaagatgatggtaatgatggtgatgaagatgttgataatgaaaatgatggtggtggtgaagatgatggtggtaatgaagatgatggtggtgatggtgatgacatgaaggagaaagaggagtctcaggaaacaaaacaggaagccttttctttcacaggaaggcagttaaaccaggacagcagtgttgcttcataaataataaaacaccagcctagaacatgttttcaaagcaatttccaaagagtttataggccaccgagataacttttcttagtgagaagaagttcgatgtggctgagtactcctgttggaattagactttacagggataaaactgcagttctcctggcacctgcctgtgaatcaagctttctgtgtctctgtgtctgtgaaactgggattccagtgccccatgcatgctttgggaagctgattccacggtgctggtcaaagtgctgggcacagaggcgttcagtggctctcgagggcttcctggatttcccacacttatttggaggcattttgggaagtgcacttttgggttaagtttttggtaatgagggggctcttatttttgaagcagcacaattcttcagaaagtcgtaaaataagactctgaaatgctatctgagcatctaaatgttgagttgggtgtggggcagagagtgagcagtgatttaggagaggggaaagagaagaaagaagatgataagaaaagaacaccttgatctgagagctggaacctgctggggctctgaccctcctgaggtcccagttctcatggcactgggccaggcctgaggggtgactggggagagccaccctgtggtgatgtttgagtgggacccaaatgggtgtgtagggttggaaacctagaaatttttattagtgctgactttgatttgaaccttgcttcaccccctcagctgtgtaagctgggaatgccaaatggtgttgggaaggctcagtctctcgatggtgagatgcttgcggtgctgtcgtctgtccagtccaagccaggaaccctggtgaggggcaccgtctctttatgtgctatcaggaaagggctatgctccagctaaactctcttgccagtgttcataagaggcatcttgacttcagaggggttacactgtgaaaaagggttcgtcttgaaattgatgaaatatggtaatcttcatacatatggagtcaaaaactaagtatttagcacaaagtgggtactcaaagagtgctagctccctttccaactctctcccacaaatctacctccatatcctgttttcaggtccctgtctggagatccctttcttggtgttctggaatttcctattgaatgaaagcatgtcacctactgatgaaggggccggtgtccctgtttgcctgggacagccctgccttgtgcctcagatccctgtgttccgctacggcactgacactcactcccaaaggtctctgttgaacataaattataccatggcccaactgacagagtgcagggcactcacaaaccaaagccctggcgagtctgtgcggtggagaaattggggcaagaggaggatcgtcgaaagaacaggccatggggatcagccagggttgagtggggtggggtttcacaccaaccttcaagtgggaagcttgaggaagggaatcagagcacccagtgccaagctctgaggtgagtcggtcaagtccatgatgctgcctcaggttggccctggtggtcacagctccacacgccaagtaaggccatcacagggtgttaatggcgtgagacagactcaagggccctgctgcacctgctcctgtgttgtggcctgcacggggttgtggatgaactgttttgaccaaattagattggcaaacatttaacctcaaatggatgaattcccctcattcccaaatcaccctcaagtttaactgtcttgactcattcaggtgatttttttttttttggtagcacaaaactggaatgttagggtcaaatgtcatcctaatatgctaataaccatccagcccagcagttgccaacatcttgctgatgaattagcctggggggtggggtccagcttccacatctctacatcgcccccagtgatcctctgtgcgtgtggggcggaccccagtctggcctagtgtttctgtagacgtgggtgtgtggagcatctgggagctccagcccaggtcggtgggaccaggaccagaactcaacactaccccacccagctgtccccatggtgtgccagtgggaacgggggtcccacacagagggaggtcactgcgaggtggtcgtgccctcaacagcctcttacagatgaagactaagatctattgggaataatctttattaaaaaaaatactgcttgaacttgaacagggcaaataacatgtaattaggacttaatgactgggtgcagtggctcatacctataaatcccagcactttgggaggccaaggccaggagtttgagaccagcctgagcaacatagggagaactcgtctgtccaaaaataaaacaaaacaaaaggatttaatgatagaaattaagtttgagaaatgtagcaaccccggccattggactggaaagatgaacgagttagccctgttctggcatctcccgggtggactagcaccgaggtgctgtgacaggaagccaaggggacctcactgagaagcggcatcgtctgccctggggatggggtgagggcatgaccacagatctcccccctgcagacttctctcccaggcccgaactgtggcctgtttccactcaaggctgcctggccattatggaaattctttatgtgtggaacacattctcagagaacgtgtgaagtaattacatccaagctgatgggctggttagcaactgaactgatgtgtgtaacacgtatctatgtgattacttttaagaactgggtcttaacctcagacatggtgcttaacaagaaataataaaaccaaaccaattcttagttattttagtcctgggactcagggctgctttcaataaattgtagattgctccaaaaccttgtttctgccattagttccagtattgtccaccttattttttccaggcaacaaagttgtcagttttctgcttctggtcttaaacacccccagcccgctattctacagcgtgcacacaggaaggaaaggatgccgcagaagggagggactgtctctgactgcaggtccacctgaggccaggagactgcccggctcagcctgcaggcttgcatctgacttgcaccgtggctgtcaaagctgagagtgtgcatctgctgagcacgtctgtgctgggcgctgcgctggctgagtgtctgccgtgtggacttgcttctctgcatgctgccttgcgaggtggcctcatcaccccatttaaagacaggaaaaccccgttcatagataggacagtatcaatgacctgccagcatcccatggctaagggcatgttcctcaccatttcagggctcaaagactaccttgctcaaggttatccaaatagtggggaatggaaccaagaatgccacagtctgtgggttgatatgaccctctagtccatgccatatatggtcctcatttgtaaattccttctggggtgaggctgagattattcctgactggttcactttgaacctccccatgtctgtaataggaacaggtgtcacgaacccttcctatgcttgtcactgaaaacccttcccaccggactcttccagcttgtccacaggtgttcctcaagtacctgccatgtgcaggctgcacctgaccccgggtgtgtaggtaccaataaaaggcctggggtctgacttcaggaagctgtagtcttaacattgatgaaaataatctgtgtattaaatagtgtaaaaactaagcacccttggtctgctgtcctggatcagggtgtcctctaataatgagagacctgctggtgaccgagtttgacaattctattcctctgtgtatctgaacatatgcattaaagtcaacaccaaggaacaggaaacgggaaggggaataacgctcccgctgggggaataacgctcccgctggtggaataacactcctgctgaagtgtggccattcacattcggatctcatcctgctggcagcagcgtgttttcatcgaccaggaaacacacaaatatttgtagtcgtttatgctaatacgcaaacattttaaaagcactttgcttctccttaaatttcaaagaaaaatagaagactctggatttttcaaattagaaaatgacccactttcttcttcactgaaactgtttcataaaatactttcacatcctgtgtttcccgccagagtagggactgcgccgcttgtgtgcacccgccgggcactgaggcctcttcagcaggagggaaagtgagagggtgggacacagagtggctcttccagagcctcccacacaccccgggtccaggtgtggccgccgggtctccacacaccccgggtcccggtgcggccgccgccgggtctcctgggctcactgtgactcaggaagcctctttcccactggaactcatcctccataaacctgacagaggctcatgttcgggctcccataagtagacacatgtgtttagtgccttagaatatgagtgccgaatttactaagtgccttcgagtgtgagtgctgaaaggcagtcacctgaaaatttcattttacaaatcaggaaactgaagaatagagaaactaaataacaaagccaagattacaccgttattaaatggatgctttaatgctgagacaggtctcttgggcactagaccactttcctgccctctttttaaaattgttgttgttttaatcgactttttataatttttttttttttgagacagagtctgtctctgtcatccaggctggagtgcagtggcacaatctcaactcactgcaacctccacctcccgggttcaagcaattctcctgcctcagccttccatgtagctgggattacaggtgtgtaccaccatgcccagctaatttttttgattttcagtagagatgggtcttcaccctgttggccaggctggtctcgaactcctggcctcaagtgatccacctgccacagcctcccgacgtgctgggattacaggcatgagctaccacgcctgaccttataataattcttaatatctatattgtgtgccattgtgaaatttttggaaaaaatcaaaagaggaaagaaaaatatttcttcataatctctctaataaactataactactgtgaatattttggcatatttccttcaagagtgttacagatacatattttaatataattgagaatttcacttccatggttttggtttttgcttgttttttgttttgttttggttttgttttgtttttgtttttgagacggagtctcgctctgtcacccaggctggagtgcagtggcatgttcttggctcactgcaacctccctgtcctgtgttcaagtgattctcctgcctcagcctccagagtagctgggattacaggcgcccatcaccatgcctggctgatttttgtatttttagtagagacggggttttgctgtgttggccaggctggtctcgaacttctgacctcaggtgatccacccgcctcagcctcccagagtgctgggattacaggcgtaagccaccatgcctgaccatgtttttttgtttttgtttttgtttttcatttatcattgtatcataaaaatatcttggtcttttcaacatttgtaatatcattttaacggatgaataatttttcatccatgaaaatatatttacttagctatttccctattcttagagcttttatttctatatctaatgtttactgcacattttttaaatggaaagaattaaagatgtatttttaaaattgaaattagatggttaaaatgtatctatattttatctgttcttgacatgtgccacccaactcctttttcagaaaggttttattgatttacagtttaaaacagcacctgattatgattcttcccatgcttcttttgcaatgatgtttttgttatggtaaaatatacataaagtaaaatttaccattttaactattttcacctgtacaattcagtggcattaagtacattcacagtgtcatgcaaccatctccaccatccatctccaaaacttgttcattttctcaaactgaaactctgtattcactaaacaagaactcctcaacccctcccccggcccctggtacccaccgttccactttctgtctttatggatctgatgaccctagggacctcagagaagtgggatcataatatttgtcctcttatatatacaactcatttcccttaacataatatcctcaaggtttacccgtgttgtagcttggatgaatgtccttcacttttagggctgaataataccccgccgtgtatagaccacatgttttttatctgttcttcccctgatgggcactcagcttgcttccaccttctggctgttgggaatagtgctgctatacatgtcagtgtagaaatatccattcaagttcctgcttttgcattacttgagtgtttacctcacgtggaattgtggggtcaaatggtaattctatgtttaattttttgaggaattctcaagctatttcccagtgtggctgaaccattttacattcccactaggagtacacacgagtttcagtctctttacaccctcatgagcccttgttttctggttttctgaggatggccgtcctgaggagtgtgaagtggcatctcatggctcctgtttgcttttgcctaatggctggtgatgttgaacagctcaccatgggctcactctccatctgcacgtcgtctttggagaaatgtctattccaatccttgcttctttgttgttgggtgtaggagtcttacatatgttctagatactcctaatcagatatgtaattttcaaacgttttctctcattctttgggttactttttaactgtttagataatgttttttaatacacagaaggttttaattttgataaagtgcaataaagtgcaatttgtttatttttctttgttgcctgtgcctttagtgtcatactgagaaatcagtgccaaatccagtgtcatgaagcttccccctaagtcttcctagagctttatagtttcatcttgtaaattcagatatttgatcagttttaagttttgtatatgatgtaagttacaggtccagctttattcttttgcaagttgtctgagaaccatttgttgaaaagcctattcttttcctcattgaatggtcttggcacaattgtcaaaaagcatttgtacacaaaagggtttacttctgggctccgttttatagtccattggtctatatgtctgcctttctgccaggaccatgctgttttgattactatagctttgttgtaagtttaaatcagcaagtcttccagttttctttaagactgctttggttgtttgggttcccatgagattccatataaatttttggatgggttgttctatctctgaaaaaatatcaatatttttggtagagattatgttgaatctgtagatcactttgggtagtattaaaagctaacaataatgagccttataatacgtgaagatgggatgtctttccacttatttgtgtcttctttcatttaacaacactttgtagttttcagtgtacatgtccttcacctccttagttaagcctaccctaaatattttattctttcgatgctattgtacatggaattgctttttaaatgtccttttggcattgtttattttagtgtatagaagtacaaatgatttctgtatattgattttataccctgcaactttactaaatttgttaataaattctattaagttctaacagatctcttgtgtaaaatctttatgattttctacctataggatcatatcataagtgaacagaaacaattttatgtcttcttttctcatttaggtgacttttacttatttttcttgcctaattcctgtggctggcacctccaatactgtcttgaataacagtggtgaaagcaggcctcctcatattgttcctagtcttaaaggaaaagccttccatcttttaccctggagtgttacattagctgcagatttttcatatatggcctttattatgttgaggtgattttctgttactcctagttcgttgagcgtttttatcatgaaagagggttgaattttgtcagatgctttttctggatcagttgagatgatgatatgggtcctttccttcattctgttagtggggtgtattgcgtttattattttttatgtgttgaaccattcttgcattctaggaatacatcccacttggtcatggtacagcaatcgttttaatatgcttctgaacttccgaattttgtctactagtattttgtcgaagattttttgcatcagtatttataagggatattggttcttagttttgtttgcttgtagtgtctgtctggctttcgtgtcagagtaatgctggactcacaggattagttagaaattgtttcctcttcaatattttggaaaagtttgaggaggagtggtgctaatccttctttaaatgtttggtaaaatttatccatcaaaccagcgactgcaggattttctttgggaggtttttgactacggtttcagtctccttactcactcctggtggggtcggttttctagttcttcatgactcagtctcagtaggttgcgtatttctaggaattttcccatttcttgtgttatcctgtttgtaggtgtgcaaatgctcatcacactcacttataatccttttcactttgtaccatcaaataataattattaatagtaatatataaataaaaagaatacaataatactatttaaaagtattaatcgatgatttattttgaatcttgtatctgtcgtgtgtaccatcagtgttttccttagggattatttggccataatactctgatcgcattttgattccatggatatgcttctctttaaacatctcatcctcttactgtacccctccttaatttatggaattcacccccccagggattaatacttaagtcctagatgccaaaaatatgtgtctcctaagctcacagttaggatgcgctgttgctgtggagaggggatgggggttggtacagggtgctgcagattctgggaagtgcacatcagatgaatttgtggggacttatagtcaccttgggtgactcttgtcccctgctctagagtaacaatgggctctcaggtgcaagtgctcgagctgtttattaacccttctgaacctctctgagccatggaggtcaaacgtatttccatttcccaagtggccattcgctcatgtggttctgatgttgggtaggacctttccttcccttttccttcttactctctaggtgtccaccattcaaaatagaatgggctcagatgcaggttttcatagtggcatgagccaggcattctagcaaggttgcagatttaaatgaaccctttacttggtggcaattgaaacaacttctttttgtaaattccaaacatgaattagtcacacaaatgaattccaactcacaggctaagaaaccaaaagcagtcaggccttctgtgtaacagtttatcctctgggaaagtgaggttcccaccatgacccctgaaacttgattcctctgtgggcccttgattctggtggccatgcatggattggacattccctagggaggagggcagccctgtcttggcatcactctgtcagtccttcccctggggagcactggcagctctgaaccagctgcttttgttcgctgtgtgcaggctgatgcccacgcaagaaatagcaactggtagacccaaagagggctagggatagccagtcaattgttgagtgcacattgagtcgaacagattcatttgtgtctgaggatttttcagcatttcttcagccagggacccagcctcttctggtagagtcacagactgggactggctcgcagccttgtttagtctaacttaggtaaaaccctctcggtagacacctgtgtccacacaccaaatgaacccagatgtggaccggagcgatcatggctacagcagcagcccagcctccccctccagatgtgctccacgtctcttgctgtctccaacacgtcagggagccaaccctgtgtcttctgctccctcacagccctgggcatgcagataacacactgtgaatgttcttaccttaaaccagccgtccctaggcttttctcatcaaacagccataaacaacagtgtactaaatgccagcacgtaggaagaataaagtctcatccaaacacaagagaaacacatcctagtttcagcagcacacgaatggcctggggcagtgtcccagcagctgacatcctgatgagaaaacgcacctgtcagaatgtgcgggtttctcccttggtctcctgggttccttccaacctctgactctctttagaaatatgcaaaggctacgtattattggaaatcacaccaatttgggggttttctcagatgcactatttgagactctcctgacctccacgtattaagacccagagctgggtgcaaactgttccacacccctgggctaatgaagggatgggaatgcagagcccaggcaaaccccgcagggtgtccgccctagcaccctgtggggctgagctgcggtgccgccttgccctctttgtctttctcttctgagctgtgccctgccacttaaaaccacaatggttgggagttgtctgaagaagagagttgatcctggagagcatttcttcaaatgcttggataaccctcctgctgtgtgctgtctggaagcagacgcaggtgcagaattgaggagttgcttctctcaggggatctgtgatgggcctgcggtgctttcccaggttttgccttcagagaagttgaaatggcttaaaaattactggtaagccctcccctggctgctgatgagacctagaaatatctcccacccagggggatgtgagcccggctcagcattctagataggtctcccagctgcaaggaattccatgcatcacaaacatgatggtaccctcccctgtgttccttggaattgcttttctccaccaaattacctgtgatccagcacaaatatagagtatgtttggcaaaaagaggtagcttaatcagcagtgaagagatgtgcctggatagaaaattcgcagctacaccaagctgctttttagtgtgaggcacaaatccagcattcgtgtgtgctgctcctggtacctgggatggccggtggatccgtctttctggactgcatctccagggggctccttggggacggtgagaggcacactggcccagcaccctccaccccacccgcttcactcccacactacccagaaacaaactaggaagtggcattttgtaaaaacaaaaagattgccagcaatttctaaatttttaaattttaagtctagtatttcggtttattattcttttaatttatcttaaaaaataattttgcaggagtaaatagaaatgatgaccaaaaaacatatgagatacttaaacacctcacctgatttggttctaaagataccagaaagaacttctgtgctttccctcccaggacactcaactgcatgggagaggccaccccgacttccacccctgaaaagggggtttctggggctcggcagggaggcggggcctcgctctggggtctggagctgtactgcaggccttaatatcaccccggctgagaccacttctctcacacaggcaccacaacccacaccacacacacacaccacacacagtacacaggcaccacccacatagacacacatgcagagactacacacaccacacagcacacgtgcaccacacacacaccacacagcacacacagtacacaggcaccacccacatggacacacatacagagactacacacaccacacagcacacgtgcaccacacacaccacagatctaggaatgcttctggaactttcactttttagtcaggaaactggaagtggctctgcctgttgcagcctcagatatgaatctgaacacctgaagctcttggaatggcctttccagagagttctgtggaagagactctaacacacatgcatcttcaagcgtttgtgcattccatggtgagggaaaggagagaatatttaaaccagcgatttctgcttcgaaatgcggatttgcttacatttctccagcaccgctcttatgccctcattcctttctcggtcgccctcaccctcaggagggatcctttggccatgtattccactcttaaccccagcttccaccagctgccccgggtctgagtcctcagacttggccctcctgtcccccaactgctctgatgatgcagctctgaaaaaatgagatgtctgtgaggggtgaggtgtctcctgtccagagagtgtccaagcagggcagtgtcaggatgtcatagaagtctttagggacaccggacctccagccatgtggatccaggttgcagggcagcacagacagcagccggcagcaaaggcacccgtgccagcagcctcatggtgtgaagaaggtgggcaggtggtgacgggcactccgctgtatcctgggaggacactctccatgccacccaggccgttccctctgtgcccggggagtgccgccagcccctgctcctgagttcccactgtgctcggggagtgctgccagcccctgctcccacgtctccatccatctgcctcgtgcactccagagacacaggccctaggaaggaggcttctcacacccggctctcctgtccttcccgaaagctcatcacatattgaacacggagccctccccagagctgctggggactctgtgcaagctgcacacgggtacagtcaacatggtgcatgcacaggacccccagatgtcgctgaggacttctcgagccagagggctcaccccgtgggtccggtggttcctggcactggacggctcaccctgtggtcaggtggttcctggcactggacagctcaccctgtggtcaggtggctcctggaactggatagctcaccctgtgggccaatggaggccgtccccttcactgtgtgcatggctttctcccacctgccgtgctgacgtctcggtgatggacatcttcacgtcctggagagggaagtctctgtgatatgaagtctgctgtacccagggacactgtgaatgtttccacctgaaagcaagcaagtgtgttcagagcattcggtggtctgggtttgagcatcacctttatttcccctggggttcctgtcccctggcaggcaggcctgtgcacacctacccccaagtctgagggaaccaagaggcctgagaaagaggctgacagacccagtttctcagaaggaaacatttactagagatacaggaacagaagccacacctgtgtctccatggcgtgagatgagatgatggctccctcacccctagacccacagctctgcaccacaggggaggggctgctcagggagccagcctatcacctacccacgttccaccacggagtcagcgtctccctccccaccctcgcctgtctccccccgtgtcccccaccccgtctcaggcatgcacactacccacccttgcctgtcccaccctcgcctgtctcccttcgtgtcccccaccctgtctcaggcgtgcacactaccccaggttcctcccacccatccctgcaccgggcactcttccactcttcactcctcctaagttgtcctgcggggttcggccccatcgcccgcgtctggcgaggctagctgcacattctgtggggggctctggggggctcccagggcctggactccctgcccagcccgagaggcttcatggtgcagccttgactcttttcttgggtgagcctggcctccccgcagggtgtgcagaaacagacacagaacaaggagagcaggcacctggagctagactgtgagcttgggaggaagatgggcagcgaacgcagtgcggggcgcaggctggagacgtgagggggcatcagagcagcaggatcagccggcagttgtggcaggtgcagcaggagtgagtgggcgcccaggccagacaggcggggccaatgaagagaggggggcagccagccagtccctgccaaccatggctgactcactggcatccactgccggactcaggccccacctgatcagaggacaaacaaatcagatggagcagggccatggtcagggaagatggtgggaggtggatcctgagacggtgttgcagtccggcaggagggacgcacagcagctaatgtcactggcagtgcctgaggcctgaagactgcggaagcggagggacgttagcccgtgattctgatcacgggaacatcgtttagtaaggcgtttcccttttcacccggtgttgagatgttgatgcagtgcacctgtccactttgctgcagtggaaggggggtcccagagaccgtgatggagccccatgggaccctcctgttgacagactgtgaaggccttagtcccttcctatgagcatcagcagcgcctccggggactgaaggtgccaatagggaagatggaaaggggtgtgtgcaccgggcgctgttcccaggacacagcctgtccagttctctttgctgttcttacacatccccagtcatatgttaattgttgtgagtgtcctttttttttaaccaaataatctttgcaaggagtaaaattcaaattttctgaaggttttgattaaaagagcttttgcagtaaaagtttcagataacagatcatccttctctgaaccgtattagagtggatattcatatgcgtttcatccttgtctctgagagtgaggctggttggtcaggggacggcacctggggcatgggagggtttcctgggttggggtcctgccaggagtacgtgctctcaagagtagggtgtgggcagcaggtaagataaagctgtgttggatgaaatcaaactaaaacaaatgaaggtcaaccagctgggaatattgctagtgaagaactagcaaactcaatggaaaccttctttaatttttattttgttaataatagaggagccactctcttatagggaatggccacccgccatcaccatagctcatctgcccaacacatctgcacctgacttccgcgtctgcacctcactttcctggttcagtacacagtacttcatgcaaagagccgtttgccaacatcacagcttccagcatccgatatggaaagaaggcgctttcactccacgcagaccttgcttgtcttttctgtagaatagttgtagaggataagcctgctccatgggtgaggcggctgcacagcaatggcagattttgttgtcaccaccagaagcagaaatcacaaataacaaaggaatctagagacgtcagagaaatgggaggtcatagagcaaaaataccacccaaataccgacaaaaataacccattacatatctgaacattttagagcaggacaagaccagcagtgagcatttgacccacccaaataccaacaaaaataacccattacatatctgaacattttagagcaggacaggaccagcagtgagcattcgacccacccaaataccaacaaaaataacccattatgcatctgaacattttagagcaggacgggaccagcagtgagcatttgacctggcacaacctccgttcactcagaaacgcctgcgggtttgtatttcccaccaggcgtttgctaggtttggaattttcaaggtgagacaattggaccctttcccttacagagctttatgatctcacaggaagattaacatgcacacagatactgaacacacaagaacagtgtttccattgagatatacacaccatgtggcattaaatgtttaatctgtcataacacaaactttaaagttttattttaaatttttttaccaagatattttttacaagttggtgatgcacaagctaaataaaaagcatctcaacccaagatctcaggactgtgattcaagtacaacctttataactttcctgccaacttcaacttaatgagtcagatagttgcaagctggaggcttaaagaagcctgaattgtttgaggagaccctgaggagcctcggaacttgcccggccccaggaagtgaatcatcagtgcctgggaaacatctggaaatggaaccctgttcggccctctccagtcacagtgcttaatcattcatttattgatttcaaataaatttactgtttgtggagctatagagcaggagacttttatcaagtaggagagtcccgtctagatagtaaacaattaccacttgttcctaagggtcttggaatatgggcctgtattagtccattcgtatactgctatgaagaaatacctgagactgagatggcctgggcaggctgtcctgcagcaagcatggcattgactcagccgccagtgtctgagcccctcaatgatgttcaactccatgcttagtgatgccttcagtaaatatttattattccaggcactgtgctgggtagcacaaagaggaataaactcctgtccatattctcaacaattttataatctagagaggcaaataaatagggaatagatgaatgaaacaaaactaaattgagggagtctttttaaaaaattgagataaaattaacatagcataaaattaaccacttaaaaatgaacaattcagtggcacttggtacattcacaacattgtgcaactgccacctgtatgtaacattttcaccatcccaaaatgcatcattttactttcaactttggatcctacgtgagtccctaaccgacagcatatatcccttatcttacatacaaagtataccttatcttaaatgcttgggacagaggtatttcagattttggatcttttcaaattttggaacatttgtggtcatctcatatatgcagatgattggttctaagacacccgccccctgcaatgtgtaccaaaattcacgcatactcaagtctcaaagttggccctgcagaacccacatttataaaagtcagctctccgtatacatgggttttgaatcccacgagtactatattttcaattcacatttggttgaaaaaaatctgcatataagtggacctgcatgattcaaacacatcttgttttaaggccaaccggactcaccagttgagcttccataatccaaaaatatgaaatccaaaatacttcaatgggcatttattttgaacatcatgtaggcactcaaaaattttcagattttggagcattttagattttggacttttggattagggatattcaacccgtagttggtcatacttttaaaaatgtattctgtcagtctctcttttaattggtgagtttgatcccttttcatttacagtaatttctgttaaggaaggatttacttctgccactttgctgctggtttctgtatgtcttacaccttttttcctcctcagttcctcaaatattgcctttttttgtttctttgatttaatttttagtgtactgttttgattcccttctcattttcttttcctgcacatttctttttgttattttcttagtggttaccatgggaattacaattaacaccccacatttatcacaatgtagtttgaatttataccaacttagcttcaaaagcacacaaaaactgcttctgaatagcttccttcccagctttatgttgttattgtcacaaattatctcttcctacattgtatgctgttaacatagatttataattattgttttatgcatttgtcttttaaatcatatagaagacaaaaggaggagatacaaaccaaagctacaatactgggttttatatttacctatgtagttaattttactgaagttctttattttcttgtatggcttctggttactgtttagaatttcagcctcaatgacctgcatttcagcctgtcacctttagcatttcttacagagcttgtctactagtgacaaactccctcagcttttgcttctaaggggatgtcttaattttggcttcattttcaaaggatagttttgcctgatacagaattattggttgacagttatttttctttcagcacattaaatacatcatcccactgccttcaggcctccatggtttctggtgaaaaactgctgttgatcttattgacgatctcaagtacaagatgaattgcctctctcttgctgctttcaaatttctgtctttcgcttttgatggtttgatgataatatgtcagcatggatctctttgaatcaattctacttggagttagttgagcttcttggatatgtatattcatgtctttcatcaaatttgggatagtattggtcagtataactctatacatgatttcgtcagcttcctcctggaaagccagtctcgcccaaaggtgctaaaacagggttcctctttgcactggtttctcaaggaaccaccagacagctcaaaacacacagccacagttttttgaaaacaagatccatactgccccctggtaccaccacatctcaccaggaacttaggccaccaatcctgtagctgctgttgaactggggaatggggaataataggtgggcaagcaaaaaccacagaatgtcttttaaccaaaatttagcattctctttctcaatttagcaccccctggttactgctgatttttaaaattagactacagaatcccagaacagtcacttctgtccatttttgtcagcttacttgttacttcagtggagggacagatccttggagccacctgctctgtgatttccatgtcactactcgacctgatggagtctttggcccacttggaagaagtacccctttgacagaccttttcgcatcctgcccacatcccagttgcccaccctgtgcctcccttcagctctgcagggcagctcccatctatgctgatggctccagccttaagcacctgccttggtctgtctgagctaagcagcacactagcccacacccagggcaggccagggctgctcaggagttcacctcttcagagagcaagggatgggagtcaatggatagagacccctgattctttgaccctcagacgattcaaggcacatcccacatgcctctcagagggtctccggcagtgtcgggccccggccgtccacactggtggtttgtgcatgtacttcatggcttccgcccttctcaggcttactgtcccgttctctcacttggcttctgggatcatcctccaaataaattacttgtacccacatccttactgcaggatgtgattttgtggacaaaagtaacctctgccttaattcttcaaagtgttgaatcccacagtggtgacaccatccctgtggctgctggcctaactgatgtaaatggctcagtccacagggcccttacacagatggcccaggcagccggtggaggatcatcctgttcctgcaagcttacgtgccctcaggagctgctgtgggccttcacatctgggctgcatgctgataacaaagcctctcacttgtttccagatgcatcaacatggtgacatgcagagtctttattttgggacaaaaataggcatccatgaaatggtgtgaacaaataactattcttggcctcagtgatttcattcagtgcataaacagtatttttcctgctgaatttccaggattgaggaaactcttgtctctcaggaccagctggattttacttttttttttttagtgtcttctcaaacgcagaaagagctacaaaactcccatgaggcatgggccagctgaagaggcttcagacagttgctttggttgtttcacaagactagaaaagtgtggttgcttcttgcctccagaccgtattatcctgcctcaccatcagctgtttctgccacctcaagacaagaggcaaagtgggaaagagaagtttgaaaccaggagcttctaagtttgcctgagtcttcaagggccagattaggaatctttagccaccaggctcacactgtcggaactgagaggtgggacagctgaacagaaaggcagaatcttccagaacctggactgggcccagcaagcagggtagggatgtccaggaagggggaaggcacccagcttggctcctgagaatgccccagctgttggtgacccgtcgtctgatgggacaactgaagccaggaagtggtgtggctggacttgctctttaggaagcagactttgtggaggtgggaaggcggcactgtccaagctggaggcggcattgtccaagctggaggtggcattgtccaagctggaggtggcatcatccaagttggaggtgacatcgtccaagctggaggcggcatcgtccaagctggaggcggcatcgtctgacttggaggcggcatcgtccaagctggaggcgccattgtctgaggtggaggcgacattgtccaagttggaggtggcattgttcgagttggaggcgccattgtccgagttggagacggctttgtctgagttgggaacggcaggttcaggggccaggtcactgagcgggagaagagtgaatgggttggagaaacatccacggggaaagatacattgatttgtcagacgccaggatggaggagcagtaggatggaagggccttcagaggcaggcggggggtcttcgggacacacggggtcagtgtgcccatgggggttggccgggagcagctagcaggcggaggctgtgagtctggaaggagaacccagtgcaggtggggatgtggctgctgcgaatgggtggggttgaaaccatgagggctcatgaggtcactctggcaggaggtgcctggggagggaggagtcagccctgaacacccagcactggggcctccgcatccctgcacggatccctgctctgtctctgacctctcaccgtgttcctcccacactaaacacatctccatctcacacaggggctggtccgaggcctgactcggtgagagcaggaaaatgggtagagaggcagagtgctccagctggagcagatgagcgatcatggtggggtcacagcactgggagctgcacaggctccattcggcacggtgtttatttcagagtctctgtttactgtataaatactaggcaggattcaggagttgtggactgtggactgtgtagtctgtgttgtagacaatgcctgccccccaagaagcatgctgcttcccagctgatgagcaagggcagagctggccaggtgcggctgcctgtcccaacagccccttggcttagagaagagaggggcacagctctcatccatgcacgtggacctgctggacagtggtcactggcctggtgactaaaaacaactcccttctcaggacttttgcctctattttggtgttccagcctctgtggacatagtttgaccctcttaagactatttctaatcaacatgtctagggatgcttctgatttaaatgttatgctttcaaacaattattatatttgcagcagtgcggatgcttgcaggaagctttttccatgaaacttttttaaaaagaagaattttccaatagatccttttctcacaaacttaggtttctctcgataaacacatatttgtgccacttaacacattaattcaaatgaattgctctaccctgcattgtattgattccaaggttcagtcagtggtgggagtggtaccgcccccgcttgggtggtgggctccactgaccgagactgctgggccgtgtgttggttaagctggacatgaccgtgggggcaggctggcgttcgcgacgaaccatgctcaatctttgtcaaatgccgttagaatccttttctgtggcaaggaaagagagttccgccttccttccctgtgaaggtgtttgctgcatgaaggccgggcatctggagcctgtcctgggctcggagtgtctgtaattgaagtgatagcagcttttgatacttactggaaatgtcaaatgaagcccagtgctcccttagaaacattggtttaaaacccttacaacgtggagaaaagtggcagaggaagaacaagattgtctgaatgcatttagttaaaaacacataaaaagatgaactaccagaaaaataatagggagtcaaaacagatacaaaaacactaaaaggggatggtgtagtgatcaacttgacccttagacacctgcggcctctgtgaacttccatcttcctgaaaggagacaggagcttgacccagggaggctgagccgggccttccatggaatggcacttcctcagcagaggaggcgggggcttcggtgtcctagaggggccttggcgtcagggtagggagcgcttggcctctgggagctttggcatctggggaggacttcagtatcctgggggtggggggcttccttggcatcttgggagggggtttcagcatttgtggaggactcagtctggggatcctccatgttgagggagtctgggcatctggggtgggtgtcttggtgtccagggcctcctcggaaccaacaggtccaggagcagggatggggaggaggtgggggctgaagctggtgctgtgctgagccagcagatgcttcctgtggagacattgttggatttcaagggcaggaagtgattctgttggctgtcactgaatttaaagggtgtagcctttgtctaagtcggccattcagaaaggaccgtctggggcatgggagggggcatgggaagtccctgagaccctctgggggtccgcagagtaagacattttcctagcaaagccccaaagttctttgcctgtttatcctctggtgagattctgcatcgcttccccaggctgtgagatgtgcgaggatgcggcttcgaggctagtggaatgtgtgttgtgtgttcttgggtctcgagaactcctcctttgaattttggagcagtgaatagtggtagctacagttatgaatgcaaaggcttcctggggccaaatttttaagcctgaagatgctgggagcaccaggcccggccctcctgctgtgcacacctgctgcccatcacagagctcggctcttgcagatcctcgtcaagtgagggcatggaaatgccagggatgggagacggtgtgtttgactttgggagtgaagcatggagacccagggcccagttaggccacagtgattcaggctacgcagatgaaggtggctggggtggcaccagtgggaatgaaaaggaaggacaaggttgagcccctgccactgcctgtcatcagagatggcaggaggatgactgataaccaagccctccttcctagaaaaggtgggggcagttctccgtgagcacagggttgtgggggtgtgatctggggaaagacagtgagggactgggaggggatacacatcatttttagacacttgcgatgtacaggtgaacgcggagaagttggggtctggagctggtggagtcatattccaccagctcccagtctcaatgagaggattctctgatcatcgctcctgcttgacatctgaaaaagaactcatttgcatacttcccaagagtattaccccagcagcattttgtgtctgtaaagatataaacattctgtgggagcattttcaggacattcgctgaggctgcctgactccccacaccaacacctgctgtgcagtcagaagtcacagtgaggtgacacgcagccctcagatgcgggagcaaaactagggtgaaggctgaggaccccaccgtgggctctgagctgggagcggccaggggccaggtgctgcttttgtggtgcctcaagatcacctcctctggaaaggcgtgccgaggactcccgtgtgtggagggtgggccgaggacccctgtgtgtggagggtgggccgaggacccctgtgtgtggagggtgggccgaggacccctgtgcgtgtggaaggcatgctgaggaccctcgtgtgtggagggtaggccaaggactcccatgagtgaaggtgcactgcagacccccatgtgtggagggtgggccgaggacccccgtgtgcgaaggtgtgctaaggacccccatatttgaaggtgtgctggggacccccgtgtgtggagggtgtgccgtggacccctgtgtgttgctgcaggggaccaaccacttagcaaaagtcctgcagagagcgctgtgtcctgtgaggagatgggcactcagcctggccgcacagtgaggcttgagcatggagattaggtggtgaaggtgggcagaggcctctgggagggctattgggagggagaccttggcagcagctggccacatgctgaccccactccatgcagagcccagcatagggagtgtggctggctctgggagacctgcactttcaggatggtcctagccctgataaaaattacagagatcttttatacacatgcatggacgtatgtccctgcacagatggccaggagcccctctctgctaactcttacacagtggcttgctgtggctgctctggtttcaagtacccagagacctgggtctactgaagaatcgcttgcagtgtcatgggggagggagttagatttgcagtgtcacggaggggggagggtgttatatttgcagtgtcatggtggggaggatgttagatttgcagtgtcatgggggagggtgttagatttgcagtgtcatgattgggagggtgttagatttgcagtgtcacaggggagggtgtcagatttgtagtgtcgtggtggggagggtgttagatttgcagtgtcacaggggagagtgttagatttgcagtgtcgtggtggggagggtgttagatttgcagtgtcatggtggggagggtgttagatttgcagtgtcacgggggagagtgttagatttgcagtgtcgtggtggggagggtgttagatttgcagtgtcgtggtggggagggtgttagatttgcagtgtcacgggggagggtgttagatttgcagtgtcacgggggagagtgttagcatttgcagtgttgtgggggagagtgttagatttgcagtgtcactgtggggagggcattagatttgcagtgtcatgggggagggtgtttgatttgcagtgtcatggtggggagggtgtcagatttgcagtgtcatggggcagggcgttagatttgcagtgtcacgggggggcgttagatttgcagtgtcttcggggagagtgttagatttgcagtgtcacggtggggagggtgttagatttgcagtgtcacaggtgagggtgatagatttgcagtgtcactggggagggtgttagatttgcagtgtcacaggggagggcgttagatttgcagtgtcacaggggagggtatgagatttgcagtgtcaagggggagggtgttagatttgcagtgtcacaggagagggcattagatttgcagtgtcacaggggagggcattagatttctgtaacagtgagaatttctaggcttcttcatttcttaatttcagtatttcaatgtcacagagtcaactgtttataactttgcctcttgatggcacaaaaaagagtttgctttgaaagtaaggagcacagaccttataaaatttaataataacactaggaaggggagagaaaagaatctgcactgaggcttcagaaaggagccggggctgagttataaccaagttctgaacaccaccatcgctgacagaccactagatgggaactctgaggatgatgcccagaaggaaatgtgcagagaacatgtccctcaggacctggactggaactcttgacaggggctcatggtcataccaacgggggcctctctgctctcaactgcccatgcagcgacgccttcctccactcaggtcctccctgctctctgctgcccatgcggcgacaccttccaggacctgggtactccctgctcttccccgcctgtgcagtgataccttcctggacctgcttagttcattcaggaagcattgcctccactctgctctgtgctgaggtctcacaggccagagacctgtggcatttgtagacacatacgtagcaaccttctccttctcgggtgcccagtacccagccaaatgcacctatccaagggcctagcaaaaccaactgctaggcaaacacatcttaaaagccctggtattaacacaggttgtaagatacgccagagggaagctggactgaggagttctgaggccaactctgtctgtctggtgctgagtttcagtagacactggacgatggggttgaggcctcagggcctcacctttgctaacccaagattatgggttttggcaaattaggttcatatgcagatgatggccccactggggatgtggctgtgtccacagggtgaatcctggcacttggtgagctccacccacaacacacagcactgagagtgacctggtctgcagatggctgtccagctctcctctcctgcagccagaggcctggtctctagagcagctctgttctagcactttctgtggcaacagaatggcccacatgtgtgctgtcctgcaggacagccaccagcccctgtggccgctcagtgatggaaaccttgctagtgagacaggagacctgcgtgctttattttatcttattgtaattcagaatttggatactggaaacctcgctattgaggtggggacctgcgtgctttacttaactttatctgactgtaattcagaatttgcgtgctggaaaccttgctattgaggtggggacctgcgtgctttgctttactgtatctgactgtaattcggaatttgggtgctggaaaccttgctgttgaggtggggacctgcatgctttactttactttatctgactgtaattcggaatttgggtgtgagttgatgtggctgccaccatgcacaaggcactgcaggggctcgtagcccgtgtggatcatggacaagaagtttgctctgatgctcccaaagagccccactccttacttcagcactgatatgagcatcttgacaccggcaggttgttttctgtgggccactccggtagatttaaaaccctcccttttactgccagggttggatcatcctacataagcaccaacaccccaaagggtggttctttttactcaaaaacaatcatgcttagtgtactacaaggacaatgtatctttgatattaaagagaatttttggaaaagagcttcctcaaatctcatcagtttaatgcaacttaaacacgtcacatttaatttgtctatgtggtaagactaatagtaaaaattgaggtcttcagtgcaaagcagatctgggttcacatcttgcctttgggtgttgttgtgtgaccctgagcagacaggcagcctccctgggcctctccttcccatctgcagagggtgggcagtggtctgcacgtggcatggctgggcctgcaggtctgcttatagtgtctacccctcacatccggccctctcctgtgtccctgctgagcagcagctcaagaacctttcagcaggatccccagggcagaagcaggtgcctctgagagctggcagggatgacactgcaggcatgtgcagctgtcccatggctgacgctcctgtgcgatgtctcccctgcatctccactgcagttcagatgtaatttccaaccagtgggtgctgcagtttttctgagacagccaactattcaaagcaaaggaaacctttcataaagtgtaatctgtgcgtgcatttggcagcaccatgcggggggcccacttcgaggtgacctcctctcaccagagcactgtgccctgcagtgggtggctcttagctttgaacagccggggttcacattgtgcagaaaaacatacttagatggccccaccatgcactctgcttcagatctgagtggctccgcatgccacattgcttctaatttccagcttgacattgtcaaaggaaaataaaacaacagagagagagatggggaacatgtcacatagtcacgaagattcccatcacaggggttgcaaatggtgctactgaacagactgtcctggggctcacgtcactaggcacaaggggatgggtgacgagcagattgcagatacgcaggactgttcagacagactctgtggtgtctttgtaaatatgaatccattcatccttttctagctctttaggccaacaggcagttggcctttccaggccccggctcaagccaaaactcagagaggccgcacccgctctcagcagctggtgagagtccggggcagaacctttgcactgaagagcccctgcctggctttttaagcggcttctcctgggtgggaaaggtggagcggccgcactcgggagcgctattgtgagagacatgaagccacaccgcacacggctttattctctcatccgatgctgagtgtcttctctgtgcctgacaacagcggcttagtagtagctgatgcgatctgctccagacatcaagggcttgcctattcccgcacctttcatttcttcagtgaattgctccagtccccacgtgctcagttagacggaaattctgtatccaccttcaaaaccttcctcttcctttccccagcacagcttactttgggtaaataagcaaaagctgtttttctaggtggtccagccccgtgtggacctttactcacctatgtgtgccagctgcaagttcacgtggtcactcgggctaaggacccaccacagccatgctcacggcaagttccaggtgcccagatgcagaaggagcataaagatattgtcagacccacggtgttcaggggtccggagggcttcccagagaaggtggcccaggccaagtctgggagatgaagagaaattgccccagtgaagggggttgacatgcgggtgagaggggcaggcagaaagacattctacaagagaaaaaatactttttacagaatattgcagaaagaatactttttacagatgagaaagaggctatgtttaggaaaattcccatgactggccatggcggaaagacaggggagaggtgggaaaatggcatgaatgaccgaaaggatggcctcatacactccctgcgaacttgaaaattctccagagggcatgaggagcctctgaagagctttgcacagggctgcacatgtgttcagacctgcactgtagaaccccaccctggcttccgagtggaggagacacgggaggtgtcagacctgcactgtagacccccaccctggcttccgagtggaagagacacgggaggtgtcagacctgcactgtagaaccccaccctggcttccgagtggaggagacacgggaggtgtccgacctgcactgtagacccccaccctggcttccgagtggaggagacactagaagtgagattgagtggtgctcgggagaacagggagaggtggtgggaatccaggagacagaggtgcctccgtggaagagaaacaggtggggtggccagagagctacagggaggatgctcgcggggcctggtggagtgagggacacaggcagaggggaggaatgagcccagtagagtctggtttgggatgtcgtgtgaacgtgacaggggcacagagcccataatcgatagcatctcgtcacctcaagaaagcagagagcttcggctcagtcagtctcagtcttctctaactagttgaggcaaaatcaattcagacctccagtggcagcagtgaagctcagtgagaaaaaattcaagcatcttgtactagagaaccatggcagggagggaaagtggggagaatgtgtctgcatttgctgtagtcatacacctacgatcggttcactttcggattgcgaagcacacaggacagaatggcgttgctgcaccatgaggatggctagacccccctgagggagcgacacagatgctgaagatgtctaaaccccccctgagggagcgacacagatgctgaggatggctagacacccctgagggagcgacacagatgctgaggatggctagacccccctgagggagcgacacagatgctgaggatggctagacccccctgagggagcgacacagatgctgaggatggctagacccccctgagggagtgacacagatgctgaggatggctagacccccctgagggagtgacacagatgccgatgcctcccagggagctccaattttaaaagcaaggagtggactgtcaccaggttcctgtgatgtacccgccaatgttcatcttgcagtccaaaattgctaaacatgttaagaaacaggacattaggacccataaagaagagaaaagaaagtcccaatgatacagacactgaaatcaaccagacaaggacttaacaacaattccagatctgttcaagaacgtaaagggaaagacggagaagaggggacacgtgggaacctcagcagaaagatggaggccgtgcagaagaaccacgtgtagattttagaaaggagagcttgtaagatgggaaattcactgcatgggctttacagcggatcagagactgcagaagaatgaattggcaaacttggaacagatgcacagaaatgatcgcatctgaaggacagagaaaaatgccagaaacaaaaaagagcccaggtggcctctaggacaaagtcaagtggtctgacccacgtgacagttccagaagatgagccaagaaaggtgggacacaaaaaaagaagaattaatattcaaaaccagcaaccctacccaccctccacctggtgaaaaagaagaagctcagagaaccccaagcaagttaagtgcaaagaaaattaacataagcacatttgtagtcaaattgctaaaataccaaagatagaaaatcttaacagctgggaggagagacgttacattcccaggagcaatgatatgcatgaggactgacttcattcttcactagaaacagcagaaaccaggagacaatttgacaactctttaaggttctgcaagggagaaaacaaaagcccagagttctatctccagcaaaaacatgtttcagcataagggtgaaagaaacctgctttcgtgccagcccatcccgagagaatctgccatgttagacctgcactgtacaaaatgctgcggacctcttctgactgatgggaaatcacagcagttggagacccaggtccacaggaaggatgaagaacccaagaaatggcagcagactgagagcttctggaggaagtgagacagccctgcaggctctgggaagcaggaggtccaaggccggatgctttgctcatcatcgccaagtgaagagtccctgtggcagagcaaagatcaggtcagagtggaaattaaacaaatgtgattcttttaaacaagtaaaaattgaagtggagtgttctatactatagtgggaaaaaattctacaagccagaggcttccagtcaaatgtgcaaatgctatcgaggtgagccgatgtgccagttgactcatactggttcagattttctttccctctctctgctcccatggctttgttgaaggcgcataaaagataagttgcccacacttggcatctgtagccatgaatactgaaatcttctcacattggaaattctttatgttaaagtcaaatcaattcttagtactacttgattcagataagaatcattgatgctaaaatgagcggccgatattctggagaaccacagaatagctctcaccacaagataggatcagaagaaaacagcattcacggtgcagaaaccaggcaggcagcgcttaacaagtgataccagtgaacgtcaccagcggcaagatggatccgcacacgtgcccttgagctgatgcacaaagaacacaaaagatgatgtccctggtgttctcgacaaagagcaaaacccagtctattcctgaggcagccacggtataccagccaaggagcatggtgcaaagtgactcacccctactttaaaaatgcaaatcagtgactcacccctgctctaaaaatgtcatttagagtgactcacccctcctctaaaactgtcaatcagggtgactcatccctccactaaaactgtcaatcagagtgactcatccttcctctaaaactgtcaatcagagtgactcacccttcctctaaagctgtcaatcagagtgactcacccctcctctaaaactgtcaatcagagtgactcacccctcctctaaaactgtcaatcagggtgactcatccctccactaaaactgtcaatcagagtgactcacccctcctctaaaagtgtcaatcagagtgactcacccctcctctaaaactgtcaatcagggtgactcatccctccactaaaactgtcaatcagagtgactcacccctcctctaaaactgtcagtcagagtgactcacccttcctctaaaactgtcagagtgactcacccttcctctaaagctgtcaatcagagtgactcacccctcctctaaaactgtcaatcagagtgactcacccctcctctaaaactgtcaatcagagtgactcacccttcctctaaaactgtcagtcagagtgactcacccttcctctaaagctgtcaatcagagtgactcacccctcctctaaaactgtcaatcagaatgactcacccttcctctaaaactgtcaatcagagtgactcacccctcctctaaaactgtcaatgagtgactcacccctcctctaaaactgtcaatcagagtgactcacccttcctctaaaactgtcaatcagagtgactcacccttcctctaaaactgtcaatcagagtgactcacccctcctctaaaactgtcaatgagtgactcacccctcctctaaaactgtcagtcagagtgactcatccctcctctaaaaatgccagtcagactgactcaccccgccactaaaactgtcaatcaggatgactcacccctcctctaaaactgtcagtcagagtgactcacccctcctctaaaactgtcaatgagtgactcacccctcctctaaaactgtcaatcagagcgactcaccccttctctaaaactgtcaatcggagtgattcacccctcctctaaaactgtcaatcagaatgactcacccttactctataaatgtcagtcaaagtgagtcacttctctaaagctgtccatcggagtgactcatccctcttctaaaactgtgagtgactcacccctcctctaaaactgtccgagtgactcacccctcctcttaaactgtcaatcagaatgacactcctcctctaaagatgtcaatcagagtgactcaccccactctcaaactgtcagaatgacccaaccctactgtaaaactgtcagagtgactcaccctactctaaaaatgtccaagtgactcacccctactctaaaactgtcaatcagactgactcacccctcctctaaaactgtcaattcaagtgagtcacccctactctaaaaatgtcaaagtaagtcacctctaatctgaaactgtcaatcaaagtgactcaccccattctaaagttgtcactatcacaaagaccaagaaagactgaactgaaggattttctaaattgaaggaggctagagagacatgacgtcggtatgcagggcctcatgtgggcatttattttgttctagaaatgttcttgggagaagtagacaaatcgtgtaagttctgttgattagatattagtaccatatcagtgtgaatttttggttttcataactgtactctcattatgtaggagaatgcctttgtttttaggaaataagcactgaagtatttagaactaagggaaaatcatgtccataagtttctctcaaatagttcagaataataaagcacaaatatcagtgtaaatataaatatagagagagattttgcaggtgagagtaaagcctaaaatgttaccatttggagaatcgggtgacgagtgtctgagattcttgtatgatagtcttacaacttttctataaatctgacgtatgttaaaataacatatttttaaaggggggaggggaagcaacttagagtaacaatagaaagccatgaccaacctaaaataatttctcctggcggtggtagaatcccaattttgtgcacatgctcatgctcaggagaagctctgccatgttgccccgccctgcacggcagccgtaattcctactgaagcccagaccgcagtctatgctaagctctagtcatttattcaatttagcttaccaaagctacacctctaactgtctcggtaactcactgaaaatgtcccctcgtcatgtaagagccagagcttacctgcatttttctgatgcatttgtgactcactgagatgcctctgaagcccccagaggcttgtgaaacagttttagagttaatgctctagccccacacgaaggcatgtgcctcctgagaacagggttagattaagaattgagctcacatttcagtcacttttctttcagtgcctactcagcgtgtgatcggaagtagactgggttccgtgcctctgttgtgctgacggctctgctcaggcctgattgggcctgccctttcccgggccaaacgcctcctcactggacctgcctggaagcagcagtgcccactggggccctcacccctaccccaagaatcctgcatgagtcacaattaattcttattagcaagcgacagaaacctggcctaggcagcaaatgtgcttatgaaaatgtattagttaactcgtggaattgctgggacagccagggaaccagctcagagcagcctgggagatgccagccaccctatccgtgcgtgggtgcccttctgcacaatgccaggcaccgcagctcatgctgcagtgctggagccatggcttctagaaacctcgtctggctgcagctcctgcagcggcagaaggagttcttgactcagagtctgtgggagcctctgatccacaggaggcctgtgcactggaggtgagacaggggagagggctgcccttcagtgcagcctcttagctgctacagcgggaagctggttctgcctcttgcgaaaaacaaaaaaaaacgaaaaaaaattatcaaaatgtagggaaggcaatatacataatttaggcagccaaaaataatttttaacatttccataaaaatatacatttcatccccaagcagcagtgcctgtgagcagcctgggaagtgtggcacgcccactcccatgttggctcacctgtggggctggtgccccaggaagctgcccgcttacctgccccagacccagctttgcccaaggaggctctcaggaacagggatggtattggcagggatttcaggcaccacctcagggccaggggcagcaggagaagcaaagaaaagaaagccccccttggcaccctccggtgctccaggcagggctgatggtgctcacgacggtcacgtgtgtgtgcttacaaccccctgagcttcacacaggaaatggaaaacacttcagctggtgccagtgcagaaacctgactccagcatcctgggaaatgattgcaccccacaaaggagctaaaagcagcagctgagagaccctgaacagagaccccctctcaggaggctgcgaatcacgaggggcaccaggaatgttttattatgcaacgtttgtgataaaataagagtgaaccagactttcattgccatcacttaacacgctgtatgctattaatattttagaattgtggtcaagtgaacctgggggaggagaagcgtgggacttctagtttatagctcccaccctggaacctgccaggtgccccaagacacccctctgtgggcctcgtgctatctctgcaggaaggttccggaaaacatcttgaggcaaactataaattgcatttgtgatgtgattcaacaggctccgaaaaacagtgtgcacgatggcatgattattacagtctgcgtcacccaggctgagcgacgggtgatggcccagagctgagcgtctgagctgggacgggtgtctaggtccaggcttggacccgctgatgtggactgaattcgcttcatgcctggccccaaggcagccagcgcgttggtgggggctgccttcagattcattacaataagcgtgccgacctccagtgcctggtgtcccgggaacaccaccagtgggcactgggaaaggttctgcattacagggcacttggaaagactcccttctggcaccattcatctcaacagcagcacagagctcctcacccctgtgaggatgccgcccccacccgagggacagggaagtcttacagtagagacagaggaggctggtgaatggagatcagaggattgggaataaatttgatttaatgagggggaagactgcctggaccctgaaaggaagatgggaccagaggtggcaaatgtggtaaaaggaggggaattccagggcaaaaactatgaccagcctctgttgggctgccaggctgcggcggaggctgtgctgggtgggcgtctgagcttaagcatgggaaacgatccggtggcttcctcctaaaaggaacaaaccgaggactgaagccctcaggagtcgcgccagggtctcccggtgctgcaggaacccacagaggagttgacatttgtgtctcctgaatgcctgtccagcatccccaccgtaaggcagggttgctgaaggtagtcagaggagcagagagcggatggcaggctgccacggcgtactggggaagaggggctgtgggttatggggagggggtcatgccagggacgaccctgccttcagcatttgctaacgcagcatgtgttgaccagctggctgacacatatgccagggaaacacaagggtggaaggaatggtctcaccgtttcactgatccttatttcacaaccttcagcaagacacctggcaccccgggaccccactctcctgcctctaaagtgggcatgtgaggttaaaccatctccatgtcccctcctgccctgacgttctggacgtggggtggctgcattctgagcatcatctgcagcctgtcctgccttgtgtgctgccttctgtcccagccctctgcctggccttctgtgctgccctccctcctgccccctgtcccacccccccatcctatcctctgcactgccctctctcccaccctctgccctgccctttctcctgccctctatccctgtgccctgccatctgccccgctctctctcccatccctatctcccaccctctcatcttccaccctctgcccccctccccaccccacccctatcccgccctctgtgctgccctctcttcatagtcggaacttgcactcccagccctggtgcttcaaactcaggtggtctcagattgatcagcttgtgagagcctggtagtgacgctgagacacggggagtgtcctgggtggcttcgcaatctcttttaccaaatgtgttcaggcagccagttcctttgggtacagtggacctgggggagccagttgaggctttcctgaatagcaggtccatcccaccatcacaagaagagtgttcagggcctaccatttttctctttggccccagccccctaaacccagggaaaggaaccagaccagttctatctttctcagggaggctgggtgcatcctgctggctgtgggatctccaggcgaccaagagcagagaggcctgatgccgcccgctctactaaggaccacccaagccaggcagttagtcccgggggcagcatggctgagtgtgggctctgggtcgggtcctgtatctgcctatggccctgccctggttttacggtcttgggtgggcctcagagtcctcatctgcaccttccttctggattgtggtgagagttaaacgtgtgaattcacataaagtgctgcaacagtgcatgttcccagtaagtgctctataaatgccacctgtcatgttcccagtaagtgctctataaatgccacctgtcacgtgtccattgcccacagagctccacagtccctctaagcgtcgggcagctctcctgaccccagccctagtttgcaaaatggaggtagtgatgtgcacctctcttcttcatgaattgcccacaagcgtgaattgtagaccctcagctgtgaagggtgtgcgtaagaactcgtaaacatcccagtctgctcagcctgacctggtcacaaaccccagagggttcacagcagaactccatggaaaatgctgactcctgcttggaggtaaagcacctgtgctttaataaaacctcgcttccctcctgcttcccacacaccacacatgcccgtgtgcactgagtgatcccagcagacatgaggcctctgctctcagacgggtccctggggcttcctgtcttcggggtcccagcagacatgaggtctctgctctcagacgggtccctggggcttcctgtcttggggtcccagaagacgtgaggcctctgctgtcagacgggtccctggggcttcctgtcttcggggtcccagcagatgtgaggtctctgctctcagaagggtccctggggcttcctgtcttggggtcccagaagatgtgaggcctctgctctcagacgggtccctggggcttcctgtcttcagggtcccagcacacgtgaggtctctgctctcagacgggtccctggggcttcctgtcttggggtcccagaagacatgaggtctctgctctcagacgggtccctggggcttcctatctttggggtcccagaagacgcgaggcctctgctctcagacgggtccctggggcttcctgtctttggggtcccagaagacgcgaggcctctgctctcagacgggtccctggggcttcctgtcttcggggtcccagaagatgcgaggcctctgttctcagacgggtccctggggcttcctgtcttcggggtcccagaagatgcgaggcctctgctctcagacgggtccctggggcttcctgtctttggggtcccagaagacgcgaggcctctgctctcagacgggtccctggggcttcctgtgttcagggccccagcagacgtgaggtctctgctctcagacgggtccctggggcttcctgtcttcagggctttgcttgcagacagtgagccggtgtcaggatccctgcagccacacgtccagatgcagggggaggcgactcttacccaacagcagtgggggccatggagtgtccagcaagatcagggtgaaggatctccagggctgcagggagagaggctacttctcaggtctaagcaggaagcaaaggagcagcattttacagggtctgtgggtgtttgtgagtgaatgcagctacagagtgtttagaggaaggggcactggagggtgcgtaggaggcctgggatgcagggagtcccgcccagttactcaggaacacacagctgtgggcaaggccctccctgcctccacttctcatttaggtaatattaaaataaattagatgatctccagaatcccttcttgctctttaaattgtttttaatttggcaattattatctcacatggactcagaatttgatgagatgcatttgaaacttctaatacagaactggcacatagtagatgctctgagaaaggggattttcatcctcagcttcctgtggctgtggtttagtggtggacagacagagggacgtgacgcatggaccctcagtgtactgtggctgtggtttagtggtggatagatggaaggatgtaatgcgtggaccctcagcatactgtggctctggtttagtggtagatagatagagggaggtaatgcatggaccctcagcttcctgtggctgtggtttatcagtggacagatagagggaggtaacgcgtggaccctcagcttcctgtggctgtggtttagtggtagatagacagagggaggtaatgcatggataaaaattaaattcatccattcgcctcacatgtagactcaaaagcttaataaagtctaaactaattttccataattacagtgcaaatactgaaaatgataacaaaaccataaaatatattttgcagggaactagtttccttatctctgggagaagggttttagaacgacacagaagaagaggtgtctgtggaagtgttttctgaggcaccgcgctttgaagagtggcccgtgttttcctctgtttaccatcacgtcactggttcctgattgtctcggtggctggtgattcagcgtcgtttctctgtgacgcgtctctaggactgaccctgacccacagctctgggttcacctgcaagctggcttgaacagctggaccttctgcatcagggtctgcattttaacagggtccccagcggctcctgggtgtgctgcccatctgaggcccatcactctgtggccccatgcggtttccacgtggcctgaccgagtccactgctgaccacctcagaacaggcagtgtttgcctgcagccaaaggaagctggagggagaggggccaggccaggttgggacccgggaccacgaggaaggtgaacccatgaagggctattgtgacagccgtgatttggacgtagcaaatgtgggcatttagattttggggattctggaagattctggaggggatttaacctactaaagcaacgtgctaaatgcaggtgcctgcatcctgactacatatcaataactgcatttgcctgacgtgctaaacgcaggtgcctgcatcctgactacatttcaataactgcatttgcctgacgtgctaaatgcaggtgcctgcatcctgactacatttcaataactgcatttgcctgacgtgctaaatgcaggtgcctgcatcctgactacatttcaataactgcatttgcctgacgtgctaaatgcaggtgcatcctgactacacttcaataactgcatttgcttgacgtgctaaatgcaggtgcctgcatcctgactacatttcaataactgcatttgcctgacgtgctaaatgcaggtgcctgcatcctgactacatttcaataactgcatttgcctgatgtgctaaatgcaggtgcctgcatcctgactacatttcaataactgcatttgcctgtttgagcttcagtggaggtgttttcatcacctaaagctggtgagaactgtgcatctcagtcatgggagttgggtgagcagagggtaccgtgccaagtggcataggcagtggcctcctggctgactcggcaagtctttaatccacctgcagcggacttcttaccctgtgtacctgaaataaagcgaggtgtcctccccgtgcatcctgtagattccacatgacctgttttccagctcaagaatgggaattgctatccctggcagaggtcaggaaccagctctgactctgggtggcacctgggccagtggtgagcagggccctgtggatggggcctttggaggcgtccagggtagggagattccatgactcagaaccagtgtcgggaggagcagctgagctctggcaacagggctggtggcctcggttctcctccaggggctgtgcacctcgccagctgcaggtcagagggggcgtcctcagctttgagcccagggccgccctttctgatgttccaatggacagtgtttccttacaggtggaggagaaaaggagaacgagtgtggcttcaatggagccagccccaggaagccacatagacctcctctgccacccctctacctgcctgtggccgcgccccctcatcctgtccaagtgaagaggccatggatgtgatggccccaccctgccttctgaaacactcaggaccgggccccctcctccagctccccagcgtgacacacaaccttgccatcccccattgtcccatccctgccgtctgctatgggtgcccatggggtctcccaaacagcggtatccagaatggaacacagtgctgagatacggtccaacccaaacagcacaccaaagccagcctcctctaattcaggacaggttgcttttttaaattctgctcaggaacaggtagatatgttagcaaccattttgcaaattcaactaaaatctccctgagtttagcaaaagaaccatctcgggtgtgaccgctaacatcctacactaacactgtcgattcctgaaaacacatttcttatctaaaggcagagatttctctttatctcaggaaaatttcctcttgttggtttctgggatcagagtttcttcctggaccatttgcagcagtgacagcctctctgagtttctggggttttatccgtcagttgagggaatgggatggaagccatcaatggtctgacatttggacgtttgcccccaaataatttgagcaaagtcttccaaaggaggtctcgggcctgtctttgaaggaactgacacaggtggaaagacggggatgatgttctttggatttttccaactcaatgtgatgtagtgacacgtgctctgcctcgcgaggggaaagagctcccctccacaggccagcgcgcaggtggcgtttcccgaggctcaggcaggtggagcatggttggatggtcccagggggctggctgccttcttgccctgccagaacacacccacctgttgttttctcagtcacaagcatcataacttatggctagctgctcccacctcacctgcactgactggctcataggaaaagcttctggtgacttaagtgatttttataggtcagggttaagaataaaaaggcccagtggaacggcgtctctaaaagcatgcagtgtagggtgttgggataaagataaaaaacccagagtgatgttttatttatagacctttattgacacacacagcctaggctaaattttacattaaacactggttacaaataaatgtgttcacctgagtaaacagcctctggggtctttattaaaatggctttaaggagaaggagggatgtttttagctgccagtggtaggagacagtggaaggatggctggtcccagagcaggcttgccactggtggcatcatttgtaatatatattttcattttgctctgaagcacagcaaataggtttttgtaagcgagtgacctcaggattagctgtgttatttgtgacttagaaagcagtcagttgaaatattgaaagtattttcccaactcaggctggtttcagcggtgccgcagcgtgccgtgacatcgagcttgctaatgaataataaagacgattgccgctggtgatgtggaaggaaaagaaccaaccttactgcagatgccctttttccttcccagcaaaaggagcttatattgagaaacccatgggaacaaagtcattcttgctagtttgtgtccaactaaagagaacatttatcttgtttaaatcagcacttagcagtggtaagtttgctcttgttttccatccataattttcaatgcaattccaattctgcataattttcaattcaattccaatttcagtgcaattccagctttgccgcaggtgtggtctcacccactgtaggactgcaggactgcaggactgagacccagacccccatttccctttccacgcactctgttccaagtcaggatgcagtgctggccccatcgcccaggaaagacttccttctgcaagtcaccactccttggccccgtcacccagtatttaaaaaccaaaaatcccgtatgaagatgttgaacagaatcctggtcagtagagtcagaaaataatcatctctcttcaaaattctcctgaaagtttcactgcagtaataatctttgtacacatggagaatgccctttacctacagtttttaaggtatttgaacatctaaccagggacatctgcacttcaaataaaaacaagcaacttttaacctttgtttgtgacttgtgtttagtagattttatgtttagtgcagttttacatttacagaaaaatagagcagacagtccagagggttcccacgtgccctgccttccactccacaccccgtctccccattgctcccatctgtattaggatggtctgtttgtcacagttgatgagcccacattcattccatggtttacatcagggttcactcctgctgttctcttaggtggatttttgttgctataataaaattcctgagacagggtagtttataagaaaagaagtttatttagctcacagttgtggaggctgggaagtccgagggcatggcagcagctctgacaagggctttcttactgcgccatgccctggaagaagggccaatgagcatgtataatgagacgacaagcatgaggggctgggctcgccttacagcagccctccctgcctgcggcagcccactcccacaagaattatcacactcctgcaagaaaccatcagtccctcttaatgacctaatcacctcttaaaggccccacctccaacactgccacaatggtaatcaaatttcagcatgagtttcagatggtataaaccatatttgagccacagcaggatggtacattctgtgggtttgggcaagtgtatgatgacacgtatccatcatcatagcgtcaaacagagtggtttccctgtcatgaaagcctctgtgctctgctggtacctctctcttcccccaactcctcattacctccaccacaacttacactgtctccatcctttgttcttttccagaacgtcttagcgttggaatcatgcagtgtgtagcctttccaggatggcttctttcacttagcaagaggcatttaaggttcctgcaagccctgtgtcatggtttgacggctcattccgttttagccctgaatgatatcctattatatggatacaccacggttgatccattcatctactgaaggacatcatggttgcttccaagtttgggcaattatgaactaagctgcaataaacatccacgtgcataattttgtatggacataagttttcaactctatttagcaaataccaaagggcatgactgctgggtcatatactaataatatattcagtttttaattttcatgaagtcctacctatcagttgtttttttcatgaactgtgcttttggtgttgtatctctaaaaagtcatcaccaaacccaaggtcacctagattttctttgtatcttctagaagttgtatagtttggcattttacatctaactttgcattaatttctgtggagggtatagggttgatgtctggattcactttttgcatgtgagtatcccattggtccagcaccatctgctgaaaagctggtcccttccccattgagttcccttgctgctttgccaaggattgggcagctctgtttgtgcagctgactcttaacttttggcttataaaatgtattgataaaacacaagtggtttgggaagtctcaaacatttcagcatttgtcctcgctggctagaacttcgtgttcaaaagaagaagcaggcaggacgttcagacaacatggggggccttggtgtaggctcagagcctttgctgtatcctcagacccaccaatggattgccaagcgtgtccttgtaaactgtgaactgcgcttggtgctggcgctcctgggaggtgctgacttgagaatcttttattcctcaaagttttgagagaactttccagtcacacttagggccttgtgcttttctggaaggaagtttctttgaaaaacgttttgtattttcatattcatctattaatatttctttcttcattcttagccaggttagtaatttttattttctttgttcatagttcaatttcttggagttccaaattcttagacagcgatgcgttgcttaatgacgaggctgccttcagataaatgtttcatctggcaatttcgtcgttgtgcgagcatcacagggtgcacttacaaaacctgtagatgctacagcctcctacacacccaggttgtatgggacagcgctgctaggctacaaacctgcacaacatgttactatactaatactgtaggcaggtgtaacacagcggtaggcatttgtgtatcatttgcacatagaaaaggtaatgctttgcactgtggctttacgatggctgtgacgtcgcaaggtgacaggaatttgtcagctccgtcatactcttatgggaccaccacttgtgggtgtatgtggttcatcactgaccaaaacgttagtacgtggtgcatgactataaatagatatataaatggtcttaagggcttataagtcttaaatttccactgcatctgtgattatgtgtcctcctaattattaatttttgataattttagaatttgaggtgttttacttttcttgattacctctaagagtttatgattttttcccctaaaatcaagctcttgggtttattcaccaatcctgtattcccttttatagtttaatttatatttttattacttaatttcttccctcaagttttttgttacctatttactttgacgtcataaatggagtgcctactttgtttactgtccttctctcttatcatcatggaagctctcagtattcgaaacccacctccggggaatcatttcggtatctcccacagcctttattattctctaactattttgtaatttagtttccatttccttcttaacctaagaattattgaaaataatatttttaatacccaaatgatgagagagttttgttttctgtgtttattaatttctaatttattagattttgcttagagaatgcaacatttatgatttttatgatttaaaaaacatgaagtccttttttgaggcttaatatctgatcggttccattctggtttctagaccatagagcttgatcagtcgctattgaattctctttgtcatgttctcgggcccgctgtaggacccttgtgggagctagggagacttgtttctaataaggctctgtgttttactagccctgtgactttaggtaagttgcttaaccccctggaaaactcagtcctctttatcaataagatgggggcatttaaagtccgcacctcaggtggctgttgtgggggttagtgccgggtgcagttaaagtgccaagcgcagccccggaacgtggctggtggaggatggccgccgtcaggcccttccgtccctcaggctgcgagtggcatctctttgtactgtgatcacttcttccttattaatttcgatgtttatttcttggcacacaccagttcattaaccctatatcgttgtctggaattttataatctaatctaacattagtctatttattccactttaatcaataacttttaaacaaattgcacattttcttggtgtcgacgccatgacgccttctctccttccattcgtatgtctgatagattttcccggccgcgtcagtttgtaatctttctggacggcgttgttttcgatatgttgcttgtagataatgagtagtttgatgcgagtgaaggcacctgtcctaggaagatgacttcccctgctcccacgcgtcgtcctcactgtgtgtgtttctcgttaatcacaccggcccacgccttccagctcctcagcttccctcctgttccttcgatggtttacctgttgccatgtggatgatgttatagtttggttttatgttgttcccaggtaatttgttttaagttcttcacacttttcaaaagcagtaaggatcttcagatttctcattatcaacttcaagaacaatactaatttccttgtcttagaagaacacttcaggatacctcatttctcccacattttataaacggggaggtgaaggcctggttcagctttacatttaccatttcagaaggcacgtctttaccagcatccgtgctaatgtctgaagaaaaggacaaactaagaaaacgcagaacctaaggctatttgtggcagtgcgtccaggaagaatcttttaggggtaggtttgagggctgtgactgaaaattctcagaaaatgtgtagatgggggaatgtggccatttattcagatgccttttaatacaaaaaaatcttagtcaaatttcactgaaatttgcgttgggaaagccaattacatcgtgaaatgggtggaaaatcttattatcccagccccagccccagctcggcctgctgactctgatgtctagagatgaacaataaggagacaatttccatttttcctcgtcgccacgcaggacctggggccgtcccttccttgtcacttttattgaacatagcagtttgtccaggaccacgcgttgaaaattgctgaagataaacattgtattttaaattactccaggcaaccaggcagactgaaaaaaaatcatttgaacaattgaaaactgaaatgttgatatcagatattaaattaatgtaagtgagattgaaacaatatctaattaaaataatttgaaaaatgacttggaaattggagctgacattagcttttcccagcctgccgctattattactgcgcagccatgctccctttccaccgaagccccgccccccggcagaatccacaggagacccgcagatgagagtctcatttatttaccctgttatggctggaaaacaagggctgaagaacctttcttggaaccctgaggagtggagtttgacaaattgacctttcagtttccaaggagaaaatgcctttcaaatgctccacgccaatgtgcacttctgcgttgcaggctggagtgtgttcagtgccttcgcttcatacaggacattttaaaatgagagagagcggtttgcaacagcaaagaaggggaaccagaagctccccagctgcggcagcctgtcctggagtggccggggtgcgtggccagcccctgccgtggtggggaccttcagccagggaggaggacgtgtgttggacgtgtcctggagtggccggggtgcatggccagcccctgccatggtggggaccttcagctggggagggggacgtgtattggacgtgtcccggagtggccggggtgcgtggccagcccctgccatggtggggaccttcagctggggagggggacgtgtgttggacgtgtcccggagtggccggggtgcgtggccagcccctgccatggtggggaccttcagctggggagggagatgtgtgttggacgtgtcctggagtggccggggtgcgtggccagcccctgccatggtggggaccttcagctggggagggggacgtgtgttggacgtgtcccggagtggccggggtgcgtggccagcccctgccatggtggggaccttcagccggggaggggacgtgcactggcctgggggctcctaagcatctcctcgaggccacgcttatgacatcagaagcagtgcttgtggtgcaggtggctggagcaaggagctgcgtgctctgcagtgaagcaccaggcacctcttagaccacacacaggacaggcaaatgatgcgtcttggtgcttctcgaactcacctgctcccagaactgtcctcacactgtcttatggattacaggtaattagaggagagcagtttgttgtgttaaaacatgcaccccttcacagtccatgaggagccacctcaagctcgagagacctggctctccttcccagagcccccattttgaactgagtagccctgggccaacacctcccagaggctccagccgcccatctgggaccataaccaccaggccctgcacaggagcctgggaccatttggggtgagaccctctgacccagcactgctgccaggagggttagagatgaagaacctggggaaagcgtggactggggccgaggagagaccagcgtccacacgcagcaccacacaaagaaaaggtgtcgttgccatttctagttcacagtcccagcaagagtcacggcagattccataaaacactgaataattagcaattttatatacacatctgtgtttagttatatttagcataatataaaatcattagattatttcatatttagcctcccctgaggttttgcccaaacctgaattaaaatgagttttacttcataagcacaaagcagctggggcggggcagagatttcttaggagatgtgggagttcccatttctgctggtacgctggaagaaacaaatattgggactcaccctcattccaaaaacaaaactacgagaatatgaggacatagagataattttaacacatcagacatctggcaataattaaattattggagatcccaagccaagtgagagcaggaacccggggacatcagtggatgactgatgttggcctttattctgagaatcttctccacaccgggtaaacctgaacttcagcattcatgatcttgtggtctatagagggcaggaggcactaggaaatcctgatatggtaaggctaatagaagacatgccacatggagctgggacccccaagaaccatgactgcagggtaacggtgaccgatgatagagtgtcttctcagctctccattgggctggaggatggtaaactgcttgcgttcagcgctgttcctggatgtgtgtgtgtgtggcggggaaggcgggggtgggggggtggcattttcccttaggacattaaccacagccaagcttcacagggatgtacaatcccactgcatgctgcctggacagccacaacatctcaagcagggaattcagcttcaaacgctcccaggtgcacgggcctccagatgcctggcagagggaaaggcagatcctctctggaggaatcctttctttccccttctactcataaagaatacctgcaagtaaaattccaagaaatttgagtccacaataaaaaattttaaaacataccaggtaacaggacaaaagttaattgaaagaatggacaacaaaagaaagcctcagatattgtaactattggacatagatcataaatttaaatattttaatatgattaaaggaacataggaggaagctaaatataacctacagatcaatagtcttaaaagagaccacaatttttgaagaaatatattttaatgaaagatataataatagaaattctaaactaagggtatgagtttaatagcagattagatatagttgaagagagaattagagaagtaaagtatagaactaagaaattttctaaaacgcagcccacagagacaaataaattgaaaatatgaaagtaagggtaggagccatagagggcagagtaggagaatcttacctacaatgcataagtcttgcagtagagtaggaggatcttaaatgcagttcataagcattttagcagattaggcaactcttacacacgattcataagtgttccagcagagtagaagactcttacacacggttcataagcattccagaagcctatggagttcctaaggaaatactaatttaaaaaaaaaaaaggtagctacattgagagccaactttattgggaaagccattgccggggaagaggcacactctatcaccatcgaggatcatcttacacatcttacacatgatccatgagtgttccagcagagttagaatattacctacgattcataagtattctggcagagttggaatcttacatatggttcataagcattccagcagagcactccagaagtaatatttgaagatacagtggcagaaaaatttccaccactgatgtaagacaccagtactcagattccagaagcctatggagtgaaaaaggctctacacctcgattcctgacagtgaagttggagaatctcaaagacagagaatctctctgtttgtttaaaaagcaaaattttttgtctttttaaaaaaagcttacaaaattgagaaacctcctttgtcataagtgattttaaaaaagagaggagggaatcataaacaatattgagaattaaaattggaatgctaatatagatgctttggcatataaaagaataacaaggggtcatcatgaacaatttatggccatatatttgaaatgttagataacatgaccaaaataccagaatgaaaaactccaatagccctgtagccaaggaagaacttgagttaatagttaaaagtcttcccacaaagaaaatatcaggcccacatattttataagcaagttattccatacatccaaacacatgcactcatacacaaaacatcccagactacacagctcatgaggttagcataaacttgataccaaaactcagtaattacagtacagggaatgacaattagagagaaatttcctcaaaaacataggtgtaaaagccaaataatagcaaattaaaatccagcaatttatttttaaaaaatgtcatgagcaattaaagctgtaattaatgtagtctatcacattaatgaaaagagaaaaaaattattatctcaatagatacaggtaaaaacatttgctaaatattaacattcattcataataaaaatgttgaataaagtaagactagtttgttcttattttgattttttaaagaccctacagaaacatcatgcttcccagcaaaacactggaaatattctcttgaacaccagaaataagacagggatgtgggctctcacccttacaagcatttgtaggaggatccgttcagcaggcagtgaagcaggaaggagagataaagggtgcacttaggagagaaggagcaagcctgtcattattcacagacggcctcattatttactcagaagagacagaagaagatccaggtaaactaatggaattagatagtttaggaagggtgctgtatatgaaatcatgcaaaagtcagctgtatttgtatatttaggaaaaaaagttagaaaatgctgtttaaaaatgatactcatttaaaatagcatcaaaatttaaagtcccgggaatatatacatatgttaaatatataagacttttatggggaaaaatataaaacttaaaagatgttgaagacaataaatggagagatttacatgttcacagattgggaataatgatgctattaataacaatcaaacttctagattcaataaaattttaacaaaaatccaaaaactattcatttacaaacgtgacaagctgattccaaaatgtataagtacaaagagccaacacctgccttcgtgtgtagacagcataaactacttacactaaagtaagaaagatcacatggatctgtgcacggagagacacctgggccaggaacagagggaacccaggagtagacccttaaatagaactgattgataacagggttgacattacagatcagtgggaaggatggcctttacaagaaactttgatggggaaatggggtattcaatgagaaaaaaatgaaatgacctctaccttgaatcacatacaaaaatcagttcttcaatatcagacttacatgtgaaggacaaaaatcttttaggaaaaaaacagagttgtatctttatatagatatctttatatagatatctttagatcttgagctaaaggagaattttttaaacaagatgccagaaatgcaaaccttaaagaaaatgataaattagactgtattaaaaccaggaactttaagaagccaagccacaaactgagatatgatagttgcagcccacataactgacaaagttttggtatccagaatgtttgaagaacttctacaaagcagtaagaaaaagacaaataacccagtagaaaaatgggcaaaacaaaaatttcatgtaagaggaagcatgaatgatgaataaacatacacgaagatgcacaaactgatgaattatcaaagacatgcacattggaagcccaaggagatacaacgtaaatctaccaaatcggcaaagtgtttaaagcttaaaccaatgagcacacggagcactaggaactctgtgtgttggtgacaggagtgtaaattgatagaatccctttgggacatctatgtcttagtgattgtactggagaaaattctctacatgggcctggagacacgtgtgagaaggttcatggctatactgtttcagatatggagggaaaaataagaacccagtttcccaccggactgggtaagtgattggaaaaataaagcgtgatgctccatgtgtatagaatgcagtcacacagcaatgaaaatgcatgagccaccatgacatgcaaaaccgaatctgagtctcagaacacagggttagcagaagacggaaggcacatcacagaacgtgtatgttattatgtcatcttatgcagtattttgtttagggatacacacataggtgaaaaaaaaagtctacatacagaaactatgcacccagaattcatgaaagttattagctttgataggaccgagaagagctcacagagagtatcaaagataattttaatgttttatctcttttcagagtgtcaggtatcctggatgtttgctgtcttattattctttggaaccaacacatattttataatattctttggtatcttcctaatatttaatggaatataaatataaaatattaatatttttgaattacaaattaaccccaaaacttctaactttcaagagaaagtcatctgagttggtgagaggaatcatttccaggagcccgtgatatatacatgtttaataaaacactgaacgttatacacatgtcagtaggtgcacatctagtttatctccctaaacgtctttgctatttctatactaagcaggatgggaccctggctgttcaggtagaaatgagcgtctttgcatcgtggtaaatctctaagggggcatcttttcatcctggagatcaccgcattgcaagcccagtcaccatgcagacgtttctccatggggtgggtcttgtgggcacagcatcttgcctcctctcttccttcgggtggtcaggcatcagcccccgttcacgatagcacggagaccgatcttcatggatagcctcttcttggcttgctgtgccacagtgcctttggcctcaccgccaaagaagaaaagagagatgatgaacagcccacttccagcacaggcacaggcaagggcaccccccttctcttctccctctctgggaattaagctttaaatggcatctctggttttagtaaataattgtcaggaaagcagttatgttccagggttattttaattccttctgacagttagcaaaattaaacatccaaacattggggcaacatgctactttcagatgacttgatgtaaaatgattaacatcaaaacattttcttgtgttttgtgttgttgccgcgcagtggatcacaacacgttacaggaacgtgctctgtctgctgggctgatcgcaggggcgcacgcgcgctcgcacacacacacacacacacgtgccctgccgcatggcatctttctggctgtgttttgacacagtcagctgtgcatgggtttgctttgcatacaaacgatcaggttacaccacaccatgtgggaaagaggaagcgtccgccagctgtgcagaacggtgtacgtgtgtgattctgcgcccgttcctacggcgtacgtgcgtgatcctggacccgttcccacggcgtacatgcgtgatcctggacccgtccccacggcgtacgtgcgtgatccggcgtacgtgcctgatcctggacccgttcccacggcgtacgtgcgtgatcctggacccgtccccacggcgtacgtgcgtgatccggcgtacgtgcctgatcctggacccgttcccacggcgtacgtgcgtgatcctggacccgtccccacggcgtacgtgcgtgatccggcgtacgtgcgtggtcctgcacccgttcccacggtgtacgtgcgtgatcctgcgcccgttcccacggtgtacgtgcgtgatcctgcacgcattcccacggcgtacatgcgtgatcctgcacccgtgctcatggctggcagccggtattggaagagaatcatgagactgcaaatcaggaatcctcagatatccttttatcgttggctctttagttcaaaactagaactgtgggtgtggaaggtataggaaactccctccctgcaccactagtgagtgccaccactggtcttagtaatagaggtaacagtggtggcatgatcatcctagagatagtaatgctttaacgctgccactagggagttaatttgctcatgcttcctataagtcacttattcattccctcaacagataatcgttgaggtcctctaatgtgctggacagtgttctaagcactagggcaaatcctcgctttgtggaactgatattctagagaaaaaatagataataaccaagcatgcatcatgtcagagggtgataaatgttttgggaaagaatgaagctggatgagggcacagacaggtgatgggatgagggcccgatgttgggtgagaacaggaggaccatgcagatggctgcaggcaggcatttgagggtcaggaacaaacagcaggtacaaaggccctgaggcaggagctggccggggcgtcccgcgctgaaggggctgagcaggggcgagggggctgttggaggtgatgtcagggcagcagccaagggccaggttctgaagggccttgtgtctgtggcctggactgtagacctcactgtgggtgagatgcgccagcgcagggctttgaggagaggcttgagtgtgtgttgagtggccagcatcctcccccccccagtgtatagagtcagcccctgtccagctgtcgaggggcccaaggccagagggcaagtggcattccatgctgggcttctggacatttaaaagtctatgtgaagctcattagccgctaaaaaaatgcttcatactttgaaaaatatatgttcatagtgaaaaaaattattcaaatgtgcataaagctattgtttttatttctgaaaattaatccaatgaaaaagacagtggattggattataatcctgtgagtagtgatgttctctcgatgggctggtaaggtttggctgagtaataaattaatgacatacataattttgtaaattattgtatatttatttgtaaatgcattttattccccttgtttcatgaagtcactaattagattgtttaatgacgatcttcataaagttggggtgttttagacagaaatgattcaactgtaattgcacacagggtacaagatgtagaagtattttcattaaaaataaaaatgcacttaaaattgtaaactaaaactatgcttcaaaagctatttttcttcaaaaagatttaatgtgaattattaaaattctaaagccaaatataattcacaaaatatcaaaattttcaatcaaaagtatttaaatagagctgtattttaaattgtattttgtgacaatttaatcaaattgtagtccatatttttgtaagaataagacatttgcaattctggctctgagatccctgcagttgctgatgtcatgagctggttgcgtgagtcatgcatgtcctgtctcgacagacgtggaaaagtgaaagggattgtggggtgctgcggggcgcctccacatttgtccgtgagtacttctagagctgtgagccgacgtgcaaagaaacgcaagagtgggcacctggcactgccaggaacggatacttctttatgcagaaatcattggcttttctgtaacctgaacagcaggatttgacacgttcattaatttgtcttttctcctgcctaagtgcttctgctcttcaaacctccctctcccaggcatgaaaggcctcacgcaacacgtggcttccacagaatgcaggctgcaggggtggaggccctttcaaggctcgcatggcagaagtgctgggcgcaggggacatcatgctgcggctcggcctgtgcagcccctcccaggccgggcccggcaccatggatggaagagccaggcagcgcagttggggtctctgcaagatccagagcagagaatgagatgctggacgcacctggccacgcggagacgccggccggtcccatgtgcaccctgaggccagaacctgcagcctcaccaggcgcgctgtgctgtgtccgaggagaataaaggcggctctgcggctgtgggcctgagctcctggcaggctggggtcacgggggacagacaggcttggggaagtcggtgaggtcaggaatttgggtggagacaccattggacgtcctagtggaagtggcaagaagacaggtgggatatcagatccacagaaaggatggggctggaggaaagaaaatggctctgatcagtgaacagatgccagtcagggcctgaggactgaacacagcacatgggggcagaagagggtggaaaagagaagcctgaggcccagcccgggacaccccacacgcagcggacagggagatactgccacccaggacaccccacacgcaagggacagggagatactgccacccccaggacaccccacacgcaggggacagggagatactgccacccccaggacaccccacatgcaggggacagggagatactgccacccgggacacctcacacacaggagacagggagatactgccacccaggacaccccacacgcaagggacagggagatactgccacccaggacaccccacacgcaggggacagggagatactgccacccgggacaccccacacgcagaggacaaggagatactgccacccgggacaccccacatgcaggggacagggagatactgccacccgggacaccccacacgcaggggacagggagacaccaccgcccgggacaccccacacacgggacaaggagatactgccacgcaggacacaccacacacaggggtaaatgttcccgtggtgcccagctggccagtggccgcacagagctgtggcctggtcctctccgagcccacgttctcaccctcgggccacactgctcggtcacggggtaccccagatgccaccacacccaccttgaaggtggttttatgcttcatcttcccgcccccttggctgtccaaagtgtgacatcagcacagatctgagcataaaacactggtgacagcttccatggctgcttccaaacctttccaacaggtgtcagggtgtcaggatctcgggatctcaggatttgctgagtgagagtctttggttctgaaatgaagactgaagtgtcactgcacgtgtttgatgttaagacatgttagaggtcccagaaccaaagaagcttagagcagggccttctccaggaagcttcagaccctggcgagcccccagtctagaggggctcaggacacgtgggtccttcctaccctgcccctccctaaggtctccctcagcccctagcccatcctccacaccgcccgtggtcctgggagaacagcgtgtgccccagcgcccagagggtgagtgaaaggctcacagtgcacagtagtgagtgagaagctttaagaaggtttgcaatgtttaaaccttttttttttaggagttttaggtttggcctgagtgactggcaggctatttcttaaccttgtatgaataaagaccccattttttcatagaatacctattaccactgggagagcccagtccgggattgtccactccgagggaaggtggggcccctcatgggcctcacgtatggccctgctagagttcttttcagaaaacgacatggggaaagagaatgggctgaaataggaaagtatggacattgctaatttttaaaagattcctttacaggaattgtgatcagccctgcgaccaggtgggcctcatgttagtcggcgacacggcagctcgcctgggcccaggaggcctctgcactcccagtggctctgtggccaccctgggatgcccaaaaaggaaaggaggtgccggttgggaccagagctccaatcactgaatcaacttccttcaaagctctttccccttcctcttcccaggaatgacttccgctttaaggaaagccctcggctgggcaccttgctgacatgcacggggaatcctgaccagtggcttccagtttcaggaaggctgacctcagggcaggggcagagtccacagaggtccccaaattacccggagatgctgaccccctgcacgggggccctgggtggaaagtggcagcgttgaggcagcttgtttacggtggctgtgaggcacaggatgcaggtcttaccctaggggacgtcgtttcagctcggccagaaaccaggctccaccccataagggaggaggatccttcctaaggaagccagtggtgccgtccagaaagctggccaggctccaggtgacagcttcaccccgggcctgggtgctctccctcccctcccaccttctaatggagcaaagccattaagtgatccccattgtaatttagattacagaagagacttctgcacattctttcaggttaaaataacgaggataaagagagtaggcaaaattattccactgtagctgcctgcttaattatatggaatgctgcataaattgtcaagtgcaaagaattagtctgataaattaaaatactaattaaataggctattgcagaattttgagaacattatagggttccgcttcttcaggtaatttgcatatccttcatctagtgaatttaattttaaaggacttcttttttgtgtttggaaaccctttttgtctcccatgaagataaaaacgggctttctctgttattctgtgcctttattaaggcagcttctccaactgtctccacgccctggcctgacagacttgggaggcccagagcttggctcaaaacataactcagacctggcatttgatggacatctggctgaagcaggctttttcttcttttcctccttcaacatgttcagcagagacttaaaaattggcagtattgtcatggagttcataaaaaggaacaaaaggacactgagaatcagcaggtatttactttagacttaaaaggagtaggtgtgagtcctcagttacacaggtgtgggcaaaagtcccgcgagaggacggcgggctccccagtgcagacgtgtcaggatcagagctcagcacctgtcacaattccaccaacagtgtggaaaagggaatccacgcggccatttagagaaatccggcggagcatcaagggtgcaggaataatgtcgggaggtgtcgggggtgccctgagacccacaggatgccggggaccacgaggcattgtttttccttttaggcatatttgaggttaaaaaaaaatctgaagcaacaaaccgcagggctgtgctgcggaggctgcccttgtgccctggaggctgcccttgtgcagcgttcgcgatgcaggaggagggaggtgcgggcctctctgtgtttcgattctctctgccagtgagaaatctcaaagccagaaagtgaactagcaaggacaggcatcgctgaaagcggccggaacacagggccgcgtgaagtcagctgacgccccacagacactggctcgttccacagcgccaagggaacgcgtagacgcccccgaaaagcactcagcaatctccaaagagatttccctggcaagaagctggactctggggactccgggacccggattctgtgctttgtgagactccccggcacctgctcagggcactgtcgggctttccagaggatggtggagtttcttgacgtgagctggcaggttggatgtcagtgcccagcacagtgctggagggcatcactcagcagaccctgtgcagggccacgggaggggagcagtgacaccgggagcatatgggctctgagaagcggcctgcggagcccctgactcctcctgtgaaggaaccggcctgtgggggaaggaagagaccctatcttgggaaacaagaaatcaggagaatcctggtgacctttatcctattgctgtgggtgctgttagtggggcacacagcaattccactgtgggaggaagaccttgatagctgagtcacccagagcaaagtcgttgagcgatgcttcagctgatgtttgatgttcaaaacacaagcagaagcactgatcggcgagttaatagcataagagaccagagcacactggagtctcagacacgcagcagatacagcactttctccttaggaagtgacagtggcccggccatgagacatgcagcaaaacagccgctgtcacgagggcacatggattagtcgcttgctgtgtgctgagacctgggccatgctggctcagaggctcccacgtggtcctcacagctgcttgtgaagcgtgcatggaaatccacagcctggatggggagacggattgaagtgtgggaagcgcttgcgccggcacttggtgtgtggcaggaatgtagccactgccagcttcattacttttcaattattttactctgtgacttcgattttgacttacactgcagtctcagattagctcgagaatgaaactgtcccttgtactctcttaaaaccttttagtataaaaaaaaaaaaggaaaaagaaaaaaccaaacactaattcaggttgtttgcttcaatcgctgatttaaaccgactgaactacattttaaaaggtccagtcagtttcgagaggcagcaccgtggggcatgtgggagggttgtcggtggcacatctgttcacttatccgtatttttaattttcagcttttattttagaatctgggagtacatgtgcaggcttgtgacctgggtatactggtggtgctgaggtttggggtacacttgtgacctgggcatactggtgatgctgaggtttggggtaccgtcttgcttgctcccgtcttgcaggtagtgagcacgtcccccagagggagtttcagcccttttctcccacctccctctcacattccctctcacattccctcttacgtgtctgttgttcccatctctatggctgtaagtacccgatgtctggtccccacttccatgtgagcgcatgtggttctctgatgagtgtagttcccacttccgtgcgagagtgtgtggcagcgtgtggctctctgatgatgtctggttcctgcttccgtgtgagagtgtgtggcagcgtgtggctttctgcttttgcgttaatttgcttaggatggtggccccaaattgtgtcctttgcagcaacgtggatgtatttgttgaagaaagaacacaggcccctaagcatcaaagtgcagtcatagaccctgaagaaccttgcctgtcctggagaggctcacaatcagcttgggaggcagctctgctaggagctcaccacgatgcctgtttcactgacttggaagccatttctcagctcaggtccactgaagagcagagacggtgccgttgaaccacagcacgtgctttggaatcacctcagatgatcttgtatttattgaacaaactctctcagactcgtttatcagcctcactctcgcatcggcatctaaaaggagttttagtgatcaatgggttaaagaatcctgacgcgcgtcacactcggaacccctccactgagtgcctccacagcacaatgctggtccccacgtgctcttgaggccacggtgaggttgatttccacgtactctccagaccaccgcggggctggtccccacgtgctctccaggccaccacggggctggtccccacgtgctcttgaggccacggtgaggttgatttccacgtactctccaggccaccgcggggctggtccccacgtgctctccaggccaccgcggggctggtccccacgtgctcttgaggccacggtgaggttgatttccacgtactctccaggccaccgcggggctggtccccacgtgctctccaggccactgcagggttggcggcaccacacttctcatgagtgttccactgcagccaacaagatcatcctctgagtcactattggccgcagctgacgccctttccggaagttctgctgcagcgcgttcctggcctcacaggaggcccggtggaaagtgcttaagtacaaacaaggactcattccctccccaaggcctccaaggatgcaccttgctgcactgccaattcagggtggcgggagttgcctagtcactaccgtgctggcccgtgctgcgaccccacttcagctgggggaagtgtgcactccagaaccaaggaaacacggacaggaaggtcccacttcagaaccaaggaaacacggacgggaaggccccgcctcaggacccaggaaacacggacgggaaggccccgcctcaggacccaggaaacacggacgggaaggccccgcctcaggacccaggaaacacggacgggaaggtcccacttcagaaccaaggaaacacggacggggaggccccgcctcaggacccaggaaacacggacgggaaggccccgcctcaggacccaggaaacacggacgggaaggccccacctcaggacccaggaaacacggacgggaaggccccacttcgggtgtaaacaaagcactgtgccagcacaggggacagtttgcatccactcagtagaactaattttactttctcaggaattttgtgagcccattattcagtacagccattgtgaaacattgaatgataaaaacatgcacttaaataaactatgttaagagcagaggcgatccatactaaagctcaccattttataactggttttctacattttactgtcatcggcacccttgagattatttctgtcctccacgtctgcatggtgggaactcttccccgcacgcctgcaactctgtatctggttggttcggccccgccatgcctcatgttgaaattcggtccccatgtgtgactctgcatctggttggttcggccccgccatgcctcatgttgaaatttggtccccatgttggaggtgcagcctggtgggagggctttggatgtgggggagggacagatggggcggggcagatccctcgtgaatggattcatgccctcccagggtggaggtgagcgacttctcgctctcttaactcctgtgagagctgattgttaacaagagcctggccctccctccgccctctcctgcttcctctctccccatgtgagctctgcacactgcatggctcccttcaccttccactgcaagtggaagcagcctggggcatcctcagatgcagacacctgtgccatgcttcttgtgcagcctgcaggactgtgagccaaataaacctcttttccttgtaaattgcccagctttgggtgttcctttacagcaacacaaatggactaagacagtatctctccccattccctttagtagtgtcacatgagcactaaagtcaactgtgatgggagcatttacacagagcagaaattacccagtgccataatttacaattctgttatgcaggggacaggcagcctgcacaccatgaactgtgagacacagagggccgtgctgaggatgttgagggagggggtgcccctgagcacatgtagggcctgagcttcctgggaggaggactgcgttttcgtcagactgaggagctcagagcatcctggcaggggacggagaatgcctgaaatgtgctgaaaagcccaatatctgggcaaggagtgccacctggacctcagggccagcaaggcaagttctccatgcctgcaggggacaccattgaaaggctttgaagggccaccgaagtgtctggatttggagccagaggtctggatgttgaggtcaaggatggacagacacccttagactcactgctcgtgacaccctgggcacagtgtggagaatggactagagccagacaacctcttggcaaccacagtctgcaggtcaagtcaggcccactgtctgctgttgtaaataaaggtttgttggaacacagccatgaccatccacttaggcgtggtctgcagctacctccacgctgcaaggcagggctgagtagctgcgacagagccgtgggcctgccgagcctgacccagttgttacctgcccttcacaggaaaagggcgctccccggcagattggatttttctcattactatgggctggggctgccgttttcattcctgaccctgacgtcggtgaccgttctgcagcagtgaccagggtggttctaaggttgcatttgtactcactttctgttcctcagcctgcttaaaagagtccactattaccctcctgagagaagcttgccaatctgtcagatgtctcctctgtttgcgggaggacagcagcaccgatggccttatagctctcttgccacccaaggcttacatttgtgtcctcccctcccctggggctctaccccatcataaagtattaaaggagttttgctttagcccagactgttttctgtctgtcttgttctttcagcgcagtaggtaattagttatatgtagaaaatagtatgcatttgctcaaagggaaaaactttccataagacaatggagaggccccaacagcagggagggcaggctgtaacaagatctcatcgcgtccctctccgaaaggaataatttcattaccccagattaacacaggggcgttacaataaggggtgagagtaattgatattttcctgctatctcatcctgtattaatcacaattgcaaggcactcttcattcatagggtttgcagtgaaattccatttttttctggttttcatctccaaagtgacaagggctttatgcaaacgcatatttccacagagtcgtaagccaaggtcaattgccttgtgacacccgtcctctctgtgaagtggggcaggtgggtttgctgtgttggtgctaggattactggggtttcatttccatctgctaattgtttccagagctcatttcccttggtttgccatcgagtgcaattcattctctgaaagtcttcctcattctacatcaggagaaaaccagggtgaggcttttattggagcgaaattattataggatgttcctgtcagggcatgaacaagaggctgcaaaatagctggcggtgctgatggcagaaatacacacattcagctttgccttctacggagtcttttatcaacacctaatgctggttaatgaaacatatttcccagtaattatacagctagaaacgattacgtaattttaaaataagacgttgcagtttgcagaatgtctctacatatttctcatcagtgattcatagcagtcctggggacccgggtgggacacccctttctagatgaaaccaaaagcgcacagttgtgccggcccgaggtggacgcacactgggtcagtgggaaaatggggcctcgtgcaggttctaattctgtgcctgttcatgacccttccattaaggtaggcgggtcaagcagtcatgtaattgaaattttcaatggaggaaaatactcagaggtgcccggagactgaggacctctccaacctgactcttgtgctttctgatttttcctaacagttgacaacaaagacaaactggaggaaacctctggactgaaaattcttcaaaccggagtcgggtcggtgagtaacagaaggggtgccgtctgctctgcgatctgcagtgctgtctgggtgctggcgaacaccgtgagaacagaggctggacctgcaggttaattcagccaaggtcctgttttcctgggaggaccagtgggctgcagcaggagcatcctctgcgggtgggaaacggtggcgaaacgtgcctggcgagttcaatgatgtcttagggcctttgaagtcctgatttagtatccccacaagaaaaagcattcatggctaagaagaacggagaagccttcagaaaataggtgcttccttccttcttcagctgttttgtagttgccaagtgtgtgaaaatgaatatgggctagagggattactctttcctcctgggactcagtgggacatacttgtatcttcaatatcgaaggacgcacatttgggagaggcaatataaaacaggaaatgcttccataatatcactgaaaatctatcaagcccctgtgtgtgcaaaccttaccatgctggtatcagagaggcaatgcttccataatatcgctgaaaatctgtcaagcccctgtgtgtccaaaccttaccatgctggtatcagagaggcgctcggccagcctcctccagcagctggagccgcaggcgcctccccgcaccgcgccgatggccgctgtcccctgacatgacaacttaatgaactgcacacagagcgcggacgcgcctcctctgaggaatggcgtgtggccactcgtcagtcagtgtggaccgaagccaatctgcgctcccgcgttcgagatttcgggtttcacagcgctcgccattagagataattaactgtgaaggagcgcttatttatgagtgtgctcgctgcacagcagagccgccctctgcggagccacttaaagacaagctgcttctgtggggaaatctcgtcctcaccaggccccagactcgggctcttgaaataagaagctgcttaattggccgctcttcccaaacagaggttcttgcgcttcccatgcagagcctgcttaagaatagcctgaagggctttgaaaatggctgcgtctgggttaaatgacgggcagggtgtgggagaggagagcagccggcgactgatggaaactggcgtgcacgtcccggacaggtgctcctgttcttggtgtttctcgatgccttcctggctcgtgccggatgaatgaggtgttgggcagctggtgatgccctggtctttcccgggagcttgctgtctctttagcacccagtgaagggtgagaaagaagccaagagtctggggggctgccgagagccacctgcatcccacggaaggtgcagtgaccgatgcggaggggccaagtagttgcaaggtggagtcagccgggggtggctgtgaccgggccgtgagtctcctgcatgtggaagatgtgatgtcggaggtgcgtctcctgcatgtacaaggagctgtggtgtcctcctgtctttcctctcccttccgagctcatcacgtggggtggtggttggtgctaagtcattcctagagggataatggtgtccaggaatttgggacaaatctagatggactcaggttagagccatctctgtaacctggtcagagaacgcgtcgaggctgggaccctctgctgtactgtggaatatttaggccccgtgagaagcggctgtggtgggtggggaggtgggtcctgtggacatgagggaggctctgccctgagagggctggaggggcaagggtgggggacggggaatgggagactctggggttcatctgggaggtgacaagtgtggtgcctggtgtccagacacaccttcctcattgaaacctggactccggccactccagaaaagaggcaggacatggtgataggtggagccactgactgggcagctccagcccaagtggcttctgccatgtgccttgccacaggttgcctcttaagcatggaaggtcagatgctgttgtctacgcacacgtgagcctgggggacagcacctccccggctgcccactcacaacggagctccttcccacgcacacgtgagcctgggggacagcacctccccggctgcccactcacaacggagctccttcccacgcacacgtgagcatgggggacagcacctccccggctgcccactcacaacggagctccttcccacgcgcacctgagcctggaggacagcacctccctggctccccactcacaacggagctccttcccacacgcacctgagcctggaggacagcacctccatggccaccctttcaggacagagctgcccttcccacgctggaggagccacagggcctggtcgctgtggcttcagcctcccagctcctcctgtcctctgctgggcacttgtaatgtccaggcactccctgcttggatcaggggatctgggtttcatcttcccagctcctcctgtcctctgctgggcacctgtgatgtccaggcactccctgcttggattgggggatctgggtttcatcttcccagctcctcctgtcctccgctgggcacctgtgatgtccaggcactccctgcttggattgggggatctgggtttcatcttcccagctcctcccgtcctcccctgggcacctgtgatgtccaggcactccctgcttggatcggggggtctgggttttgtgctatacttggtgctccctttcactcaggccccttcttgactctgcagagctacccctcgccatctctttcacgcgggcctcctgcagtctctgtgctcaccctgtgactctgcttcctgtgttgtcaaatgggggtcatcccaggacccgcaccactgggtcgtgtgcaggtttctggggtggcagagtgcggatgagtgggcacgcgtaaacattcactctcattcccatcacggtcctgacgcctccacagcatttgattaggcagggttggaccttcttgttccatccaccctgtctcagcaccctctgtcgcgccttcacctctccctccctcgatgctacatgacagattatttcctgaaattgtctcccacgttccttcctcctctgtctaatctgctgtaaaactcaaatgctgggtacttttctcttggttactgtatttttcacttagaaaaaaatttttatttagtaatttatcaaatctgttattttgccttctactttgattatgtgtttgatatcttcttttatcttttcaatcattttaaacctacttattttatggtctcgtccagatcctctggcttattttatggtctcgtccagatcctctggcttattttatggtctcgttcagaccctctggcttattttattgactcgttcagaccctctggcttattttatggtctcgtccagatcctctggcttattttatggtctcgtccagatcctctggcttattttatggtctcgtccagaccctctggcttattttatggtttcgtccagatcctctggcttattttatggtctcgtccagatcctctggcttattttatggtcttgttcagaccctctggcttattttatggtctcgttcagaccctctggccgtttcctagtcttcgctttctacagctcctgctcatcacatctgctgaccccctcctgtgggggaggggtcctcttttgtggttgatgaagtctttttttagaattgtgagcttaccctcagcagggattggtgatactgaagtgtgaatttctatgtgagagtttctggataagaagttctgccctcagtgtcccagccgatccactttcctgtcaattgcccacctgggagtttctgcttcattcaataaagtgtggaccgtgctctggcacatgcacagatctggggttcagccccctccccacttccccagctggtaggtggtctgttcctgggcttcaatcttgagggaggcaggtcctcaaggtcctgggcttcatgtggagtccccatctccatccaccccaaggccacatgggctgtcctcgtgtgactataggaactcacaccccagctctcagcttccacaggaactcacaccccagctctcagcttccacaggaactcacaccccagctctcagcttccacaggaactcacaccccagctctcagcttccacaggaactcacaccccagctctcagcttccacaggaactcacaccccagctctcagctgtccacaggaactcacaccccagctctcagcttccacaggaactcacaccccagctctcagcttccacaggaactcacaccccagctctcagcttccacaggaactcacaccccagctctcagcttccacacacttggatccacagaaagatgccaaacgtccaggagccacttcagcagcagctcccagtcacgcccggttttgattgctcctctcagttttggagtctggagatccactttcttcctgtgctctcggctttgtgcccctcagagttgatgccatgcgtcatgcgggatttcgatgtgcgtgtgcgagggtccctgctcagcctcagtttagtgagctgttcgttcattcattcctaggtatttatatgcgtcaggcaggttttaagaactgaaactacagcagtgactaaaacagacaaacccttccatcacgagctcccattccaggtgaagctggaggtgtatcgaggaataaggcccattgtttcctctgaaggcagaacccagccgtcccctgcattgctttctgctctcactgggcgcgacggccatctctgttcccttcaagtcgaccagctcctcctccgtgagttctacagattggactctccagggcctggctccctcctcctttctgccggtgctgtctcctgtggggaactcacctgggccctggctttttatgttatctgttcgatgatgatcccaagcctacgtctccagccctgacccattcaccgagcaacaggtgtgtatggccacaggtgtcctccttttctctcctgggagatctgtagaggagcctcacacttaaagtgggccacgcagggctcttgatcttcctgccgcagcctgtttctcccgtcaggttttcttatctcttaatggaaatggcatcactgctccttgtgaagctctgtctaggaagtagattgattcaatgcatggaaatctgaattgctgctcagattatctgtgaagtggactatttaactctggaaagaattggcctctgcccactcctgatgcccacccatctcatatgtgggaaggaaggttctccctagactgcgggggaccgtgggggctgagggcagaggcaggagctcacctgcacagcaccacacctctgcttccatccacatccaacctgtgtcctctctggcccctgagcgagcagaggatggaccttgccattcccaggggcagaggctccgtcatccctgggacagaaaattaccaaacgctagagtgtttatttcacccactggttacgatctggccacaaggagctcattcaccctgacctgcctgtcttcctggccttctccagacatttctttgttctcgttccaccaaatgctggagaccagctcctggagcattatccttctccacgtggccattttacatttcaaaagatggttcttctcgagctcttgaccccacggacatcgtgcccagagggccctcaagcccagcatctgtgtctcctgttgccccaagtgagtgcagaaagcaatgcaggtgacggctgggttctgccttcagaggaaacaatgggccttattcctggatgcatctccagcttcacctggaatgggagctctgtgatggaagggtttgtctgttttattcactgctgtagtttcgggaggtttatatatttggagtagatttgcagtggtgaaaatgggagaaaggggtacaagttgataaattatttaacagctaatgatttttttttctaattttaattgccttattcagtattaagcctgaatttgacgattctgatttttaatgtatttaaaattcttctaatccctgactctggaatataaagcagagtttgattacagaaatctaatagcatttactaaatctctcccctgcgcttgcgtttaatgcaagtgatgacagatagtggaattaaaaccttttaagccaaatggaaatatctcaaaacaaaatttaaaggaaatgaacagattacagtgcagatacacacccctcatagatgggtggcattttgatgtatttcaaaatctaatttctgatatcttgaaaagtatttgcattttattcaaattaataaagccatgtttttttccaaaggaaagtgataatcaccaaaaagcaaaactcaaaagtttggaagaaaaataatttggataaaggcagatccatggctccaaccttctcagttgtgtccagagttaggggtgcgttctagcttcttagcatcatgatagagcagagaggtcccctgcccagcgttctagcttctaagcgtcgtgatagacacagaggtcccctgcccagcgttctagcttctaagcgtcgtgatagacacagaggtcccctgcccagcgttctagcttctaagcgtcgtgatagacacagaggtgccctgcccagcatgtcagtgagaagtggccgaccctgagtctcagcagagcccctgcaggctcaggagcgtgaacaagaggaatctgagaagaagctgaggggaagagctgctcagactgggggctgtctgggtggcaaagagccccccatctctgctgagggagccttctctctgtccagtgtgggatgaggtcagaggtcttcagatggttattcaaggagccctgggggctccaaggcagttgggtgtgaatccctgctcagctcacgctaccctcacactccggctcagcaaggtccaggcttctgttgcctgctgctcactgggcttctgggtgagactttgttccaagaaaggattctgtagccaagaatatgtggatcccaaaagtcccttaaaagtctatgaacctatggtcatgcatccaccccatgaaaaatgtgaatttgccatgatatgtgttacctgggatggggggtgggggtgtgagaatccaccccatgaataatgtgaatttgccgtgtgatgtgtgtgttacctgggatggggggtggggggctgtgggaatccgccccatgaataatgtgaatttgctgtgtgatgtttgttacctggggtggggggcggggggtgtggggatgctcagcacttgtcacagggagcaagcagtgggcagaactgagatgggtgacggatgtgttcgaaaccagcttcatttccccctgacttccaccctgtcatttcctgtctgtgcaaagaggtttgctactgtacacagctcctacccggttgcttggggattaccaagaggagcctggacattgaatgcagactttggccaaatcaatagcaggaacatatcagctgtgatggctcgacatggccatgcaccttctccctggggtcttgtcaagatgcagatttcctgcccgcctcaccagatgcctggttctgcacacccaggtgtgacccaggagaggacgggacagaggggggcctttgcccacaggtgaagagagccggagtaaggaggtggggaggtggggaggtggggaggagctgcccctgcttgtcagggtgacagctgttgttgctctgcggtgcccagcagcaggaccgtgcctttgtcaggcacattaaatgtttcaggtggatccaggtggatggatgaggctcttggctggaagaaatgctatttgggaaatgccaacaggtgaggtggagagctggcaagcagaccacttgcaaagggctctccagccaaaatgatttgtgtgagaccggaggccctgtggtgctgggggcaggtgaaatgtcagagctacagtggggtgagaaatccgtagatgttccaatcacatcctaagtctaaagtcctattattttgttgttgttgtttgagacacagtctcgctctgtcgcccaggctggagtgcagtggcgcaatctcagctcactgcaagctctgcctcccaggttcacgccattctcctgcctcagcctcccgagtagctgggactacaggcctctgccaccatgttcagctaatttttctgtatttttagtagagacggggtttcaccatgttagccaggatggttttgatgtcctgacctcatgatccgcctgccttggcctcccaaagtgctgggattacaagcctgagccaccgtgcccagcctgaagtcttatttttaagattagtactgaaggttgcttgagaacaacagttttggttttataaataaagaccaaatgtgataaaactcatatacgtacactccatggtaggcagggtgaatgagtctaactctttagaaggcaggacagcagtggtcatctgcaaaccaacaaacaaaaactcttcccctttggctcagtaatcaaactccgagaaatgtatcctaagaagacactccatccagcaaggaaatcagaaaaacaaaaccttcaccaaaaaaaaaaaactgacttaaaatataaaactatagcaaggtaactcatcattaacaatcaaataaatcaaattctgtgatttcatttaaaattttgagaactctaaacttaaaggcagctgtgtaaacatgtgtgtgcacagagatgttagaagcccatgtacgtaacaggtgaataagagagcagctcttatggggttgatggtggcagcagaagaatgacgaggctcgtaattgggaaaggagagctttattccttataaagagctgcatcctgcaggacagccaacctgaccagctgggaagcgtagcctccggccagaagccagaaacaggcacttctagtgagaggcaaagggaacaggaatttatgctgagtgggtggctaagtatacatattcagcaggttatgggaggagccgtgaatatttgtgaaggggagacacgggcatgcatggtcagctaatgtttgcaaaatgcatcccatgttcactggggcatggagacttaacatgtaaacagattacagttaggcattctgcatcaaaaggtgaagctgaggacatgaaggccctccctgtgcagcctccacagactagccagaggcactccgtgaatggggtctcttatgaggagggaatgctgattggttgttgggtcgaaaccataaaaggaagagcagtttcaggcacttggtggatatcaggaatggagtcttttaaaagggctggtttctgttcagccctcagagaaggaagcctggtggtgattagttgagaggggggcggtaaccaggcgggtctgaacccagggaaggaagcctggtgatgattaatgatgggggcgggtaaccaggcgggtctgaccttcatcctgtcacggtcccaactcagttttaaggtttctctggggtcctcttggtcaagagtaggtcattccgtcagttggggcttcggactttatttttctcagtggaattgcaagtgagttttttcctttgtccaaaagtttttatatgatttctgacttcttattttgaaaccattatagattcacagggaattgcaaagttataacaaagaagtctcatgtatcccttacccagtgaggttttcccctggtggttacgtctgggtaattataaaagccaattatggcaaaaccaggagattgatattggaacaatgtgtgtgtctagttctatctcattttacctttagtaccattttttacaacctaaataaagagaaaatatgtaaccaaaggaaaggcgtttacacacacattagcaaatgtggggacctgaggggagcagccaccatctgggacatggcggcccccgtcacccattgaccgtggttgctgtgggaaacgctcacagtaacgaaagtcatcagacatccgtgaagattctgcgtggcatggtgctgcgcataggccagtacatgacaaaggtttaaaatcactgctggcctttagatgagggcctgtgtttggggattcaagagaaggggcattggatgttggggggtgggggggcgcaggatgggctggtggggcagagagcacggccacacgttcctgatggggcccctggagcaggagcttggaggagcagctcccaggaggaagagaagctcacgtggtcagaggtaggtttgtcagaatggagcgaaagcggtgggttcagcagtatctgaaggaagagatcacagctcctgaggctctggacagtggatctaaaaagcctgaggtgtcagagttcacagggttccttgggtaaggtgactgagctgagcttgcgaaggtaacagtgcgtttgatggtaatgctgggtcacaccaaggatagaagcctggggggaccactgaaccctacatctcatgctacggcttgtccctagtgccggctcagcctaaagaaccaggctgcagtgactggggtgtaacactccagcaatctcagaccgtccgtgagcccaagaaaaaccagggtctctctctccagaaacattcactcacacccccccaagacagcgtgcgtttcagggagcctgtggcatctcaccccagaagcccaagagcacgtgggaagctctgccaagggtgggaggcagggggcggtggtgcctgtgtgggctcttgcccactcagtgcatgtggtgggctctggcagtactggggggagtgggtatggtggagagcaggtactggggggagcaaatactgggtggagcaggtattggggaagcgggtactgggtgaagcgggtactgggggagtgggtacttggggaagcgagtactgggggagcaggtactgggggagcgggcactgggggagtgggtatggtggggagtgggtactggggggagtaggtaatggagcagttactgggggagcgggtactgggggaagtgggtactgggggagtgggtactggggagtgggtacgggggttgggtactgggggaagcatgtactgggagagtgggtaatggagtgggcactgggggagcgggtactgggagcaggtactgggggagcgggtactgggggaagcgggtactgggggagtgggtactgggggagcgggtactggggagtgggtacgggggttgggtactgggggaagcacgtactgggagagtgggtaatggagtgggcactgggggagcgggtactgggggagcgggtactggggggagcaggtactgggggagcgggtactggggggagcaggtactggggggagtgggtactggcgagtgggtactggcagcagcaggtaatggggggagcgggtactggaggaagtgggtactgggggagtgggtactgggggaagtgggtactggggggagtgggcatcttttgtcatttcctgcactgtcactctattttattctaatatgcattagttgacagatggttttctcctaaatgcaaaagtgcctcagtcctaagaaaagcctgtttactggtaaatattcctaatttgcgtctgaaagggaaatctgcatgaaattgcattaaaatatttgcatcagcccagcccaggcagctctgcattcagcccatctgaggaccccagataagcctttggttggtgggaggtcagaggtcaggagcagccccttctctggtttggctctgtggtgaggacctcaaatgccccaggacaggcctgtcatgggtgggctcagctgatgaggacttcgatggccccaggacaggcccgctgtgggcttggctgtgtgacaaggacctcgaaggccccaggacaggcccgtcatgggtgggctcagctgacgaggacctcgatggccccaggactggcccactgtgggtttggatctgtgacaaggacctcgatggcccagacagccccaccgtggtgggcttggctctgtgacgaagacctcgatggccccaggatagacccgctgtgggtttgtctctgtgacaaggacttcagtggccctggggcagccccactgtggtgggctcagctgcaccccatcagcctgcttgctgcttactgctcttctcactctttttctatttctcaaaagtgaagaaaaacacaaaaatgtattttcgatataattaactgcacttgacgtattgacaaataggagttcatcatgaaacaacatcttttcctcctggaattgtgaatggcacacaggtttccacgttgcgctggctcacggatgccttctcaatactttcctgtgacttaaaggcaggagaggtgctgtgtgatgtggctgttgctatagcaacacattcaatttttattcaatatcagagtaaatagtcacataagatgaaataagtcatgtctgcctgtggcaacggcagtccctgcttctcgacatgcttccctccctccctgtgcccttttctaacattttcagctgcatttttataaaaatatgcataatatagatttcagtcgcagggacacggcttattgtctgaggtggggacttggtgatgtctcccgctgaagaaacggaggcccgccttgtgcctgggtcttagtggaaggcaagattgtccctgcaggttccctagggagcctggctcacgtggcaccaaagttcatttttatttaaacaactgaactctagggatgttcataaggtccctcagtgtgtaataatccagaaacccctttcagtgggtcaacccatcagacttggagttgcttaaagagatgaagaaaattaacaggatcctgcaccctgaaagctcctgctgcagctttttcagaacggcagcagcacagtggcagcaacagttgtgatgctcgccccctcccggggtgtgttccacacttcacatgcatgtcatctcccttgtccccaggaggcaacatttcacagaggggagactgaggcaggagaagtgacatggcagaaccggcagccggtgccagcaccaggcagcctgactcaggccaggtcgcactccctacactgagccccacatcaaattaagttccttttctcatggagattcctgaaagctgaaatgtccttagctacatctatagcacattcgcacctggtatactccatgaatatgaaacttttacctggcagagttcatgagatacaggtgggaaaccctaattttcaaccctggaattgtccagctagggacatggacgctgatgagcagagcccagaggtgtgtctgtcaggggaaactctcctgttggggccagcaggaggaacttggcttgtttccagcgtcaggcgggtgcatctgcatccccttcagggaccctccttctgaaagccccatgcccttctgctcaggtgcctttctctgcccaggtgggcatcaggtgccctggagaggctaggcctgggtggctgccaggatgcattgtgtccaatgcccccagcccaggcccacctgggcactgtggagtggaggaacgtgctgcaggtgtaagggcagccttgctcccgagacagtgaacatggagccaagcccaccctggtgggggctgtcgttccagccttgagaccgccctggcatcacattttccataatcacttatcagggcagccactgagcatccaggccaactcaggtaccccttttgcttgagccagtggcctcaagctactactctgtgtggggaagaaaaagtagtgtctctgttcttctgagttcctacgaggggtggactcctgtaacaaaaaaccgattcacaagagataaacaagccgaagtggattcacatgtgcacctcctgcatccatgagccatacccagagaaacgggtcaatcacaaagaggtgtgtagactcaggcttcagcaccatcatctgctgagacagagcaggaggagcaatgaggaggtgatagggtttggctgtgtccccacccaaatctcatcttgaattgtcactcccacaattgccacatgtcgtgagagggaactggtgggaggtcattgaatcatgggggctggtctttcccatgctgttctcgtgacagtcaatgagtctcatgagatctgatggtttataaagggcagtttccctgcacatgctctctcttgtctgccaccctgtgagatgtgcctctgaccttgtgaggccttgtgattgtgaggcctccccaaaaccacgtggaactgtgagtccattaaacctctttctttcataaattgcccagtctcccgtatgtatttatcagcagcatgagaacagattaacacaggaggggaccagagaagccggtcagcaagggcaaggcctgtcatgcaccctcagtcgagccctctgcattgatggggtttccagtgacgagagccgtcctcttccaggtgcagagaggagccacccttacaaatggaggactcctttataaacatagatctctcttatagaagagaatcaacttgttttcagagcttctcctatatcttcagtttctcaaaataatccttatgccaaaaaggcatacatttattaggatggtgtgttctggtctctgacagtcattttggggtgctatgttctggtctctgacagtcatttttggatggtatgttctggtctctgacagtcattttggggtggtatgttctgttctctgacagtcattttggggtggcatgttctggtctctgacaggcattttggggtggtatgttctggtctctgacaggcattttggggtggtatgttctggttttcgacagtcattttggggtagtgtgttctgatctccaacagtcatttttggggtgatgtgttctggtttctgacagtcattttggggtggcgtgttctggtctccaacagtcactttggggtggtgttttctgatctccaacagtcattttggggtggtgtgttctagtctctgacagtcgtttttggggtgatgtgttctgatctctgacagtcatttttggggtggtgtgttctagtctctgacagtcattttttgggtggtgcgttccgatctctgacagtcatttttggggtggtgtgttccaatctccgacagtcttttctggggtggtgtgttctggtctctgacagtcatttttggggtgttgtgttctggtttctgacagtcattttggggtggcatgttctggtctccaacagtcattttggggtggtgtgttctggtctccaacagtcattttggggtggtgtgttctgttctctgacagtcggttttagggtgacgtgttctgatctccaacagtcatttttggggtggtgtgttctggtctctgacagtcatttttggggtggtgcattccgatctccaacagtcatttttggggtggtgtgttctgatctccgacaatcattttttgggtggtgtgttctcttctccaacagtcatttttggggtgttgtgttctggtttccaacagtcattttggggtggtgtgttctgatctccaacaatcattttggggtggtgtgttctgttctctgacagtcattttcgggtggtgtgttctggtctctgacagtcatttttggggtgatgtgttctgatctccaacagtcatttttggggtgatgtgttctgatctccgacagtcatttttggggtggtgtgttctgatccctgacagtcattttggggtggtgtcctgacagtcattttggggtggtgtgttctggtctccaacaacagtcattttgaggtggtgtgttttgatctccaacagtcatttttgtggtgtcatgttctgttctctgacagtcatttttggggtggcatgttctgttctccaacagtcgttttggggtggtgtgttctgttctccaacagtcatttttggggtggtatgttctgatctccaacaatcatttttggggtggtgtgttctgatctccaacagccattttgggggtggcatgtttttatctccgacagtcattttggggggtggtgtgttctggtctctgatagtcatttttggggtggtgtgttctgttctccgacagtcattttggggtggtgtgttctgttcttcaacagttttttggggtggtgtattctgttctccgacagtcatttttggggtggtgtgttcttttctctgacagtctttttggggtggtgtgttctggtctctgacagtcattttgcggtggtgtgttctggtcttcgacagtcatttttggggtgaggtgttctgttctccaacagtcatttttggggtggcatgttctggtctttgacagtcatttttagggtggtatgttctgatctccgacagtcattttgggggtggtgtgttctgttctccgacagtcatttttggggtgatgtgttctgttctctgacagtcatttcagggtggtgtattctggtctctgatagtcaagtttgggatggcatgttctgttctccaacagtcatttttggggtggtgtgttctgatctctgatagtcatttttggggtggtgtgttctgatctctgacagtcatttttggggtggcgtgttctgttctccaacagtcattttggggtggtgtatctggtctctgatagtcatttttggagtggtgttttctagcctttgacagtcatttttggggtggcatgttctgttcttcgacagtcatttttggggtggcatgtgctgatgtatgacagtcatttttggggtggtgtgttctgttcttcaacagtagtttgtggggtggcatgtgctgatgtatgacagtcatttttggggcggcatgttctgttcttcgacagttgtttttggggtggcatgttctgatgtatgacagtcatttttggggtgatgtgttctcatctcctacattagaaactgatggatggtggagggccctagacactgggccctagtagctctttagtagtttacaggcacaaactttaccttcactttcattcctgtgaaacaaaggatctattaaaagtctaattagggttgtgtgtgtgcaaacccttttactgaagtgccaatctatttttttttttttaatgagatcataaagcaaaaagaacattcttaagaagtaactttcttctgttgacaagcacttggacttaacgttccacgaaaacaggaaatcctctcctttctcgtaggcagagacgcatccctgcagtcacaggggcttggcctcagatgtctagggtgtactgagggggtgttgccatgttgaccatgtgcgtcctctctggctgccacaacagaatactgcagagtggggggcttcagtcacaaacctttattgctcacaatcctggtggctgaagtccaagatcaaggtgtgggcagggctggtctctcccaaggcctctctcctgggcttcagatgccgtctctgcatcctcaagtcctcacccctctgtgtgcacctgtgtctgcatctccttcctacaaggatgccagtcacatgggatcaggctcaccctgatgaccacattttactgtaatgactcctgtaaacacccccatctccacataccatcatgacctcattttaccataatgactactgtaaacacccccatctccacataccctcatgacctcattttaccgtaatgattcctgtaaacacctccatctccacataccctcatgacttcattttatcataatgactactgtaaacacccccatctccacatatcctcatgacctcattttaccgtaatgactcctatagacaactccatctccacatacagtcacattcggaagttctgggattagagcttcccataggcactttggagagactcaattcagctctaaactctgaccctgttagtgtctcatttaactcagagtgcctttttatcatttgttccaaaagatagcattgggtcaagctagcttcagaggaatacatctatgccattttcctgcaccatatcaaacaataaattaaaaagtgaaaaattctaccaaggcaatcagggagagtgaattaatgaataaatacatgaataaaatttagcgcgatttttagaaggataataggatagttttgtccaaaaacccttcagatccacggttcagtctgagccatccagccatagcaataaagtaaaaattaccacatggtacaaatgtgtcaccgtcaacgatgctcagcgtggagatggcctgcctgccctcagagctggagaaggacgtggctgcatctgcctatgggccgggtcccttgggtgattttgcagggaggatgtacagggtcctccttctgccaacgccacatgatgaccaagactcacacctcccaggagctgccggtgccccctctagcacggggaccctaaaaaattcttgatgttgaagcaatataacttgtgttgcaattttacttctttggcagtgttgtcttttcctttgcgatgtatttcctgatagaagccttttcattttggtgtgcggcgggtagagtaatgaatttattttagaaatgtcagtggcattttatgatgctaccttcagcagcaacatcacagggcctgattgtgaagctgctaatttacagatcgtctctaagtgaacgcaaacaaattctggtcctcagagccctgctaatatacaatgttcaatttttaatttccagtccgtcttagattacggggatgaaaaacaatatttaatccctcgttaacacatgaataagcggaagctgtcattttcaaccagacaataacgggattatctcaaggactgtcagtttatgtgaaaacattatgttgcccaaattttcataaaaattagcagtggataatactcaagatcagagcaatggaaagagaaaaatatgcattcatggtaataaatattcatatttgtctgctcaggagatgaaaatctaatcaaggggctattgaagctctggctttttttttttttttttttaacaaagacgtttcatctaaattgggtttgatatggaaattagtctcactcaaagtcctccaggccacgagtaagccgggctcacgtggggtgaggtggccactctatcagatgtcgcttctggcatgggcctcttagacaacagccaccaatgctggggttcacactgtctctcttggttcagcatcctcagagtttaatgcaagggagtgcttggagccccctccctttttaaaggaaaaaaaaaatatgatttcatgccggttaactcccagctactgcagggttaaaattgtctgtgtttttgcttttgttgacaattaccataaatcagaagacactctgcatggagcttaatgaaatatgtatgattttaaaaagaaaagatgggagctgcaggacgttgctctgtgtgtgtgtgcgtgcacgtgtgcgtgcacgagtgtgtgtgtgtgcacatgcacgtgcatgcgtgtgtgtttgggtgtgcgtgttggggggtgtgttcctgctgttctcatggaggctgtgcttttcctacacatgggcaggcttgaaaacacagaatccaagagctcctcggtgagtaagtgtgggtgcacggtatcacactgacccttccagccccacggaatccgagagctcctcggtgagtaagtgtgggtgcacggtatcacactgacccgtccagccccacggaatccgagagctcctcggtgagtaagtgtgggtgcacggtatcacactgacccttccagccccatggaatctgagagagctcctcggtgagtaattgtgggtgcacggtatcacactgacccttccagccccatggaatctgagagagctcctcagtgagtaagcgtgggtgcatggtatcacactgacccgtcaagccccacggaatccgagagctcctcggtgagtaagtgtgggtgcatggtatcacactgacccttccagccccacggaatccgagagctcctcggtgagtaagtgtgggtgcacggtatcacactgacccttccagccccacggaatccgagagctcctcggtgagtaagtgtgggtgcacggtatcacactgacccgtccagccccatggaatccgagagctcctcagtgagtaagtgtgggtgcatggtatcacactgacccttccagccccatggaatctgagagagctcctcagtgagtaagcgtgggtgcatggtatcacactgacccttccagccccatggaatctgagagagctcctcagtgagtaagtgtgggtgcacggtatcacactgacccgtcaagccccacggaatccgagagctcctcggtgagtaagcgtgggtgcacggtatcacactgacccttccagccccacggaatccgagagctcctcggtgagtaagcgtgggtgcacggtatcacactgacccttccagccccacggaatccgagagcttctcggtgagtaagtgtgggtgcatggtatcacactgacccttccagccccacggaatccgagagctcctcggtgagtaagtgtgggtgcacggtatcacactgacccttccagcccctttaaggagcctcagggtccgtgctcttgagcactggccggcccagcacggggatccctggtgcatgaggtctcccgtggaccacaggccaccaagagggtatcttttggggaactgaatctttgctctcttacacttataaattcctagacagcaaagctgagatgggcttgtctgagcctcaggaaggaacacgggcaggcccttcagagtcagagagccggaacaccgccaagtagccttcgctccgcatcaagaacgcttcctactgacatacgcgggattttccttggggcgctgttaattatgttacagagctgaatgtttatattcacacacattttaaaatctcacccctgacatatttcctgttcctcttctccccggtcaagcagagctgatcgtgggatgttttgatgattttggcgaagggcttggggaatgtggtttctgaagaagacgtctctgagcagactccctcctctcctgtccctgctgctcccagctgtgcagtgcctgttcctgagacctggctctgaggcccacagggagggttggctgttccccagcccactgttaggaacaccttctgcaccacccaccaagacccgggctttgatgctgggtccagagacatcaccttcctctttgtgacgtgggcggggtgcacggaggggaggagagaggaccccgaggaaaccctgggtagggcactcggacctgggatccccgaggaaaccctgaccatggcacttggacccggggccccgaggaaaccctggcgctgcactcagatctggggtccccaaggaaaccctgaccatggcacttggacccaaggtccctgaggaaaccctggcgctgcactcagatctcgggtccccgagaaaactctagtgtggcactcggacccggggtccccgagaaaaccctggtgctgcactcggacccggggtccccaaggaaaccctggtgctgcactcagatctggggtccccgaggaaactctagtgtggcactcggacccggggtccccgagaaaaccctggtgctgcactcggacccggggtccccgaggaaaccctggtgctgcactcagatctggggtccctgaggaaaccctgaccatggcactcggacccggggtccccgaggaaaccctgaccatggcacttgcacccggggtccccgaggaaaccctggtgctgcactcagatatggggtccccgaggaaaccctggtgccacactcaggcctggggttcctccagggactgccacatcctgcaccttcccctgtgggtaaaggctagcgaggccgtccagggcatcaaggcccatttcagaacgtcgtcctcctggagggccggcgagctgcgtgtccctagtgcctcctgcggctcccagaggctcccccggcatgcccccgtgctggcactgtccccaggtggctgctggcacccacacagcagctgccccgaccttccctcttagaaagttctccgccctggggtgcaggggccatgtgaagccccatagagcaccattcccgctgcccccgacccatcctcactcttggggtgcagtgcggcctctcccagccccacgtgggggcgctggtcttcccaaggccaccctggtggacgtggaagctgctgattgccgccgtctgcctgccttggccgtctgtgcatcttcctgggagaaacgtcttctagggccgtttactcatgagaggacctgccaaggaactagattatttgtggtggtgtcagcatccaacagtacttttttctaaggaaagggataacttgccacaggaaaagaaaatgctgtggctttagacacagccacccatcctgtctccaggctctggtgacagactctgtcctggggccgctgctggttaattcaggcttctccatgctgggaattcgcttccagaagagtggcccccaggatgctttgccttcagggtcagccctgtccgccttacctcaggcccagcagaaatagcaggggatgggtcacaacaggagaccaacacaaaaacagggcttggatgagcccactcgggcacccagtccatggtccagggcactgaggtctcgtggagaggagggagggtgagcgtggactgcattgtttgcaaggagtcgtgaattctgacactgtccaaggagctgcaggtgctgccccagatggagacagccaggaacacctctaggccactgcagtggtgatggccaaggcatacctgccctgctgaccctctgcagccccgtgcctgccctggggatgcctggcctgggggctcggcccctcctgaccctctgcagcccggtgcccaccctggggatgcctggccttggggctcggcccctcctgaccctctgcagccccgtgcctgccctggggacgcctggcctgggggctcggcccctcctgaccctctgcagcccggtgcccaccctggggatgcctggcctgggggctcggcccctcctgaccctctgcagccccgtgcccccctggggatgcctgacctggggactcagcccctcctgacccccgaggcccaaggtgctgctgctgctgcagccaccaggggtcacacttgctcgcctcctgcacaggccatggccccacaatcagggctgcaagaagagatggagaaagagacaccttggaagtggctggaacgatctccctttggagtcaccctgtctgctggaattaagacttctgggactgcacagtgaagttcccggcaatgactcattttctgatattggtgcctgaattgcagcttccgtggctgccacttcaggaagataacgtgtgacccggagcaaggttatcagaaactgccgatagaggtttgccacctcccaccatgaatacggacgctgataggaggaagccctcacgcgctccctcggctctcacggaacgcctggaaactccccagctttctcttgtttgaagaaggagcccccaggagacttccaggacagcacggtctggaccgtttccaagccctttaggaaaactttgcagcaaaattcagcatttcgaaaatagtgaagtcaaggtgaccccgacacagcctgggctcctcctgggacatacttcctgtacggctgtcagaccacaagtctacccaagggcatctgtttgcctgtgagtgagcgtgtgtgtgtgtgtgtctgtgtgtgcgcgtgtgtgtgtctgcgtgtgtctgtgtgtctgtgtgcatgcacgtttgcgtctgcctgtgtgtgcctgtgtctctgtgtatgtgcacaagtgtgtctccgtgcacaagtgtttctctgtgtatgtgcatgagtgtgtgtgtatgtgcacgagtgtgtctccgtgtgtgtatgtgcacgagtgtgtctccgtgtgtatatgtgcatgagtgtgtctctgtgtgtgtccatgagtgtgtctctgtgtgtatatgtgtatgagtgtgttcgtgtgtgtgtgcatgagtgtgtgtctgtgtatgtgcatgagtgtgtctctgtgtgtgtgtgcatgagtgtgtgtctgcttgggttactttgctacctgcaagcaaacccctgccttgtgctgctgggtggcacggccttctctgcccccctccgcttctccccggaccccgggagctgtctgtggagcgagtaggaaatccccctactcacgagaggccgtgcaggtgaccccgaagcttcactgaaataaaagctcgagttaagggggacatgaacttccttgtgaacatggttggctggcaggaaggcactgtggctggggccatgtggacagaagcagaggcaggatcggggcagggcaggagagaggggacaggagggggcagaaagcaggagctgggtcaggtccacttcacctgcgtgtgtcacgttgaaaatgggctgagaggtgggcgaggccaagtggagcactgcagtccaggcttaggggctgtgatctgatttgcaggccatggggagccatggagtgttggggtgaagggagcagcctgcccagttgtggagggggaaacagagggaggccagaggcagactgagggccgcttcagcaccttccgcaggacaaggctggagctaggcagagcagcagagaggccagagaatcgttgcagaaggcctggtctgaagatgtgtgatgtgacgtgccaccactgagctgtgccaggcctgggccacctcactcccccgaggtcccgagagctcttcccgaggctgctcagggtcctgggactttgccggagttgtggcagacctagagccgtcaaagtcagtgggacaggaaacaactttccccggacggccctcctgccgtgccctgaagcccctcttgtgcccagctggtcgtccatccctcctcctccgctttccacctcctcttctctcccaggtgccccctgctgacctgtgcccccagtgtgatgccgagtgctgcgctctcctcagtacctgaaagcagggccctctgcccatcccagagaccagcgcaggaaattctgcttgaggacagtacgttctcctcccggcccccacgacgagacagaccttgaggacagtacgttctcctcccggcccccacgacgagacagaccttgaggacagtacgttctcctcccggcccccacgacgagacagaccttgaggacagtacgttctcctcccggcccccacgacgagacagaccttgaggacagtacgttctcctcccggcccccacgacgagacagaccttgaggacagtacgttctcctcccggcccccacggcgagacggaccttgaggacggtacgttctcctcccggcccccacggcgagacggaccttgcagacgctcccagcacatgtccttggcacacgtcggagcaaagcctcggggcgcggccctccgggggtttctccagggaagcgagcaaactgggaagcgtatcccatccagagcctcagacgaggtcaggccaggcggctgctttctttcctggtgcacattcatttattcaacagatacttgctcagcactcgctggtggcggaaacattggtggataaaggagagacagtcggagcctccccctcccacaagcagcgaggaagcaggacttcagggcaggcaagaggcccggtcagagggaatgaggcagaggtctcagtgcaaaatggaagcgagagcctaggagacagggctcgggtgagggacatacacggccaggggcagttcccctgttccgtggccagttcccactttccatggccaggaagctttgtggcttcctctgtcaagttctagtgcagacagaaaagtgtcccaggaagaggacaagcaccacctgggaaatgagtgctcccagcaaggggaggtggcctgcggacatgggtggcccttgaaggggagctgtggagaggcagcagcagacagggcccacacagaaagcacccgtcacccctctaccccgccaggaagctgaggaaactctcaggagccctgacagggcggggaggggacactccaaggaggggcatgtggactgagggcctcagggactctgcaccctccttctacctcctgcaagatggagcctgccccagttggacaggcggcctgggcgcaagagcgcctctcagtgcttagttataccgggaaaccaaggaggccaccaagtgtcaggacacagttacatgggcattgggtaggggaaacagctgtgaggacatagcgtgggaaggcactgggtatccatgtgtgcggaggcactggatatgcgtgtgtggggaggacactggatatgcgtgtgtggggaggacactggatatgcgtgtgtggggaggacactgggtatgtgtgtgtgggaaagacactgggtatgtgtgtggggggaggacactgggtatgtgtgtggggggaggacactgggtatgtgtgtggggggaggacactgggtatgggtgtgtggggaggacactgggtatgcgtgtgtggggaggacactgggtatgtgtgtgtggggaggacactggatatgtgtgtgtggggaggacactgggtatgtgtgtatgcggaggacactgggtatgggtgtgtggggaggcgctgggtatgtgtgtgtggggaggcgctgtgtatgtgtgtgtggggaggacactgggtgtgtgtggggaggcgctgggtatgtgtgtgtggagaagcgctgtgtatgtgtgtgtggggaggacactgggtgtgtgtggggaggcgctgggtatgtgtgtgtggggaggacactgggtgtgtgtggggaggcgctgggtatgtgtgtgtggggaggacactgggtatgtgtgtgtggggaggacactgggtatgtgtgtgtggggaagcgctgggtatgtgtgtgggaaagtgctgggtatgcaggtatgggaaggacgctgggtatttgtgtgtggggaggtgctgggtatgcgtggccacatcctgtgttctggagctgagtgcacatgtgtagacatgggtgtgtgtgcatttttgtgggtgtgtgggtgtgtaggtatttaggggtctgtgtgtgtgtgtgtatgtgtgcatatgtgtgggaaggcatatgtgtatgtatgtgtatatgtgtgttagggaaatgttaaccctaagacattactagtttataataggaaaaaatccctccaaaaataatactgtacctcaagcctttgtattacaaaaaaaaataaaaggaggagggtgaagttgtgccagtgagtcccggttgctcttcaggggccctggggtggtgtcggccaatagagacaaatgccattggcaaacacctagggtgcctcctacatcacagctgccgatgaacgcgaccttgagtccaatttagaggaagcttttggactctcacatcttacaagttctctcagaggtcacgcctgccctttcccataagcagaacaacccaaatcccccaggcccacagttctcatatgtcagcctgcatcagaatcacctgcagggcttgtaaacacacaggttgctggttcaccccagaacctctgactcagggggtccgaggcagggcccaaggatctgtgtttctaacaagctccctgggtgctgccagtctggggaccccactttgagaaccacagctttgagcaactgggcctccccagctgagaaaagaggaaagattggtgcctagttcagaaccgtcaactttggaagctctgggagccagcttcttcgtaaggaagtccaggcagccctgaggcccctaccccagctgtgcagctcatggcctagcgcccccagcaccagcactgcaagagccttcaggtcggggacatttcaacatctctgagccaggccatccaatccccaacatcgaacgcccaataaacccaaagctatctccacttccagagtctcacagaaagatcaacatcaaagtactttaagaaacagatgactgtggtgtgcagccccttacgcaacccaggtgctctgggggatcaaggtgggggtgcaggtgcgggaggctggcacgaggccatgcagctcctggccccagagcaggattcctggcggctcacaggcattactctgagttcagccagcaccccaagcagccatcaggcttgttatggaagagattctgaagaaggtccatggaaaatgtggatcatggaaaactatgcatggatttcaaaaatctttctgcaccaaaataaactcatactaacttgttgtaacatgtctgaacaggatctagtttaaggctaggaagagaatatatcagtttgaaaagagcccctatcagagcaacatgaattctgctaaaattgaaggaagaacaaacatcaaaattgtggtgaaacatgggtggaacaatgatgaagtcattgatgctttatgaaaagtttatagggacaacaccccaaagaaatcagcagctttcaaatggagaactcattttaagaaagaatgagatgatattgaagatgaatcctatagtggcagaccccctcatcaatttgcaaggaaaaaattaaccttgtttatatcctaattggagagaaccaacaattaacagcagaaacagcagccaacaccatagacatctcggctggttcagcttacataattctggctggaaaattaaagttgagcaaactttccactccatgggttccaaaaccattgcacccagatgagctgcagccaagggcagagctttcaatggaaatttttaacagcggaatcaagatcctgaagcatttccttgaagaattgcaacaggagaggaaacatggctttaccagtaccatcctgatgaccaagcacaaccacagcagtggctaccgagaggcggaaggggtcccatcgaagcaacagcagactgatcaagagcaaaggtcatggcagtagatgttgggatgctcaaggcattttgcatgttgactttctggagggccagagaaaaataacatctgcttattatgtgggtgttttgagaaagttataaaaactttagcagaaaaatgcctgggaaagcttcaccagagagcccttctccaccaggacaaggcttcagctcactcctctcatcaaacacgggcaatttagcaagagttccgatgagaactcatgaggcatccccctacagtcctggtttggctccttctcacttctttttgttttccattcttaaaatatatccagagggtacccatttttccttagatagtaatgggaaaaagactgcattgatgtggctaaattcccaaggtcctcagtgccttgggaatggactaaatggtgggtttgatcccttgcaaaagtgtcttggccctggtggagattatgttgagaaataaagtttatatttttatttttaccttttaatccaatttttctgtgaactttttgaagtccccttatatttgtctgctaactcaggaaaaatgtaaactttttctttactttggcattaagtgtaactctgtcatcaaatgaaattatccctaggaattttatatgcatggggataagtgagcggcctggagtccacagacctcccagcaggcctccaaggccctacccagacctcccatgctgggaggctctgcaagtacctaagcacacgcttaggaccctggcaaagttgaggtatcaggaaagatttgtagaaagaccttgatattttaataaagaaaacatcttgtcatccagggaaacatcagaaatttgacttgctcacacgcattttaaaacttagtacttacagatttggaattacacgtgtcagggtgtttcgggacattgggaagtctttatcccactggcctttatgaatcttcatctggttctacatggaactgagtccccaaacgactgtggtggcagaaagatggagggcgcgggaggcctggcctcaccactggtgctaggcaatgctaaatgggttgtgtgaccctcctggccttgagttccccaagactgaggtggcatctcagatgatcaagcagaattttccatgtcgagcatttcccagttaccagccacgcatggcccggagtgcacagcccagagggagctcacaatacaatgaagaacgaccgctgttgagtggatgggcgagtgggcaggtgggtgagggagggagtgagcaagggaaggcatagcccctcatctcgagggctcagagttatttccccggccagtcctcaggctgggaaatgggctgcacctttttctccatgtgtcatactttcttccctttaaaaaatttaaccagttcttggcattggtagttttgctaaattaaaccagggaggacctggaagacagcagcgcagccctgacactcacaaggccagtttcctccaggcatggttttaatccagaggctgggtctgctttcctacagctgggccatgagctgctgccccgcagagatccaatgtcctggtgtcctacgttcatcgtggagatgatggaaacaagctcagacaggaaaactcatcacttggcaaactccaggcctggggctgcctgcagagagccctgttcagatgggcttgccgagtcccagcccaccacctcgatgggaagcagttgtaggtgcaccactgggctgtcggagccatcgggaaaggaacccttcctgtgcctggccttaggataactgtgtctggacccacagcccacaccccactcgtgaactgtttcgggccctttctaaggtgcatgtgggcctcttgcccaggatgcgggctgggttcctagaggactcaggtgatcctacctgcggcagtgagttaatctccagggctcaggaggcctgctgtccagaggaagtctgggcagcttgggctggcgcaggcacggtgcccccagtcctgctcttgtggactctgggggcatgctgggcctgggcacacctccaccacgcctgcggccctttgctcacggactgtggattggatctgagcagtctagggaccagctcctcgggcccatgcagaaaggaagagaaggagtctccctggactggattctgggagggaccctcactctttctgcctgaatgaacattagtgcgtggacttttccagtctttccatctgttctgttttgaagtttattcatgttgatttacgtgaatctagttcactctttttgcctctggtgtcacccttcagtctgggcggggtggtggccgtgtatccagggcgtcagggacagggtggtggccgtgtatccagggcgtcagggacagggtggtggccgtgtatccagagcgtcaggggcggggtggtggccgtgtatccaggtggccgtgtatccagggcgtcagggacagggtggtggccctgtatccagagcgtcaggggcggggtggtggccgtgtatccaggtggccgtgtatccagggcgtcagggacagggtggtggccgtgtatccagggcgtcaggggcggggtggtggccgtgtatccagggtgtcagggacagggtggtggccgtgtatccagggcgtcagggacggggtggtggccgtgtatccagggcgtcagggacggggtggtggccgtgtatccagggcgtcagggacggggtggtggccgtgtatccagggcgtcaggggcggggtggtggccgtgtatccagggcgtcaggggcggggtggtggccgtgtatccaggtggccatgtatccagggcgtcagggacagggtggtggccgtgtatccagggcgtcaggggcggggtggtggccgtgtatccagggcgtcagggacggggtggtggccgtgtatccagggcgtcagggacggggtggtggccgtgtatccagggcgtcaggggcggggtggtggccgtgtatccagggcgtcaggggcggggtggtggccgtgtatccaggtggccgtgtatccagggcgtcagggacggggtggtggccgtgtatccagggcgtcggggacggggtggtggccgtgtatccagggcgtcgggggcggggtggtggccgtgtatccagggcgtcgggggcggggtggtggccgtgtatccagggcgtcgggggcggggtggtggccgtgtatccagggcgtcgggggcggggtggtggccgtgtatccagggcgtcgggggggggcggtggtggccatgtatccagggcgtcgggggcggggtagtggccgtgtatccagggcctcaggggcggggtggtggccgtgcatctcggggcacaggcactgcttctgaggagaccccagggtgtgtgtggcaagcactggggcgagcctgggactcgggccagacagcctcggtgcagaccctgagctgggcactcatgctgggtgcctgggagaatgcacaccagcctcagctccacctctatggacgtgtttcctgcagacctcatggttgtcatggcaagggctgagaggcacatgcgctgtttagtaggtcatgagcactgtgtgtatgtgtgtgtgtgtgtacacgagggatatgggtgtgatcgtgcatgttcgtgtgtgtacatatggtcgtgtgtgtgctcatgcatatgtatgtatgtgtgtacatgtggacgtgtgtgtgctcatgtgtatgtgtgtgcttatatatgtatataactctgcatatgcatgtgtgtgtatgtgtatttggatatgcacgtgtgtttgtgtgaatatgcaatgttgtttcctgctcactgactcttaattgatgaaacaaatgcccagcaggccaggatgggatttgagccccggctcatggtggggcctagaaagtgacgactactttccctttgcagaacccgggcctcactcaagtggtgtttgtgtagaaggaaaagaaaccacaaaggtgcatttgactcccattttctcgcatctgctgagagcgtattcatgcacaaaagggaaaggtccttgttctaaagcaggagagtacacgtggctgtcagaggttgcgcggcagcggggaaggaggccggggagcatctgtcagttgccgcaatgcaggggcgaggtcacagaacagagggtgtgctggctgctggggagggtgtggggctctggggccttgaccctgttaaccgtccaccctgccctcccgtctgctcctctgacagcagcttctggaggccgggcactgtggccaggctggcacaagtaacatcaggacctggggctgcagccccaggagggcccattcacctggctgtgacccacaggcaaataccgcacaaaacccgtggcccgtcttgcacacagaggccactggaaacacagataaggctgtgtgaactcatctctccactgtgaagacaacactgggaagacagcagatcctcctggcactcgctgagggtctccactgccctccagatgccgagctcccgccttccttcccccaacccccgacaggctcggcacagtcagaccagctttgcagggtccgtcgtggccccacggtgagggtcctgcttgcgagctgaagctgagatggacgtgtgcatgcatgaggatgagcatctctgtggtttaggtgaggtggggtcacccacctccaggacccctgactaataatagcgctgagattcaaactcaggtagcagatcagttaggatcacccaaacaagtggacatgaaccagtgggatgttcagcagagcagaagccgattcctcgttcatcccctggtgcaggactgcggaatgcgtcagctgggcagtgccaacctgcagcccctcaggggccacccccacagtgcccggctcccgtctcacctagggacctccatttcccggcagcagcacttgggaaggagcctgcgtgggccagacccagggagtgcaccgctcctctccatttcggtggccagagtcaacccccctgcccacccagccacacatgcacacacagccacgtgcccaggaggggagtgcttggatttgggcctatgtggcacagccttgggctggacctcagagacacaggtcctaccacgaccccacacaggtgcctgccagctgtgagcccttgtgcaggttgggggtcagggagggcctgagatggcggcattttatgcgggggcagaaactgcaggttcaggcacagaggaggggctgtcacctgccagaacatgcctccctcgatggtaccaccttggggcccaaacctgggtctcagacaagcactttgtcctgagatactgacgtctatgagcgtttgagggaatacgtgctcaaacctgacctcctgcagagaggatggggcagctggttcctggccgccaggctgcgtttcagcagctcacaggtgcataccacacacagccccgccgtggccagtcaccgtgggccagccccacatggcagcttccagaggcaccacagggtggcggccccagaccttggagaaagtggcacaggcaatgtaaacctttgcgaccccaccatcctctcaatctcatccccaatgcctcccctggccccaacaggacttcctcctgtcggcctggaaaactagagcccgggaggaacatctgcctaatacagcccatccccaggtgtcagcatccggggcccgtccccaggtggagcccgggaggaaacatctgcctgatacagcccgtccccaggtgtcggcatctggggcctctggatggtgcccagtgaacctcgggtgggctggaccctggatggggggacccagtcacagatctggatggtgcccagtgagccttaggccaggctggaccctggatggggggacgcactcacaccctgtgtgtgaacagtcgcttggaaggagcagcgatgccgggactcagcttttctgcatcttcagagcagctttcaaatgcttttggatcaaaaccacgtggccggcagaaatcgcacaattagcttcgacatagccgtggcttcgggcagggtggtcctggccagaatcacacatgcagagagcgtttttggagcctgtactgtctgctcaggctgccgaggcaaagtcccacagacagggcagcttaaatgatggaagtttcttttcacacggctctggaggctggaagtccgaggtcgaggcgtgggcagagcccgtttctcctgaggccactcccccgcctggtagatgccatcttcatcttcaggtgtctccacacgtgcacgtctgtctctgtgtccagatatccctttctgataaggataccggtcctgctgggtcagggtcgccataagagcttgttttaccttcatcgcctctgtaaagcccctgtctccaagacgccacacgctgaggtcctgggggtcaaggctgccacatgaacttgggggcgcattcagcccatcacagggccagtgaaccacgctgcagtttttaaagaattatatttatatctcaaagttttgaattacttttaatttttttcttttgaaaaccagttggtggtataaggtttcttgggcacaagtctggcccagccaggtgttcagcatcaactgtgacttcacaccccgagctagtagcatgggccaggattgaccctggcagaggtctctgagacgcgtcgccgcccaggcaagctgggaaggaggggaagacctcgtctccactctgcactggggcattgggcagcccactggctccgtgagacctgtaaaagcaaaggttttgtggcacagcaggccgagagggtgccgtgtgctaccctcctgcagacgtacatcagccacgtaaggcagaaaaatcctgtccaaaagtctgacagattacagcggaaccttctcaaggctcccagaccacacagcctacttctcctgtaagactgatcagagcgcttggagaatgctggtccatgcaaaactgaatccccaggtgtgtccagggccccagagccggagcacaggaggcactggcttggctgccgtcctttcttgtaactgcccaccaagtgccgcctgacgtgaatcccagcctcctcgcggtgccgtccgagctctgggctttgtgtgtgtcatgtccaagttgacaagtggctgtgctgtgagcgtcactgtcctcctccccctcatctttcaggaaactgctgtgactttaaagccggtcctcgccgcttcccgcacacctcgccgcttcccgcgcacctcgccgcttcccgcacaccaccaggcttgtgcttcccggagctgggtctgtgcacgtggcatccgtgcctctaaaggcgttgcaggccggtaagaggccctgctattttccattcatcccataagcgtttttaaatctcagggactgtgctcagcactggaaataatttctagaacatgattcttgaccagccaagcctgcaccggtggttccactctcaaggcattttaaagcaaggtaacaaatgtatgttgaccagctgggcacccatttctgttctaaaaagagagatgaatatcaatgttaaaaagtcatggatcctgaccccagttagtaaataatctagtggagaaatacaataaatgcacaacaattaaataagccggtggtgtacagcaaattagcacacgtgtgaaataagcaagacattctgtgttcagaagggaatcccctagccgtgggctcaagtctgtcagggaacttcctaacagagggcacatgagctaatgctataggctgaactgtctccgcagaaagatatgttgaagtcctggacctcggcagctcagaatgggaccttccgtggacataggactgttgcagacacagttcgcttggtgaaggaggcaccgtgctgcagtaggtccttgatgcggccatgtccctgcgacaggaaggacaaactccagcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcatccgtgtccctgcgacggagaggacagactccggcatgcagagggaagccgtctgcgtggctcggaggcaggagggaagcgctgtgtctgtgggccgagggctgctggcaacgcagaggctgggagtcaggaagggtcggtgtccccttcaaggccctgcagacacctccaagcaaggtctccaaacccagcctgtgagactgcaggcatccactgtttcaagcccatccgtctggagtcctttgttctggcagccccaaaagcctcacacagctcggctttgagtacagggagcgtgtctgcaggtaaggtggggaggccacacagaggcacagcggctgggccctgcaagactcagggagggcgggccagcatgtccgagggcaggaggcagatgccacagggcatcaccagctgcatgttgcacctcgacggcaaaacacagaagccactgcccaccgcagggagcgcagactgaagggacccgggctccttggccgagctccagccggaggtgcttccggtgcaatccaggcctctcatcctcccacggattccccacagagggcttcggttccattattgtatagacttcacgtatgtaaaaggtacaggaattcagcatttggaccccgtggggcagtgtcaccatggagcacgcacagggtgcctccctgagctggcacatccctggaggcatgcgtgcctctgccgacatcccaaagcgcccgtgctggggtcccacatggtgtccgctgtgccgtggggttcctcttccaacccccacaagaaagagaaggtcaccctgccccccacctctccacagctccctggactgggccacatttctttatcctcttcttggtttttaattaactttgggccagcccatctgtgcctgttctggactccagttttgacagctactgactgaattgcctggtcagttccgtgaaaaactagaaatagaaatgcacccggccagctgctgcctgagctgaccagccccggccgtcagtggccttccctggttggacggaccgtgaatgctgccagttctgtttcattttaactatgtgtatttgtataaatataagaaactgtctgctctctacccacagagtaattgtctagctctatcatctaattatctcaacacgtttagtgagcgagatattaaggcccagattagatattaaaaggcatcgttaaagaacagaaatgagatttgcatggagtggtatctagttccagcgtggaaacgcgttcacacagcactcaattagatatgtggactcagctctgaaacgttcctataggagaacaaagatgaaaattcattactacctccaaatactgccaactccgccatttcttttaaaactgcagtcttgggaagctccaagagtgttcgataataaccaagacgtggatcctgtgtgtgaaaagtggcccagctcctggagaggcgcgaaggctgtgggtggactgtggggtgggctgcttctctggggtcacgtggacatccctagagagagtcttggcttgggcaccaccctcaggtgtgtgtcctcaggtggcctgactgcagtgacctctgaaatccagggtatgcagagatcgcaggctgtgggccctgccaccacaggctggggcctcagggaattgggtctgggtcgttgcaagtctcgaggctcccccagtgggctgctgctccatagcaggctgtccccactctgctccacaggaatcacgaagccgcatgctgtctctggggtctgtgctgcagagctgggggctctccctgcaggagtgtgtacagtggctggggctctccctgcaggagtgtgggtggtggccggggctctccctgcaggagtgtgtacagtggctggggggctctccctgcaggagtgtgggtggtggctgggaggctctccctgcaggagtgtgtacagtggctggggctctccctgcaggagtgtgtacagtagctggggctctccctgcaggagtgtgggtggtggctgggggactctccctgcaggagtgtgggtggtggctggggggctctccctgcaggagtgtgggtggtggccggggctctccctacaggagtgtgggtggtgacggggctctccctgcaggagtgtgggtggtggctgggaggctctccctgcaggagtgtgggtggtgacggggctctccctgcaggagtgtgggtggtggctggggggctctccctgcaggagtgtgggtggtggctgggaggctctccctgcaggagtgtgggtggtgacggggctctccctgcaggagtgtgggtggtggctgggaggctctccctgcaggggtgtgggtggtgacggggttctccctgcaggagtgtgggtggtgacggggttctccctgcaggagtgtgggtggtgacggggctctccctgcaggagtgtgggtggtagctgggaggctctccctgcaggagtgtgggtggtggctgggaggctctccctgcaggagtgtgggtggtgacggggttctccctgcaggagtgtgggtggtagctggggggctgactcagagaaccagcaaaggccgtgtttcttttcaggccccccgacaaagggctcccttccctcacaaggctttctcatacccgccgtctttgagtacgtgtctgttcctgatctgagccactggggccaggcctgctgtgtgggcacacgtgctcctggcagacactcctgctttgtgattccacccccaacctcgggatggaggtcaggaccacgcctgctcacatctgtttctcaaacgtctagtgcgggcgcttgcacgaagaggtgctgagacgtgcctcacaggatgtggaggatgaccagttatggacggacacgtggcgcgtcagggaaggctccggaaactttgctgtgtgaacttttctactcagggcacggacctcagagatggatctggttgtcatcccagatgaggaaacaggtcaggcggatgatgcagaaggagctgtgactccccggtggccactggtgggtgtaggagcctcacctggcatgagtaggagcagccacaggctgtggggcgggcaccctctaaacagagccctgcagaaggggctcctccatcacgcgccgagcctgccacacagaggagaggacgctccggagagagaggagcgcagagcctgtgcagatctgccatctcctcctccctaggggatgctcctggcccttgtgtgggtgaacgggtgccgtgatgtggccatgaggcgcacggacctctggactcaacgtggcctctccataggcttgagggaaaacagaaacggtgaaatcaactctccgccccacacgggcccagcttcagtgttgggcacagcagagccccagcttcctcctgcagcatccccctccctccccttccagcgtccccctccctccccatccagcgttcccctccctccccctccagcatccccagctccaccagcaatgccgatggccatgccctcgtgctgtggccccggctgtgactcccactcatggcgcccaagctgatggcactgcagctttgcaaacctggccacctcccttgtcagcaatgcttggaagataaatagaagatgctgctaaaaatttggagaaaaatttgagaataaatcatgagccgtggaagtctgctacacagttgggtgaatgtacaggttgttcaaacctttcttggtgtacactcattgctaagcaatacttaacaggtcaaaaaaagttttaaaaattggaataactatggatgaagtgaccactttgactgacagacatacgaaaaagattctgggtgaggtgagggaaccagcaggtcatatgaaatccaccccacacatcattgcagcacagcaaggacctgaagctcagtgtgcaagaagtgaattttgtatgtttaatgtattttgtcactttatccattttataaaaatgagacctttgcactactgtgagttaacctttgtgatacattttgtaataaagccaggagaaaccagtagaactgtgtgccacacacggcttgctggttgtctgcggcaaactcatgtaagagggttgaaggctgagcctcggaggcaccggcctgtggtgggaacgggacgccccagcaaacactccccagtaaaataaaccttcagtgtaaaatagacatctgagctgtgtgtgagaaaatgtgtgtgcttgaaaagcgaaaacaaaaaacagccagctgtggcacattttgaaaatgaatatttggaaatagtttcattgccgtgtgaaatgtttcagacaactgggtctcctataaagtcatccacagtcacgactctaaaaagcatggaaatgacattttctaacccacttcacatctttccaaatgaaatgtttccatgggttgaacatatactgaaattattatcataaaaatccaagacatcccaccgtgttaaaaatggtgccgagaatcaggcagggaggacaaggcctttgcagagctggtgagcaggaccgggacggagactccacggttaagcagcacagctgacttcctccacccggtccgccgtgtggggcagcttttcagctgcaggagccttaaatcaagtactgagataaccctgcacttccggccaggcctccagtgacctgtagggcaaaatatcaactcagtatcagaaaaaatgatggtgccgtgcagttgggtggctgtccctgaaataatcaccagagtacttttagagagaggaaagttcattaaatcatagagggcgttagtttttagatgttcatttcatcttttcctcatcctctaaaagtgactttgtatcgccgcccccctgggcccattcagtggctttcctggctccggctctccctcggctcagccacaggcatccctcagctctaacgctcccgccgggatgtgctctatgcagtgagggctattcctgacatccccccttccagggaagccccatcactacatcacagcaggccgcatccagattatcctaattagagaattacttgtatcaagtgaatccccaaaccactgtccagggtcgctgtaggagggaccctgctggccttgagctccccaagaagcggcaccactcagcgtttagcttcaaaaggtccccagaggtttcgtgctccatgggtttgtttgttgtttggaaactgttgttaaaataatcgttattaggtgaccccaggaaacttgttgctcaggtgtttgagtctgtcacttaagaggccgagctcgagaagccggcgcgtgggttggggccgctccctgggcgtccgcagagcacgagagtcagcaagccccgcacacacgcctgcaatggtgcagccatcctccccgatccggccccacacacacccctgcaatggtgcagccatcctccccgatccggccccgcacacacccctgcaaccgtgcagccatcctccccgatccggccccacacacatccctgcaacggcacagccatcctccccgatccagccccacacacacccctgcaacagcaaagccagcctccctgatccagccccacacacacccctgcaatggtgcagccatcctccccgatccagccccacacacacccctacaacggcacagccatcctccccgatccagccccacacacatccctgcaacagcacagccagcctccccgatccatacctttctcagggcctcagcagcccccaaggccccgagggacatggcagcctgctctgtgaaacgtcctgtctgttctgcattgtcctgggcctcctcccagcccttcccacaacgcccaggccagctccaacagaggggaagttggccttcaccatccagcgaggcagggtcctggggtcgggcatctttgagccaggggctggggcagtcctgacagctccacccgctcatgccatgccttgcagcctccctgcccgtccgatcgcctgagtcaggcgtggtcctggcctctcttgccccatttgttttttcaaaaacctgcaagcggaatgctgctgcttccgtcttcataggcacagagccggatttaagaagaggaactgtcttcattttgctcaaccacaagggcagtgaccttgggttcaaccctgggcctctctgactgctttcctggccacggctgctctttggccccatgaggagccacgtggacgtgggtgtgccgattgcacagctggagagacgtgggcagacaggctgggactgaaggtttgtcccagagctgagggtggggcagaggcagccacggtatccaggcttctgagcccagcccttgccttcatgtcgggggatgacagtctcgccatcagcagcacccaatgtaggccctgtccagggagtcagtgctgcatcatcagtgatgggagagggaggcggaggcagggaaatgcacagagccagtggccttggctgctgtgacagcatagcagacggggcggcgcaaaccgcagattcatcgcccaccactcacaggctgggagtccagggtcaatgtgtgggcagggctggtttcttctgaggccctcggagaagaatctgtcccagatctctctcctcggcttgtgggtgccgtctccgtcttcacgcggtgttccctgtggctgccccgtgtccgcatctccgcctttgataaggacccccgtcttgttggattagggcccgccctaatgacctcattgaaacttagccagttacctccacaaagaccctattccccgataaggtcacgtccacaggtactgggcttagggcttggcatgcgaatttggggaactcaattcatcccaaaacacggggagtatctccctcagacctacgggcagtggggcgtggagcatctccgcacgtgtggctcggttgttctacatgatgcaccagttccgccgtggaggaggctcctcggacagttcccttcctgagcgctcagctcttgtctgctccaaggtcaggccctgagaaagtgccccaagaccgtgggcctgggagaaagggtcacggggcttgtgctggattttgggacttttctcttcagcctgtacacaaaggttacacacaaagaagacggcaaagggaggtgggggggtggggagagggccagacagaggcaaacatggttctccagggtttaaagtgggcacggtgcgggatgcttcctccctggctggagaggatccttacctccagtggctctgcgggccgtgcctgttgagaagaaggctctgaagttaccccatgccacaggcctttccgttgcaggcccggctcggccgtcatcatgtgagcgtgagcctctgggtctccatcttgctcatgcccctcatgactacatgactcctcggaatgcaaggggcagtgtggtgttgccagtgagctgcttctcgtttcctaccaggaatcacacatcgcatccgtgtgagtacaagaaagacccaaatacccatccactgcctgccgatctggaggcggagagaggacggccccagagaccatccaccctccccattcacccatggtccacacagtgatgggaaaccacattccaaaatcaacacttttccaaaacagtgggcagaaaaagctggtggcatggccactccggacgcacatctcagagggtttgctgctggcgcttcagggtccactgtgctagtatttttttttttttttttttttttgagagacttgctgtgttgccgagctggagtgcagtggtgcgatcttggctcactgcaacctctgcctcctgggttaaagcgattctcctgcctcagcctcccgagtagctgggattacaggcgcccaccaccacacccagctaatttttgtgtttttagtagagacggggtttcaccatgttggccaggatggtctcagcatcttgacctcgtgatccgcccttctcagcctcccaaagtgctgggattacaggcgtgagccaccgcacccggccagtgtattttttaaggaagcaggagaaaacaaaatctgaaaaatataaacacttttattttaaacacacactccttcaccattgaatgtgtttttaagatcaacctatttaaactttcaatttaaaaatggtcgtctgttagagggtaggagacttggcttagaaagcatttgattaaaacatgcagatctccattctcagcttggtcttctgaattttgttaataaaattatttccatggaagtgaacctcattctactttttttagtcaggttatttaatgcttgttttcataattgttttcaacagagatacacaaactgacttttaaaaaaatactgtgccttcaggtgaaagcttatataattgagcagagtttgccaacattttggaacttttttgacaaaataattcccacataaatataactttccttggttctgttggctgagaccctaagtcatttctggcgtattttaaaaatccagactcctcggcgggcaccgctgcaaacagacccgcctctaaggctgataacgtgaaggtgtcgttttcaacacaaaaggctctgcacagagggtttttcttctgagcgggtggttatttgagtaacacgtcctcttgtcaatctttaggaaaacgggtgttgcccgcagcgaggtgggcggaggcacaagtgagctgggcccggaagaggctgttttgttcagtggtagggcaggcgcgggagcgctgaggctttgtgccaaagagaaacagaaaagaaagtttgccatgtgagcgtctcacatcactgtctgccaaattccgcatgtgagagaaggctggaaggaccacactgttacaggagaggctctttgcctccacacggcctgattgctcagggattttgttagggtttcaaatgtggagagcagaaaacactcaggcacctagagctgggcggtctctgcagagcagggacacaaggtgcccttggcgggtgtgccctggccagtccctccctcgggatatggacaatctccatctcccatactggatccttcaccctttcttacagcggatagggacgctggactgaggcaggttctgtgcccggaacctcagtgatggcaaagtcgctgttccgtgcaccaggagatgacagggaggggcctccataggttgggtttcagagactttccatcagactatatttgtattaaagaaagcgcatttttattcatgagccatatttgtatgaatgttcaaatgcctgttatgattattttgagaagttaagggataatttagattctctgctgatattcttgttattatttaaacagtgcatttgctgattaagcattaaccgccactctataggaggcaggaacccaaacagcctcgttaagggactgataaaatgcaccctcgttagagaaccctttttgggggttggtaattatcacagatatttattaggcagaaaggcacaggagcggctggaggctgggtgagtccggtgtgcggggccatgggacagaaggcccagcaggctctgcacggtacctccctcgccgccttttgttcgacagcccgcccattccgctgcttttctcttccacccttcaccccagcaagaactcgctttgctttgggtaaaccaagaatagggaagatctgaaaaatcctaatttgcaaagcatatttcagagatgaccattcgttctcccacatgaagattgtattttacacattgatgtggcacagcattcctgatcccgcatgaatttaaagttggtttctcccgtcaactctaccgtggccgcttgtggtgtgaagaagcttccgcctccatgccccagcctgcacctgccctgcaggactcccaggaacctggaatcccaggctattctacaccttttgtctgtcaaggaattggagggtccaggacccaccccctggcctcaaaacagactcatattgtggggagctgaataagttagtctgtggatggtttgagaaaggagaattctggatttggtggatgtgagatggtgcaggactgtctgtgcttctttctcacagcttccttgtggaatatgtagtctgtggtgcacacaccaggccccgggagacctgggatcccttatgcgagcgtgaggcaccccacgtcggaaattcggatacctgggatcccttacgcgagcctgaggcaccccacgtcggaaatggaaattcggagacctgggatcccttacgcgagcctgaggcaccccacgtcggaaattcggagacctgggatcccttacgcgagcctgaggcaccccatgtcggaaattcggagacctgggatcccttatgtgagcctgaggctccgcacttcggaaatttggaatctgaccacatcatgtttctccccagttcctcaaaggcctggaaatgctggtgttgggtggagaggggataacctgagctctgtttgttatgaatgttctcttttcctcccataaaagattttcaagcaaatttgatctggcaatttatttaaaccaaaagcatatgagtagaaagtggtataaactgaaataaaaaacgtgtaagatgctccaatccttggaagaccatccctgagggacggggagcctggctatctcatgtcgtccccagggcacggcacacacgggccccagctgccatcagggccagcggtgaagggtctgtgccgtcttcccctcctccatggtgatcgaaccctaagtttagctaaaataacacgtttggcctcccctgtgcttagatgtggtcactgagtgagacctggccatgagctgtggctgtacagtactctgggcagaaaggcttcttgatgggaaatgacggccacctggatagtggatcctaggctgatgtggttcccgtaaatgtccctggccaggatgcgggacccagactgcccatttagatgggttttgtgtgggagggaagaaaagcctcaggtgttcacaccaaccttgtcagaagttttctgttatatgcagctgaatttagtcctaaacagcacatcttgtcagaacccaggggttggcccagactggtcactctgagtggcgtggggctgcagcagcatctcgggaagggtacaagcagtcagaggaacggtggctcagggacctgggagaccttctgctgagcttccttgctgaggtgtgaccctgagaggacgcacacccacatgagcctcggccccgtcgtgtctgacatgaatcgcaacttccggatggccccagctcacacactgggaatgacggtggcctcatgctgcctcctccatcccagcctgggggagaaaggcactgcgaactccagctttctgcctcttcggtgggaacagtgggtgtcctcttgctgtgttaaatttgatctgagctgagggaaacccgaagaatcagctccatcaccctggagaccagcgtcagcccggccggtgggaactgagaaggacctgggtgtagaggtgctggggtcctggacgccagccacgctgggaccgaggggctccgcagacgtcatcccaagacccgctattggttcagagcttgtggatcaggaccagagccagtcctctcattggggcagtgagagcctgacatatgtccagaaggcagcccctgtgatcctcccagggtggcagcggccaagtgagtggtccagggcacaccgtggtgcacacggggcttccctgggtctgggactgcagaggcgtcggggctgctggctgcaccactatagccgtgggctcactgcagggtgcgggccaccattcaggacaagcgttcctgtggacgacctgccagaggtggcagcctgcggacaggggccccactcacttcagctctggcttacagaaccttcatgggatcccgcggaagccgtcatttctgtcaggtggggccccattcactcctggcaagctctgtggcttcattgactggtgggagcattttgttgcctgtaaagccaggaactgttgcccatctcacagcagtggtgcaaatcaaacggaatgagagagggctccgtaaatatcgggcacacatgacagagtgagagagggctctgtaaacattgggcacgcatgatgcagtgagagagggctctgtaaacatcaggcacacatgatgtaatgagagagggctctgtaaacattgggcacacatgatgtaatgaaagagggctctgtaaacatctgtaaacatactgcacccatgagggagtgagagagggctctgtaaacatcaggcacacacgatgtaatgagagagggctctgtaaacatcaggcacacatgatgtaatgaaagagggctctataaacatctgtaaacatacggcacccatgagggagtgagagagggctctgtaaacatcaggcacacacgatgtaatgagagagggctctgtaaacatcaggcacacatgatgtaatgaaagagggctctgtaaacatctgtaaacatacggcacccatgagggagtgagagagggctctgtaaacatcaggcacacacgatgtaatgagagagggctctgtaaacatcaggcacacatgatgtaatgaaagagggctctgtaaacatcgggcatacatgatggagtgagagagggctctgtagacatcgggcacacatgatgtaatgagagagggctctgtaaacatcgggcacacatgatgtaatgagagagggctctgtagacatcgggcacacatgatggagtgagagagggctctgtagacatcgggcacgcatgatggagtgagagagggctctgtagacatcgggcacgcatgatggagtgagagagggctctgtagacattgggcacacatgatggagtgagagagggctctgtaaacatctgtaaacatccggcatgcatgacagagtgagagagggctctgtagacattgggcacacatgatggagtgagagagggctctgtagacatcgggcacgcatgatggagtgagagagggctctgtagacatcgggcacgcatgatggagtgagagagggctctgtagacatcgggcatgcatgatggagtgagagagggctctgtagacatcgggcacgcatgatggagtgagagagggctttgtagacatcaggcacacctgatggagtgagagagggctctgtaaacattgggcacacgtgatagagtcagagagggctctgtaaacatcgggcacagaagatgtaatgagagagggctctgtaaacatcggccacacatgatgtagtgagggagggctctgtaaacattggccacacatgaaggagtgagagagggctctgtaaacattgggcacacatgaaggagtgagagagggctctgtaaacatcaggcacacatgatggagtcagagagggctctgtaaacatcgggcacacgtgatggagtgagagagggctctgtagacatcgggcacgcatgatggagtgagagagggctctgtagatatcgggcacgcatgatggagtgagagagggctctgtagacatcgggcacgcatgatggagtgagagagggctctgtagatatcgggcacgcatgatggagtgagagagggctctgtagacatcgggcacgcatgatggagcgagagaggtctctgtaaacatcagacacacctgcagcacagggatgatgatccatgacacgattttctctcagacagcagcaggcagggtgttggggcagcgcactcagggcagtgacaaactggtgcctgttccccctccgttccggccccaaaattgtggggacgccccacagcagctcagtatcacccaggggaggggaaagggtgtttctcggtggttggttcagagctttgcatttttagagcgtcatttcctggaggcctgagagatttcataatgataccgagttctctcaatacgtctctgaaggagaaacggactgttcttaggttcatagaatcaagcagctcttggttttccagatgggtttttttacctctttaatttcctaggatgcaaacgtacatcacaccttggccagttttcagaagacttgttttggtgactcccacccccgcttttcttcctagaatattggcggctcatcttcattgcctggctggacgcagacccagccctttcatctgacagaggtgccgtgaatctcgcttcctggcgcgtggctcacccccaccttttcccactttttaatagtgtttcttgaagcacagaagctgcttcacttgatttgatcaaattttaccactcccttcctccgtagtttgtgttgtttgaggaaaggatttgaggaaactgttttctgccctgagttcagagaggctcaaatgttttcttcaaaacatttacaggttttttccccccatttaggctttaatctgcctggggttaatttttgtgttttgtggagagccgggatccacttctgtcttccgtccctccccatggccccacgttgcttgtccttcctctgcccatggccctgctgtgtccttgctgccgtccccgtctctgtgagtcatgagcacagggacctctctggggcctcagctccatgttggtttctttcctgtgcacccacctgccccgcggggaggttctgtgccgcacagtgggttaccgcatctgcaagtggctcctccatgcaatgctccttaacattgcctgggctgttcttggccctgtgtggccgggaacgtggtgagttaggctgcatggttcaccgggatgtggccgggaacatgctgagttaggctgcgtggttcaccagggtgtggtcgggaacatggtgagttaggctgtgtggttcactggggtatggccgggaacatggtgagttaggccagtaacctggtgagttaggctgcgtgattcactgtggcgtggccgggaacatggtgagttaggctgcgtgattcaccagggaaaagagggcggatcactctgtgtatgtcctctgggtggtgcagggaggacagaaaggccatcgagtatctgccatgcatttttttcctacagctggctaagggtgctagtgtattcattacattagcctgtgtatctttttctaggaataaaatagtccatttgaaaaacaacaaaggcagccatccaagttgctctctgcccgtcgtggaccaacgtgaggtcagggctgcgtccctgtgaccttgtgctcacctctccctttgtctatctctacaccaagggcaaaccctggaagataaggcaggtgtcaccaggtggatcccaaccgatctgtagggtttgctggaaaaccagtgtccagggctccagggcatcttcccacaggccagaataagaaaaacgcccctgaaataacaaaacaaaagagacaaaggccgtcacagtgcacggacacgagcacccggaggctcacaggactctgcggtagacagaacaccacagatgctaacatactgctatctcgtcagatgcaggcagcgcccagctcacccctgcggagccgctgacctgcaccagtcctgagaactcagtgccgggtacgttgccgggaacacagagcaacttaggacgtgaacaagcctctcgtactagaagtggaggagtaataatgctttcttcatctccagcagtgtgccctcatcaccaccctggggtcgtgctgtggaaggccttctctttctagagcattgcttcaggaccccaggctggtcacgctgggctcctgtccccgtgtcagcctcaccctctcctcctggccctcacctggcagtttcctcagtggctttgggtcgttcctctgccccagatgtccggtttcttcctcgaatttcagctctagtgttctttcttctccccactgtcctccatctcccacacgccagtggcctcgctagctgtgcccaggccttcagctgcctggagggtgcaggctggggatggggctggggcctggacggcttctacagagaagtgggaatgtagaatctccttcagagagtgtgtggccgtctcaccacccgccaaggccagtccctcctgttccctttcctgcagagacacgtgctgcacaccacctcctgtgtgtggggcttgcacactcctatgttcaaaaggcctgcgttccacacccacgacgtggaggggcctgcattccacacccacgatgtggaggggcctgcgttccacatccacgacgtggaggggcctgcgttccacacccacgacgtggaggggcctgcgccgccccctcctccgtgcagggggtcagagtctttctctgcacctttcctctccgtggaagagctcccggtgcctgcagtggggtggcactggtgacggcaccacatcgaaaggaccccaatgtggagccctgtttgctccagttgtctggaaggaatgccatgcagccccgacctgttcctcctcccctttctatcagcaaattaacatcccacgcattaagccttggtcctggaataatcagcacagagcagaggtttccttcgaaactgcgagtgtgaatcatagaaccgtaagtatcatgatattgtgtggcacgctggaaagaaagcaagagagttgcgtaggttaatgtgtgttcccaaatttttttccgacacctgcactcaatgagcggctctgggccttctgtgtttttctgcaccagccgtctctccacctgccctcccccagggaatcccgacagtcagtggccggggaagttgggtctggaaggaggggacctcttgacttctccaggggaggctcagaggcacagtcctttgctgaggagctccaggtggaggaaggcagagaacgcacagccaggcagtgggcatggactgaaaccagcccataaacccccacgccggcccccctaccaccacaattaattcattaatgctggaaaccaccattgcattgttttcttgtaattatacacacctcaaatgcttgcttttgaagacattaattgcatgattagttttatgatttctgattaccaattaggttacctttttgtgtatttcatacataccattaggctttatggtacagcttttgtaatttctcacctagcaggggttctcacacatttgaaggctacattatccactcaataaacagagagagtttaattttctgtgtaaagtattggtgtggacttgggaagatgatgtttcagatattatgctatcaagagtgacatttaattttacaggggaaaagtcgtggttttcactgtcataacgatgttcacagagcatgactttagagatgggaggaggccgggtccaatggatctgtgtctgcggtgtggattgggctgtcacatcccttctctgaggaagatattcctaatcactctaccctttactccgacttgttaatatatttaatttacttgtgccttgcctctttcccaagaatagttagaaagcatttggtgctgttgggtttcctatgtgaagttccttggagattccattccctctgatctgaaatcaaagggctgggtgtgcactgtggcggagacaggggcacaggattcttaacgtgcccttgtgaggccagatgagaaagtaatcccagcactttgggaggctgaggtgggcgaatcacagggtctggagttcgaaaccagcctgaccgacatggtgaaaccccatctctactaaaaatacaaaaattagctgggcatggtggtgcctgcctgtaattccagctactcaggaggttgaggcaggagaatcacttgaatacgggaggtggaggttgcggtgagccaagatcatgccactgcactccagcctgggtgacagagcgagacaccgtctcaaaaaaaaaaaaaaaaaaaaagtctcctgaatctgcacacaaagcggcatttgagccccttttgtaccatttgcactttaaatctcctcccttcccccagggaaaataagagcagatagatcagtaatcaagagatggtcaggtggacgaggcggctgattggagcgcgctgaaatgaccccataaagcaggaatgtgtggaggaggcctggtttgaccatgtgatgcagcagcaccgattcacagccccacgcacaaaggggccagcaaataatgccgtttctaatgttgtgtatgggttggggaccttcctgttatttaaaatggatgcatggttccagtgctctgacagccaggcctccccgaaagggaagccactgggaggtctaagatactttcaattggatgtggctatagaaagagaaagttccaattttgatgttgatccttaaagtattagcttgacaaagctttgcattatgggggagagaaagggagaggagggaggaaaaaagacacagtccccggggtactgtatgctgtcctgtgggcccctgcaggctgcaggcccgcaggaaggaaagcgcagaatccagggtgttctcctgataaccagagaggacgtccccagcaccccgaacgctgcaatattttcataaatgtagaaaaaatagtagtgtttctcaagcaacctttatttacccccagctttgcttctctttctatggaaggcttccttattgtcccacgtgctcctgaataatgcatgagcctcagagtccgccaggccaggaagcacaaaggccccgtggtgggggcccttccaggcaggcaccccagcagcctcgggtaattactggcccttaatgggcagtttccctgcctcagatagatttgtgtgtgtgtttaagactaatttagggttcctttgggggagcttttcaaaatcatcacctgcgggtggggtgggaaggggaggatccttcactcaagtttcacttaaagccacgtacaatacggtaagtttgaaaaaccatcaggaaaaggaaggccgacctgttagtgagcatttgagcttcccaccatgtggggctctgcactttagataatgtcctcgttcacagttttgtctcttcaccgatgttcagccagtgacagggagcgtgtggggagtgaaggcggtgaagaagctttcaagaccccatagcctgttccaaaaacagcctgaattaacttaaagctgcccttgctgccatcgtggccagcgcatgaactgttactgcagaaggactttcacagaacttaaaagtagatcatgcagctctgcgaccgcctctgccctgtgctgggagcgagtgcagggcggacacggctggcacttccagcagaaggcactgcagagctcccaggccaggcagcggccgttgtgaattgcaggttgccctgcagactggacgttgagagaggaggagggggcaggcaggcggtgaggtggtggctccagcccccgccggtgcttctccctgggcactgcctgagagggcgcccagcccctcacctctccaagaagaaacacttctggctcctggaggggtctgaggacggggctcctcttcaggggtcctgtggcctgagaccaggaagaaacaacctgtccccctgactgctgagcagcagcaacccactgggtgaaaacgctggaggctctggatgctgcctggtggcggctgtgagtgatcaggtgccagcgtcagcatcgggtcatccactgtccagaatccagcaccactccctaaattccaacttccccccaacacggggcctgctctgtgggcttcagccggctcggatgttgtctgcagctcccgtcccgtaccctctccactcccacaccctgcctggacatggttacacagtcacacacactccacacagtcacacagtcacacagtcacacgtggccacacagtcacacgcggtcacacagtcacacgcggtcacacagtcacacacagtcacacagtcacacacggtcacacagtcacacgcggtcacacagtcacacgcggccacacagtcacacgcggccacacgtcacacgcggtcacacagtcacacgtggccacacagtcacacagtcacacggtcacacagtcacacgcggccacacagtcacacgcggttacacagtcacacacagtcacacagtcacacgtggccacacagtcacacgcggtcacagtcacacacggtcacacagtcacacagggccacacagtcacatgtggtaacagtgacggccacacagtcacagtcacacagtcacgcggtcacacagtcacatatggccacacaatcacacatagttacacagtcacacacactccatgtggtcacacagtcacacacagtcacacagtcacacacagtcacacacggccacacagtcaaatgtggtcacacagtcacacgtggccacacagtcacacgcagtcacacacagtcacacagtcacatatggccacacagtcacacatggttacacagtcacacacactccacacggtcacacagtcacacacagtcacacagtcacacgtggccacacagtcacacctggtcacacagtcacatatggccacacagccacacatggttacatagtcacgcacacagccacacacacttcacacagccacacagtcacacagtcacacagacatgcactcccacacagttgcacatacacattccacacagctacacagtcacacacactacacatagccacacagtcatacacagacacattcccacacaggcccttgcactccacatagccacatgctcacacagtcacacacacaatctctcacacacacacagacacacagagtaatacaaagtcacacacacagacagacacatagacacagccacacatgcacattcacatacactcccacacagtcacacaaccacacacacagccagacacacacacagtctctctcacaaacacaaacacacgccacacacactccaccacatacacactcccacacagccacacagacacacacagtcatacactcacatgcagccacacatatggacacagtgacacactgacagtgatgaacatgcactcacagtcatgcacatacattcaaacacactcagatacacatacgactatacatgcttcagtcaactcacacagtcagataccaattcagtaaagaacaattacgtgttaatctgtcttgtgccaaatataagtcattggcttttagaggatggaatcagaggcaacttcacgaagacaagaacactgtagccaccccagggaagacgagaggaactggagtagccacggcggagaggagctttctcccgtgccatccactacgagaggaactggagtagccacggtggagaggagctttctcccatgccatccactacgagaggaactggagtagccacagtggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggtggagaggagctttctcccatgccatccactatgagaggaactggagtagccacggtggagaggagctttctcccgtgccatccactatgagaggaactggagtagccacggtggagaggagctttctcccgtgccatccactatgagaggaactggagtagccacggtggagaggagctttctcccgtgccatccactatgagaggaactggagtagccacggcagagagcagctttctcccatgccatccactacgagaggaactggagtaggcacggcggagaggagctttctcccatgccatccactacgagaggaactggaataggtacggcggagaggagctttctcccgtgccatccactatgagaggaactggagtaggcatagtggagaggagctttctcccgtaccatccactatgagaggaactggtagtaggcacggcggagaggagctttctcccgtgccatccactacgagaggaactggagtaggcatagtggagaggagctttctcccgtgccatccactgtgagaggaactggagtagccacggtggagaggagctttctcccttgccatccactcagcaagtgtcggactccactgagtcacttgtgtgtcctatgctgggcagcagggctgtgagatccacgggacccacccctgagtccaaggctccgtgtctaacaggtgcaacagacgtgtggcggcaacaaggaagggtcatggagtgaaggaggatgtgagtcctgccctgtggaggctggatacactgtgtccttgtgagggtcatggaggatgtgagccctgccctgcgggggctggatgcaccgtgtccttgcagacggcaggagtgcgaaggactcaggcacagagcaagagggcatgacccagcagaggctgtcaagcccagggtgttcctgggtgcgtgtgctggggagtcgacctccacagaatgtggtacatggccctggctcctcatggtgccccttctgagccatctcggatgactctgcatcaaaacagcctcccccctccaccacctcttccatcagacactacatcccccatgggcattaataatgtcctagccgtccataaacctcagagcctggcccacagcacacaacaagcgagcaattctctgggtgggtgggtagatggagggacgtgtcgatgggcaggtgggtggacaggtggtggtgagtggatgggtgggtggatgggtggagggacacatggaagggtggatgtgtggatgggtgggcaggtggacaggtggtagtgagtggatgggtggnnnnnnnnnnnnnnnnnnnnccgttgtcccaactacttttttgtcaatcctgcccacagtacgccataactcactcatctctcgctcatgcaagatttgcacgtcacgttccgacgtcggacaccttcatacagcatatcgactcacgaggacgcagcaagcacctctttctcatctatctatgctccgcgcgtaaccagccctctccgtttctgatcatactatgcatacgacatccaccacgcacccaaatctcacctctctatgccccacccgttaaccgattgatcactacagctctctcgacaggaaatccgactacactccgacatcaaaactcccattctctacgcgcgttaacaaccccactcggcacactagtcgctacatctactcataccggctagaacgtatatcggaatacttagccatttcacacaaactacacatgaccacactctatcacctacaagtacaattccatgcagcgcacccactggatagccagactgcctacataacctcacagctcgcacacacagtaggtcaatcgacgggtatttggatagatggacacatacatggatggacatctcgatggacaggcaggtgcacaggtgatggtgagtggatgggtgggtggatgggtggagggacacatggaaagacagatgtgtggatgggtgggtgggtggacaggtggtggtgggtggatgggtgggtggatggagggatgcatggaagggcagacgtgtggacaggtggtggtgagtggacaggtggtggtgagtggataggtggtggtgagtgcagggtgggtgggtagatggatgagtaagtgggtggtttggtcgggggatggatggatggatggatggatgaatggacacacagttgtagatttggtgacacaatttggaagtctctggagcaattaaaaatggtccaggccaggacatggtcatgacataggccaaacctcttctatattatctgtcaggaaatcatatttttgttaaaatacttgttttgtgtctattgaacacttagcgtggaaaacttagaaaatgcttactatttgatattcttttaggatgtgtgtgtgtgtgtgtgtgtgtgtctttattttgcttttcagtttgtatgtgtgccttatcaaattgtctttaaaatatgcttctgaggaacactttggtctttatgtggttctgctgtaagttcttcaacccatgtgctattgttgaacatttagcttgtttctagtatttcattatcataagtcttgctgcaattaatatccttgggcatacattcaatctatgtggcttactgtttctttaggatacactcctagaaatctaactactatgtgaaatggtgcaagctcttctaaatacctcaattcctcttatccagttgaactaatatctccaacaaatgcaggtgcatctggcaagtccaataaacctgccatcatccactcacttaacaccaagggttaggacttcatttaagtgcatgcaattatttagggcaaacgatagcatcttatcattggtttaatttatagtttttgatttattgtagatttaaacattttatcatacttgattattgatggttctgcttcctgggataatctcttcatgaattttcctatgggagtgtgaattttctgaaatagactcacgagtactcttcatatttgtttttgcctcttacttttggccaatgttctgccaggcttgtctgtgtctaacgttgcttgttgtactgtctgaagttcagaaaggctgagctctggtggattcaaatgcacagtcgtttcctttaagattttgtcaatcgctctcatgtttagaaagtgcttgctcatcctgtcatcagtgaaacacaagtttttatttgttatttttatggttccattaatgtgttaatgtatctggatcatttctggtggttgtaatgtgtgtgaagtgagggataaactaggaccttcccccaagtaaactctagtttcttgaataagccattgtttcccacgcatttgcagtgcacccttcggctatgttgttaatttcgcccctgcaccctcccgagcgccctgagagccgaggcattgctgcagatccctgtttcctgttcttcctactagtcattctagcttcttcttgcaaactctcccccatccttaggacgagtctctttcctgtgccgtacgtctctaatatcccctcttttagcatcttttgtgctttgctcgtgattctcgaagagctttgcgggttcggttgtgaactgtagtcagttctgctctgccgcctcaatgtgaattttaactctgctattgtagttttaatttcctcacagttatttctcatctctcccagttccagctctttgccttcataacttggtaacggttctgtttttatgacaccctgtttttcccgttgtgttgtgtgtttctgctcctgtttttagagaggctgtgtgtcttgcatcttcgttggaaagggtagcagagttctcttccagccaccttaggaaatcctcctggaaggtctgcttgtcctagggggctcaggacgctgtggcctgtctcttactgaaaccatattttcagctgtccctggttgctggcttttatcttccctcttcactcattctcaaaggaagagaagagaaatctatccagcttcttttcctgacaaaaggcaagaagtagctcatcactgccccagctccattcaccacccacagcaggctacatgcattctttccccagatctgtggctcggggagtaggcggacaggtcaatgttcacagctgcaggaaaatccctggttttgctaagagaagcattgaaagctgggtccggtgctcttattgacaacacatttggggttcatgacaacaagccccgtagcctcatgtgcgtctgtcctcctaaggtgggtccccacacccgcctggggtcctccctgcaggccggctccaggctcactggaggctgggcccgcagccccgtggcttcccctctgcgagcgtgcactctgcacacacaagcacacccacgtttctgtctggagccgcccgctcgccctgacttccctgtgagcgcagctgcgctgggtgcccctggtagccagcgggtgggtcgactgatcaattgatggattgatcacagggagtgcttctggctcactgattggtgggtggaattgatggattgatcacagggagtgctgctggctcactgattggtgggtggaattgatggattgatcacagggagtgctgctggctcactgattggtgggtggaattgatggattgatcacagggagtgctgctggctcactgattggtgggtggaattgatggattgatcacagggagtgctgctggctcactggtgggtggaattgatggattgatcacagggagtgctgctggctcactgattggtgggtggaattgatggattgatctcagggagtgctgctggctcactgattggtgggtggaattgatggattgatcacagggagtgctgctggctcactgattggtgggtggaattgatggattgatcacagggagtgctgctggctcactgattggtgggtggaattgatggattgatcacagggaatgctgctggctcattgattggcggatagaaagtactacagagagtttcgaaggacgttggcagaggagaaatccgccagctccttctttcggcaccaggtcagagagaatctggggctgcagtgttggtttctgggttcagtgcgcctcagcccagtgaggagtggagaccaacagcgccagctgcccacgtcctgtccgattcgactcagaaagccacaatgctgatttatggaaatgagcggcttgttactcctaaaatgtccatggatgagagttgtgaccagaagaaatgcaaaatattgaaatttatctggaaggaaattgaagcagcggataagatcatcatactaacggctgcatctccacaccctccccaatttcctaaaacccaggagagctgctcccggaactatgctccatcaagtttaccatcatacaggatggatgggctccggccacgtcacacacttcctgaacgagtttacaatcatatgggatagatgggcaccggccacatctcgctcctggacaaattcaccgtcatacaggatggatgggcgccggccacgtcgcatacttcctggacgagtttaccatcatatgggatggatgggcaccggccacatctcgctcctggacaagttcaccatcatacaggatggatgggcgccccccacgtcacacacttcctggacgagtttaccatcatatgggatggatgggcaccagccacatctcgctcctggacgagttcaccgtcatacaggatggatgggcaccggccacatcacacacttcctggacgagtttacaatcatatgggatagatgggcaccggccacatctcgctcctggataagttcaccatcatacaggatggatgggcgctggccacgtcgcatacttcctgaacgagtttacgatcatatgggatggatgggcaccagccacatctcgctcctggacaagttcaccgtcatacaggatggatgggcaccggccacatcacacacttcctggacgagtttaccatcatacaggatggatgggcaccggccacatctcgctcctggacgagtttatcatcatacaggatggatgggcaccagccacatcacgcacctcctggagaatcccgccatctcatcacagttctttgaccagttggctattttctccattgagtaaattggtttggtaacttttcccactgtccccattctgatcacaaatccagtcactctctgctgttgcttttgctactagaaggaagagaactgctccatatactgaaatattttgggccaagccttccagtaactgaagatccattcagcctttgaatcaaccccagattcccacgcgaagcatatgtgtttggaaactgtgacagattgtgcctttccttccttctcaccctcacctcccccacacgtgcagctccttcgtgtttccatttctttttttctttttaacagcaatttttgtggcatctagaagcaagtgcagtaagtctctgggtttgaagggagcttcagtgtgttggtcagtcaggcaaagcgtgggtgaaacttaggaatcctgtgtttctctttgaactcaacagaaccgctacatttcttgacttccaccttcccaaatgtatgtttaaaacaaaaacaaaagtattctgtctccagtttacaaaggcaaccttcctgaacagaccaacatggattagtgccgcctgtcggaggagccacttggcaatgtgtgagcgcagccacagcacacggtaatttgcagaatgcagccgcctctgatcggtctgaaataatcctcctgtttatgaaacagagcctgagatgcagcatcgagcctggtgccaatcacagtggtagtgcggcttaacacagagctcgagtcctgagcctgtgagaccggctgagcagctgccacagccttggtgccacctctcatgtcctccgagcttccgggcgctgctgaagaattcatcacatggttgtgcaagtgcctccaccccggagaattagcggaggtgccaggtgctccgggaggacccctcagggccatcagcagcccagccgtcactcctcatgcagacgaagcaactgccagacaaacttctttccgttttccaacaacttaccccgctctggagctccataactgccctcccccagcttaaggatggctatgaattaaaccctggaatatccatatattttatggcctagggttccattcgtgggacgtctcgtgagggtctaacgtggccaggcttgtcataggactgggctgtgctggtgtgaggacagccccagctgcctgggggagggagacggcagcctataccttccctgcttctcgcaggcccgaagtagaggggagctcagtgcagaacacctgtgtagactcccaataagggttggatgtcttcctgctcgttctgacaggtggagatggctctgaaatgctcactgagaccctcccagccactcctctgctcctcctcttccctgcctcaccctgctcagtactgcagggtgagaggggccgtggacagggatggggagggcagctccgtctcccagccccagccccagggcaactccaaatgcacccagccctgccctgctcttccctggacacagaacccgcatcagttaagatgcttcgggaagaaataacagaaaaccccaacgagagaaggcttagactacaggatattcacggctgcacatggcgggacacctggaggaggagtggccgcagtgctggatgaggctacaggtcgctgggacaggcctgcaccatgggggcttctgtctctggacttccctgcaccccttgtaagatgctgcagggcccgagcagttcctccccacagctgggctcacagcaaggagtccctcttcctgtgcttctccctttatcccagaattttattttgcaaactccacactgtcaaacaagttgaaagaagagtaaaatgagcacctgcaccctcttcctccagagtcaccaactttgagctctcagtcatgcctgcaactctgtcatttacctgtgtgtctggatggaagtcacaaaggttgctgcagacatcacaaaacttccccgtgaggtgcagaaaagggagtgtctgcatcatcccccagcgtgcagcctggaagcagtgacgttacttagcacacgttcgtatgtggccagttttcccgttgtcccaatagcttgctttttatttttaatccagattccaatcaagggtgaatgctgtgttttgttgtgacatctcggattttctttgttctagaatacttctacctttacgttttagttttggtcttttctagcattgcaattgttagagaaaccaggcttgtcctgtgggatatcctgtggcctgggcctgttggattgccccacactactagattcagatgcaggtcttcagcatgtggtgatgtgtgtgcctccggcagctgtgggtgcacggtcagcccctccccgcgtggcgatgtgtgtgcctccggccacagcaggtgcacggtcaacccctccccgcgtggtgatgtgtgtgcctccagccacagcgggtgcacggccagcccctccctgctgggacaatgccaagtgcagtcgctttggtaaaagaggcacctgccacatcactccattgtaaaggtaaattcttcccttggtaattcatcgttgatttgcaggatgataccttgagaacttaggggtatcttgttaccagcagccttttaccatgtgcctctttttaagggctgagtagggaagaagggtgggctggatgcccctgagtctgaggatgaggactgtgaattcagggaccccagatgcccctgggggtgctcagctgccagtgagcaggcacagagaagccagcccctcctttcttccagggttggcacttcccatgggaccaagagcaggaagacaggaggtcaaggacaccatccagaaaggacagtgggagggagggtggggcaggagggggtggtaacacgggggagagaggatactgcagaccaggagttctggtgaccaggacacaatgtctttggaagcatggagggacagtgcagctagaagcacggcccacagacaggtggagctgccactgcagaggtgcagggcaggcagctgccatggggcagaggagacatcaccatcatgagattcagggtgaaacagagtttgcccagggacaaacgtgttgccgccaagtcaacatctgtaccatcatgcctgaggagtcgggccagggcttttcctggagcgaccttcaatgcggctgctctcccggccctctggacggggtggtgctggggcagccacttgggctctcagcaggtgggtgcacggtcatgctctgtccttccattgcagagatggctcagctcacagtgtggcgccttccgcctttgtaaggagtcttcaccaacatcctcgtcctcagcttttccgtgtcagtcttgctggagcctctagaaagcagaggctttcacgccgtttagcatcacctacgctttaatgacagccttgtccagactttcaaacttacctaaccccacgtatggcctgcggtgcacacgggcccgcatctgtggcctcacggtcagggtgaccccacaaaaagagcgccccagatgaggacctgtttgatgttcgtcttttttaaggacttctacttaccagccgagtgtttgatcagtggcgaggcctcatctcttttgcgccaccgtgttcagatagcacctgccccaacactcgcagcaagacgggacccttgcctttttgtttttgactttaaatagctcctcattgtagaagacagtttattatggactcttcaaaatacatttctagggaaacaaatttagttgtccttattaaaaatgtattacatatttcagaatcaaagctcacggctcacgagcatcccgcgcccggctgcgccccgcgctggcatcgcagacgtgtcctggaaggaagaactccaagtgcatttgaaattcaaattgtgtttggttttaagatggggatgtcatcaatttcccttagaaaattataaaaaccatgatgcataaagaaatacagttggagaaaacagtgacaccatcttcgttcctgaattggtgactccaaacggcttgcccttggaggtcacttttatagggggttacgcaaataaaactgagtggcgttgttaaaattctccactactggacctttttagccaaagtgggcattttcgggagtcggcaacacagacagaccctgtcttacttgtcagctgtttggcaggaagttggtactttgccatagatttcagtttacctggttttgttgaatgtctcataaacagatacttgatttgactgtttgtacctgcagtaaccaggacatctctcagggtcttgctgtgatcatacctgcagtaaccaggacatctctcagggtcttgctgtgatcatacctgcagtaaccaggacgtctctcagggtcttgctgtgagctgctgccactttccagactcttccttcaccatatagtcttggtgctgatgacacggatggctctggggcagggaagtggtcccgaggggcacagctgtgggtgccgagggcttgcggaagtgggggcaagtcttgtatccgatcgctgttccgtccatgggctctgtagtcaacgtggcctcttctgtggttgctcgtgaagacacagctcagcatctacagtctgtagcaaggtggacagtctgtctacagcctacagcaggggcatccggacaggttggaaaagggagactgtggtgaccacacgcgtggaaggggctcagagaagcatgaggacctcccaccatcttcctctgagtaagacgtgatgctgaattttaacccagaggctggtcccagctccatctgcatgtggggaaaattaatgtcaggaaggaggaaaaccagaacttacgaaatgtacttccgtggccgtgaaggcaggcaggtcccacggtggggacgcccagagctgcaccccaagctgccgtctgagggaccctccagggcagctgccttgcggagacctgtcagcccaactgtgtcctggggcttcaagcattttctttatgtttaccttttcaaaaaaaaacaaaatcagaacgtgcagcccgaggaaggcactgagactctgggaacagcccgtgacacggtggccgtccctgagtcaaagcatcacagccggcgagggcggggccggcagctcaggggccacatccaccccggcacggtgagtcgtagtggagacaccaccaaccgccctcctccaaggcaccccagcacctggtcctcagtcctcgctcaaggaacatctgcagagcacactgggttcccccaaatgccggaggggtcctttgtggacgcagtgcccactccctgggccactgggtttgaaggacaactcagcccccatgggggaaataagtgaattgaatggaggacgtcacgcctcactggaggtcttaggtccaacccccaccacccacacagcccgaacgctttctcaggcccccagacagtgcccagggacattctgatcgagcttggcctccagacagccacggcccacactgtgttgtgttgtgttgtgttgtgttgtgttgtgttgtgttgtgttgtggtctctggcttccttcatccataaatgggtgcccacctctcaaaaccgctgcaggaatcgaatgagataatatgagggctcaagatgaaaacccaaatgcagggtgttgtcgaaaagctctagagaatggaaactccagaaaaccacaagggcctttgatgcttcatgagtttgaaaacaatgtttatacaggagttagggttaggttttggatgacattcagttagaaaaactcatagccagtctgcttggttagaaaatatagtaacttcagatgtctggcagtgttgtgttaggaccagagaacctagtgttttgaccaaggaagcatcatctctagtgcaatgtgtctgctggggacacggtcggagatgcaggacaacttgaagacatttggagggtcctgtgcaggagccgggtcagtatagacccctctggtgcctgtgggataagtcgtgctcctgggcagatgaattcgctgccccgtgcgcaggatatatgggcgcctttcctggctccccattgccccatgacctcacaggaggacggtgacatcctaaagccatgttctgcccaccctctgggatgccatggtccccaccctctgcaatcaggactcccacttgctcctgtgacacccccaagtccccgccaggctccgctgagattaccagggccctcacctgtgaactgggaagagtaatgcccaccttgttgcctggcgtgagggtgaaatacagcttagcacagcacgcgtggaaatggcgctcacgattgtgacgatcgtgttcgtgctgccatctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgctgtctttgcacagcacgcgtggaaatggcgctcgttgtgatgattgtggtcatcacagttgtgttgtcatctcagcacagcacgcgtggaaatggcgctcattgtgatgactgtggtgatcacggttgtgctgccgttctatttactggtggtggcttgagcagaggggattgcctgaccccttacatgcacgggggaacaaagtgaaagtggtgaataaagcacttgcgcttctccaaagccttgactcagtgtacaaaagagcatctgtaacttttcaagcacccctaagccacagacatccagaagctctctacagtgatgctactttttgtctcctggagccttgaggtctccagaacagtgcctgggagctcggcagagaagctgagtggtggaagctgaatggggctggggccagcgctgctgctcccccgggatccagccaggttttctcagatctgcagagaaggcgcctgaggtctgcctcgagagagatacctgtgtgagccccaggtgtgaactcagacatgaacaaatgtggagggcagtggtccaggcagcagagctcactcgtcctcttaacacgggagccttcattgttcaaaggtgtgattcatacactgacgtggcattttgacacttttgagaggataatctgttcactggcaaacacgtgtgtattagtcaggattagtgtgactgagtgtgacagaaaataaaaaataaaagtggcttaaatgagctggaaatgcactttcatttcctgtggaagaagtctgggggggaggcagtctgaggaccttgcagcctctgaggtcccagaaacaaggtgttctactcctgccgctccagccctcagccctgagctgctcctcatgatcccagatggctgctggagatcccaccatccaggtctcatttcagccagcaggaagggggaagaagaggagcagggcgcgcgtcccaccatgagacactccctgaaagcagcacacaactctcacttgggttgccttggccagaaccgagtcgcatgtccagcttcaagaaaggctgggaaagagaaacttcatccacgtgtccagctacagaccagaggctccaaggaagcagaggaagaccagcaggcctgggatggtgaagaatcctcgtttgccctgagccaagctgccttgagatggggtggggtctgcagggtccttggggccacattggctgactccccaggccctcagttttcccagcatgactcagccctaatgtgggccctgggtgccgctcgtgatccgcctgctttgtggcttcattcagcatgtggaagtggttccatcatctgctccagccaaggcgaggcgggttctgcctcacgggaaacaggtcaccctttctctgaggagtgttgccttctgcccaagtatttggggcacagcactagttgggggtcactgcagtgtagcatccaggttcacacccaaagactcttctgcccaccaacagacagccagtgacccaaaagcatgcctgtcctctagaacttcctgtcgagccaggtctcaccatgtccctccggaatggggcagcctccattccctattttgcgggaggctcagttgccaacagtccagagttcctaccgagttcttccgggggcctgtgtggcagccttgagtcagcaaagagtccctgagtgtcagtgacacacctcacgccatgcaggcacagagaatccacggacagcatgcacttgtcctcgggaagctgctgcccattggacaggtggggcaccagacagaggcctcccatccttaacatcccaagacaaacctgctaattaaggcttcaggtgcaaaggggaaggccctcttgtggttctctggcagcggtcggcacaacaagctcgccccctgccctaggaggaggacctgtggtcagcttctaccttcaggagggtgactctctggcagccgtcggcaagctgagctcgcccctgccttgggaggaggacttgtggtcagctcctaccttcaggagggtcacaggaggctgtgcacaaaccccactgacggtctgagctctggggccgtgtgctctcgctgggttcagggggattgttactgatggcagagcgaaggtgacttgagatgcatcagttctctatgagggcttgaagtccaggccacttttgagccagtccatctgctcatctctagagtaaggaggaaaaaggaaaaaacacttctaatttctctgtctgtctcatacccagctgtggaacgaaggactgattcaacctcctccccactttgccctccagattccccttagagacacaggctggttagggtatctgaattatttgagcaaaattttcatgcttagggaaaagcttgatgtgatcaaaacctaagtctcaggacatcaaatccccagatgtttaaggtagactatatatatcaagcctttgaagagttcaaaggaatgctagccaatgagtgagaaaatctgaaaacttcaccagtccttgcctgtcatatgaacttgatgatctaacctgtagtcttggatgtcaggggcctcagaaacacaacttccaaaccagaacatccttgggggatgaagacaacagggatcctaggagtccaattctagtctctccattctggatatctccacatcaagaatgaataatagatggagtccagctgttttgtagcagactgcagattagtgattcactgattgtaatcagaagcagctgctcataatcacagcccaggtacggacgctcattgtcaagtactaggtgttaattttttgcctataccctgagcctgaggctaggagtgtcttgaagctaatgataacataatcttgcaaacattaattagaatttcttgaacttattctaataatttgttattttgccaggctttagtattttaggtatttatgtgttttaaggttttattaaatattttaggtgattattagctctattttttaacaatatgggtcctcaatagaaatctggatggatggatggatggatatatgcttccataggtagatggacagaatggatggaaggaaggatagatggatgcatgcatggatggatgatggatagtgggtgaatggatgagtggatagaaggatggaaggatagaaagatggatgggtgcatgtatgtctgtatggatcatgggtggatggatgaatgcttgatagtggatgaatacatggataagtgatggatagtatatagataaatggatggatgagtggatggatggatgacagattggctgatggatgagaggaaggatggatgcctgcatggatgatgggtggatggatagatggatagtggatggatataaggatggatggatggatgggctgatggatatataggaggaaggatggatgcatgtacgcatggatgatgggatatgtggatgggtagatggatagtggatgggtggatagaagagtggatggatagataatggatagtgtgtagatggatgcatggtgagtggatgggtagatgaatggatggatgaaagggtagatggatgatggatagtggatgattggatgaatggataagtgtattatggaaagataatggatagcggatgattggatggatggataagtgtattatggatagataatggctaatatataggtggatggatgatggatagcatatagatgggtggatgagtggatagatggatgatggatagtatatagatggatagatgagtggatggatagttaatggatagtatatagatggatagatgagtaggtggatggatagtgtatagatggatggacggatggatggatggatgagtgggaggatggctcatggatagcagatgggtggatggatgcatgagtgtattatggatggatgatggatagtgggtgagtggatggatggatgagtgtatagatggataatggatcgtatatagatggatggatgagtatttggatggatgatggatagtgtatagatggatgaatggatgagtgggtagatgaatgcacaatggatagtggatgagtggatggatgagtgtatgggtgattgatggatagtatatagatggatggatgagtgaatggatggttattggatggtgtatagatagagggagggatggatagatgagtagatggatggatgatggatagtgtacagatggatggatgggtggatgagtgggtgtatggatgatggatagtgtatatatagatggatgaatgagtgcctggatggatgaatggcttcctaacccatgtccctcctcccccttagtcacgtctctcacaattatcttcaccacaacctatgtcatcattctctgtgacatcaacaaccattggtttccctggcctctggtttatttgtcttcctgtttgcattctccccaatcctccatctacctcagccactgcctctgccccggccacaggtgcagactccagctcattcagagtggcttctatcccaccatgccaaccaaggccagctgtgatttcatggtgctgaagccaatggccactcttcaatcctcatcaactgtgggctctccatcagcttttgagagctaataagccccttctcaaaacttcctcttgtcttggtgtcaaccatgctgggctcaccttcatctccgatgtctctggctgctctttctcaggctcatcaatggtggcctccccacatgctctccaaatgctgggttcctcaggacacttctctccagacaccacctccctccatgacctcattcatctgtataactccaaatggcagccatggagtgaattgaccctgaatttatagctctgaccagatcctagagttatgtctttactcagaggtcttataggcctctcataactaaaactgaattcttgttgttgtctccaaacttatgattgtgctggttctcaggagagaggacagcactgttcacaggtgagttgccttcttccacctacattcagcagaggcagcaaagtacacccgagtggcattggcacaaggatgctgggtgtgtcatctgcacctagatcctgccatgcctgccttggggtcacacaagctgtccagtatgcctggcctcatcctcctctcctccagcatgggagactccaccaggctgcagggtgcactcttgcctcccctccagcgtgggagactccaccaggctgcggggtgcactcctgctgccctgtggcagttactgtttccttcatcctcggctccaaagggcaaaaagtgagccccagcctgacactttccctctgggtgaggctgtcaaatcctctcctttctgatttcacctttcctggcatgtagagaataaggaataactccaagatcattctcatgggttttgaaacctcagatgcaaaagaagaaatgctctgaggttcctcagcctccagatgccacttcccagatcactcccccttggcttggcctcaggtgaaggtgtgtgtatgtgtgtgtgcatgtgtgtgtgcacgtgtgtaggggtctgctgtgtgcatgtgtaagaatgcgtgtgtgggggagtctgctgtgagtgcatgtatgagtgtgtgtgcgtgtgtgtgcacgtgtgtgggtctgctgtgtgcatgtgtaagaatgcgtgtgttggatctgctgtgagtgcgtgtatgagtgtgggtgtttgtgtgcatgtgtgtggggatctgctgtgtgcaggtgtgtggagtgcatgtgtgagtgtggatgtgttgtgtgtttgaatatgcatatatatgggtctgctgtgtgcatgtatgtttgagtgcatatgtgactgtgttgtgtgtgtgaacgtgtgtgggtctgctgtgtgtgacatgggtgtggtgtgtgcacgtgtgtgtgtctgctgcatgtgtggattgcatgtgtgaatgtgttggtgtgtgactgtgtgggtctgctgtgttcatatatatgtgagtgcataagtgtgggtgttctatatgtgtgtgcgtgtgtgggggtctgctgtgtgcatgtatgtggagtgcatgtgtgagtgtggatgtgttgtgtgtgtgcatatacattgtggatctgctgtatgtgtgtggtggtgcatgtgtgactgtgggtgtgtgtgtgcatgtgtgtgtggagtgcctctgtgtgtgtgggtgtgttgtgcgtgtgaacgtgtttgggtctgctgtgttcatgtatgtgtgagtgcctgggctagtgcaggtgtgttgtgtgtgtgcacataagcatgtgtctgttgtgtgcgtgtgtgtgactgcatgtgtgggtgtggggggggtcatgcagtgtgatcgcatgtgtgagtgtgttttgcgtgttcatgaatacacaaatattgtgtgtgtgcccatggctggcagtgggtgggcgggtgatggggcgtgcagagggatcccatccttccaggagacgtgacagggagccccctcccatccagcacgctcccctgaatgcacctgcgctgccaaaaggaggtaggggtggggagggctgtgccgtggccgcttggtgtacccttgtggcgggagggctgtgctgcggccactcggtgtgtgcttggggcggggagggctgtgccgtggccgctcggtgtgtgcttggggcgggagggagggctgtgctgcggccgctcggtgtgtgctcaggcgctgtgagcctgcagggcgccctcgcgcttcttcctctgcgcagcccctggtgttgcgttctgagctgaggcttcctaattgacgctgacggatgggctcagactcgagccgacagagccagctgagcggagcctgttaaaaatctcacttattaacccaagtcctctaccacactcctgtccctgtcagggccatgctgatgaggcatgggggtgagggctcactttggaagacccagcgccaaatgagcgcgtccctgggtgctggagctcccaggcagcagagccctgggcttccgaagggggctgcccaggccaccctgagcgggtgcaggtgggccactgtggacccaggcccagcaggtgtttggggggctggggccagtggtgtccacagggcagcttagtggcagaaatgaagaatcccacaggcacgtgggctgatggcctctgtcctgagaggaggctcagggtgcagatttcatgggtgcctgggcctggcctgtcctgagaggtggctcggggtgcagttgtcacgggtgcctgggcctggccttgctggtttcagaggaggggtgtgttgggcgagggctgctggaggagggcgggccagcttctcctgtttgtggctggagtgccatgtgcctggcacccaggaggttctccacacgtaattaatgaattaattaatcacaaaagcatttatgttttacattttctctaaaattaacatttaatcttcctaataattgcctgaggggtaaatactatattgtcttcatttggcacatgaggaaattaaattttagcatcccagggactcacacccagggccttggactccagtgcccctcatcactcagccacaggaggcaccagctgggggcctcggtgtcgtggcctctgcccttctggaagctgccacctgaactccttggctcaggccacgccctctcttgagacgtccctccccgtttcctgtcttcctcatcgttgaagatgtagcttgggcacctggcccccaagacatcttcccaaatgtccagattattgatccagctccccaatgaccccacccatctctgaggccacacagcccccgtgtcatttcccacgctttagaaaaaaccacccatctgtttctctgctgctagaccgcagcctccaccttccctccctatgaccaacacactgccggcatctaccacacacataccatacaccacacatgcacgggcacacacatacacatgcatgcaaacacacatgtgcacacactttcacatgaatgcacacacaccacacacctaccacacacaccacacatgcacatacacatatacacacactacacacacccacactgtacacacaacacacataccacatatgcacacaccacacacaccacacatgccacacatccacagacacaaacatatacatatatacacacaccgcacacatgccccacgcacaacacatatatcacacatgtacaaacaggcacacaccatgcacataacacacatatacaccatacatacacatcacacatgatacatacacacatctcactacacacaccacacaaacatcatgtgcactcaccacacacacgcaccacacacatacgctacacacacacaccaaacatgcacacatacacagacatgtacacatgcacacatcacacacgtctctcacacattacacatagacacacacgtgcatgcacacaggccacacggacacaccctctgcagggcagccagggctctccttggccccctcaccccattgatggccccggccgtagctccagatgctgctttgtgcaggtcgggtgtgtccctggtcgacaggtcctctcagatgcattctctcctcttttccctgaggacagatgtggtgtaatgtggtctttggccacctgaggacgtggggaggactggatgggatgaaacggtgccgtgatggtggctctggggtggctccggcagtggcaccatctgcctgatactcatgtgacctcagtgacctctcctttccccacagcctgctcctcattgtcttctcagctccctgttctcctgctgggaggcacagtcaaaaggggggtttgtcatggtttcctgtgacatgattcttcgtttgggggagcagcaacgtcttctccgaataagacacacagacccccagcgcaccagcaaaatgcagcagaagggaagcagagccagacgtgtgcaaaaccctctcctaagagcacaagtgaagggttttatgtgaaaggatttgggtttaaatcagagctgctggtgtgacgcgtaagcagcctggggaggagggacccgcggcgcccccggaacacagcgctcccatgccgacacccccggtgcacagcctccctccaccttgagcagcgagagggcccatcggcctccggggtgtcagcaaatggcccgagactggccggaggccagaggcatgtggtcggcagcccatctgcagtgccctggatgtggggacccctgttagagagaggtcttggggtgcccagccccgtaactaagatgggatattcctgagtaaagagaaaagaggaggagaaagggagggggatgctgcagggtctgtgcgaatccacatgtggggcaagagagggggccagggagccgcagtcccagcaaagcactcaacgccagggcagagggcagagggcagagggtagagggcagagtctcgcaccacccgcttccaaggatgtgccgaatgccagcctgcctgcttttctgagagcagagctcctgtctgagtgccagaggcctgtagactgcgggggcttcagtgcctgcccccgggcccctcctggagacaggcagtggacagtaaaaagaacactagggactttaaacacatccccgaaatcttaacaacttaacccaagaaagtttgtttctcactcatatccagtgcagcgtcctgaggtggagtgtggctctgctccgtgtggccactctgagatccaggctggctcggcctctgccagcccttggcttccaagcttgccctgccctagagctcgtggaggggaggaaagtgtgtggaaggtctccacagccagtttagggtggaacccatcactcattcaccctggggccgacccaggcccccgaccacaccgagcagcagagtctgcaaggcagcatggcccagggaggcggggcaggcacggggcagcagctggtctccacctcagagcacgctaggaggcgggaggcaggaggcgagccggcagggctggggggtctctgggctgcaattcatggaattctgtgtcttctcaggctgctgctgtgaacaagggtggagaaggagtgagtgtatttgtatatatgaggggagcatgtgttcacatgtacaccagcgagagggcgtgatctgtacgtgcatgagtgagagcacatcttcacatctgcacgagggtgacagtatgttcatatgagcacaagccagagagggcgtgtgctggggagtctgcaacatgcttacttgtgtgaatcttgccgcccagctctttctgaagcacagcgatgtctgcaacgtgtcaccgcctgagcgtgtgcagagtgtgcacagtgtgcactgcttagcctctgctttgtggcatgcatgtgtgctgctttacacacatgtgcgcgcgccccagctcatggcaggctgtaagggtggtctgtcccaggatctctacagcttctggtggcctccaacagtccttggatgtgggtggctctctccttcacgtcgacccccatgagtgcctgtctgcatccgaatgtccctttaaaaggatgccagcaacactggactagggccaactcccatgacgtcatctaaatgtgatcctctagaaagaccctatttccaaacaaggtcccagcacagagtctgggcccaggaccccagcaccctgagctcagcccactggctgggactccggctttcccacctcggcagcggtgcttctctaagtggctctacaggtaacaaaatgtcaggaaacaccacacaccagtcctgccttttgaccacactgatgcgcggaggcctaggcctggcaccctggagggcaaaggaccgaggaagaggccacggccatgggagggcgcaggcctgagcccacctgtggcccagccctcaggaggtgcacacagcctcagcctcccgtcctgcaaacggctggccctgctcttcccagcgtgcccagcgcctgcccacagcagcacccaggccaggtgaggacggtgaggctgaagggcgcagaatcttctgcagggaaaccggtcatgcaggcccagcagccggagcctgcttccacgtctccactgcctcccgcgctgctcccagaataaagactaggagggttcaggtgcagaggagagaaacgcagggccccgtgtggaaggtcagcctcaaagtcacctgaaatcaaacatcaccgtcaccatgcacgggtgaccacgtagctttggagaaacaaatatttaaagttgggtgagatttgcttccctccatctgggactcgtgcgcttctgtgcagaggcgccctctgcaaagtgtggacacctgaaacaggctgcctgcaaagctgctctgtgacaagaagccaattcaaagatgaaaagaagctcagtttttagaaacattttcaaataatggaatgagcctgtggatggggtgctggggccccatcactctgtgttcatttgggtttagagggatctccccgcttctcgcctccttgccatggtgaatcgtacattttgggcagagggtggcagatggccccatatgggattggagaagacgtggctccctgccccctcctgccccctcctgccccccgtctctcctccgtccctgtcctccctctgtcctgcccccgcctgtccccgtcctgccccgtcctgccccgtgtctctcctctgtccctgtcctgccccctcctgtcccctcctgttcccatcctgctcccgtcctgccccatgtcgagcgccagttctcctgtccttgtggcctccccacccttctccctccccgtcaaacgctgaggaagccattgctgtcaggcggcaccgtggacgtggccttctccgggggagctctctgtggacacccacgtttccttcacgcgcacatccgttttatgatgtggagctttaaggacctgggaggaaatgggaggtttgcagttgtaaatggcgtcagcaggggcttcctcgcctgcctgtcaagatggaggccaagcccagggaggggttcctgagcagatggcaggagaaggcccttcgccgtgtcccccaggggctccgtgcaccaggcctcacctgcgcagcacggcagtgtgggtgtggcgaccactgcctcgcgtgggcacagtctcgcagctctgaagaggccattggggcagaacaatccccctcactctaaggagcaaactcctccaaagcaccacaaaccgcgacttgtgtcggggctctcacggcggggtccccggggtcaccagcagcatcacctggggaacaacgcaaatgcacgttcttgggcccagccctggctcagaagctctggctggccccgagctgttttacccgcgctccaggccattctgactcagggtccagatgaaaaccaccggggtaaggaatgcgtgctgtgtagacagccacacgcagggcagctggagcactcggggcagctgctaattaaaaagcaatgctcattcctcagtggacatctggaaaatacagcgatgcagtgaggaagaaatgcgactcccccggacccgcccagaggcagcaaaggcgcttatcattcgtgggcatcttgtcctctgatctttcttctgcgcatttgaactttcttttttatacgagtaggatcaccacattttgtacactaacaaagtttaacaaattgttagactttcccatgacattagggccttttccatttaacgagagctgcacatgctgttttggggacctgaatggcgtatcgaacccctgtccgcctctgactctggtctcccaccctcttccctccccaccgttccccgctgtccttggtctttgttgtcctagccacaccggcttcccagcactggctggactcacaccccacagcaggaggaccgggcagggtgaggggtcccaaaggtctgggcttaccactgaagttccacttctccaaccggcttgccctggccctgtcactgccttctctacggtcccacgcgctctggagatgcttgtctgtgggcccgggtggttggcttgggggaggctgccatgcgtgtggttttagcacggcacaggtctttgcagatacacggcacgtgtcacagtcatttgagcaccgtcctcctgtttgtcaccgagtcatctctttttaacagaagctcatccagaggctgtggtccgggtgaaattagggagcagcgtggaatgtgggtagggacttggcttagggacttctaaaccaagacgaaggcttctgggtttggaaggagggcgagttttccacatcctaaccccggtttgcacaacgctggtttccaaacggaattctcaacataccagccctgggctaccgctccgggaactcaacctccatttctgtgaagcccagctacccatctgtggtgggtcagacaggtgaaatcacgggcctccttggctatacgttaaatggaagttaaatggaaattggccagcacccggctaccaagggtgacaccggctgatgaaagatgcaccaaagcacagatgagccgtccattcatctctctcgcttacagctttctcagctgacatagagtttctggtctcctctgacaacttctttcttttcaccattaagaaaaactccaaataatttcaatttgcagctcattagcaccctatgcacagggagtgttgaaagagtttttctttttcctcttgatgaaagaagtccctggaactcaggacgccctcctcagaattctctcctttgttcttcccaccctcctccctcacctccctcatgccccaaagggagtggagtggaaagggaggaaagaaagacaaaaagcgaaacaggtgccccaggaagggcagcggaacccctcctcccacaaagccccttccctctgggcgtctctcccggcaagccccaagggtcccagcacgggaggaggacggcccctcggatctaatgagcggacctcacatccaaaaggggctgcgatgttggggtgcccctgccttggccagagcagacactgccctctgctcatctgtgtgcaccagagaacatggtcgagggatgccgggttgataaggggagcccggccaaaccctcagtcacatggagtccgcctgccctgaacctcctcatttctcactgcctgtcctcagagcgaggcttttttcactgagccatgtcttaagtcgagggtggtccttccctacttagacagcgaccccatcgccctatcacctgtcggagactcattcagcattggggatacagatggccttgtcctgagttccagggaccccaaaatgtataaaacagcctcagctttggtctagaccctaaaatccagagaagcaccctatgcaaagaggtgtgggtagaattggacccgctgtttggacctcgtcagatgaggggaggctgtcacagcgaggaagccactgcgtggagtctcggcacaggggccggcctgtggggagcatcagtctcccataagccgagtgctcatcaggttccccaagcttagcagcttggcagcatttattattgagcaagtatttcatgggctcacgcacgttcctgtgtgatgcctggtgctgaggacattaaatcctgtatatttggccagggttcttaggatttgggtgccagccctgggctatctcctgcccttaagcttagaaatctcaagacgttgaacacactcaggtacacagcactgtgccaacagccacgatggagaggagacgcatctacttcacgtggagatttggggtgaagtcattttgatactaaaacatacatgtgtgtgcatatatatatatatatatatatatataatagagtagattacaaaaatccatgagttttttttgttttatttttttgggtttttttttttgagatggagtctcgctctgtcatccaggctggggtatagtggtgcgatctccgctcactgcaagctccacctcccgggttcatgccattctcctgcctcagcctcccgagtagctgggactacaggtgcccgccaccacgcccggctaattttttgtgtttttagtagagatggggtttcactgtgttagccaggatggtctcgatctcctgacttcgtgatccgcctgccttggcctcccaaagtgctaggattacaggcatgagccacagcgccccgccccaaaaatccacgagtttttaagataacagatgaaacttcaaagacatctcctacctgctgctgaccctcagtgctcagtcttcagagcccccgatgtggctggggagggtctcatggaaaagcgtgagccctggggtgaggagcacagaccccagcagtcccgccgtccccgtggaaagcctgtgcccagcagtcctgccgtccttgtggagagcctgtgcccagcagtcccgccgtccccgtggagagccagcctccagcagtcccgccgtccccgtggagagccagcccccagaagtcccgccgtccccgtgaagagcccagcccccagcagtcccgccgttcccgtccccgtccccatggagagcccagcccccagcagtcccgccgtccccgtccctgtccccatggagagcccagcccccagcagtcccgccgtccccgtccccgtggagaacccagctcccagcagtcccgccgtccccatggagaccctgtgcccagcagccccgctgtccccgtggagagcctgtgcccagcagccccgccgtccccgtggagagcctgtgcccagcagtcccgccatcccgtggagagcctgtgcccagcacggcacctctagcccagcctggcatagcctcgtcaagttgcagagcccccagtgccagggcgcccgcctgtggaccccacacgtctagatcgctgctttgggatcacgggggatggtgcgctgcgaccatgatgtgttgtgaagttctgtgctcactgtccgcagcctttgcttaaacaacaacggttggctttatctgatgaaggtggaactgcagtgttctccacgtggccctcacatggctccgcagaagctcagggtgttgtgggccaggttcgcctccacccacttcagccagcaggggcagctcccccgtcctctctgccgagccctcgtgagttggacggtggccccggcttccagctccggcctggcggttccctgatctcctccccacgcaccctctgccatcagcctggtattttccatgacccattacagtcctgttccccgaacctgcctcctgttcaaggacagcaagtccatcccatgggcagggcccagcaggactgggccagtgagacggtttcctgtgaggatcctggggtcaaagtgccacaaactgggtggcttcaaaccacagaaatgaattgtctgacgggaccgcgggccggaagctggagatccaggtgttgtcagggccacgtgctcaggaagctctcgggcgactctctgtggctcctggcaatgccgggggctccttggcaggtagacgcctcactccgttccgtctccgtcctcggggcgtgtctgtgctgtctcttcttagaaggatgccggccgtactggataagggcctcatctttactaactccatccacagagaccctatgtccagaaggcggcattcactgtgctggtgttaggagttgaacgtgtctttttggggaaacggttctgctcgccacagtgccttggtgtcatctcatccaaccctgggcctacgcgggagctcacacggcgggggtggcgcggggctccttccacacctcgctcagggctgagccccctccagggccagagtcacagcctcctggctccacagcctcggtgtcatctcatccaaccctgggcctacgtgggagctcacacggcaggggtggtgccgggctccttccacacctcgctcagggctgagccccctccagggccagagtcacagcctcctggctccataaggcatctggcttgtcgcaacacgttcctctttggactgactcagctttcgaaaccttcttacttatcctaagcaacagtacccacaaattcatgtttttgatgtactattttgctttttctcgtgcacattaaaataaagttttaaaaattgcccacattccacataaaagcaagtgacacagcacacttcgggaggtgctgcagggactgaacgtgtgcattaaaataaagttttaagaactgcccacattccacataaaagcaagtgacacaccacacttcgggaggtgctgcagggactgaccatgtgaaatgtgaatcgtccaaggcaacaactgaatcttatagatgcttaatccaaaagagtgttttcaacaaggtcaattccaggcccagggtttgtccaggacagcggtccatactctttttggcaccagggacctgttccatggaagacggtttttccatggaccaaggttgggggaaggtttcaggatgattcaaacgcattacatttactgtgcacttaatttgtgttattattacattgtaatatataattaaataattataaaacccaccatcatgtagaatcagtgggtgccctgagcttgttttcctgcaactggctggtcccatctgggggtgatgggagacagtgacagatcatcaggcattagattttcataaggagcgtgcaacctggatccctcacatgcacagttcacaacagggctcaagctcctatgagaatctgatgccactgctgagctgacaggaggtggagcccaggcagtactgtgagccatggggactggctataaataccgacaaagtttcactcgctcactcacccgccactcacccgcttacctgccactcacgtactcactcacccaccactcaccggccactcaacagctcactctcccgccactcacccactcacctacctgccactcacctgctcactcacccaccactcaccggccactcaacagctcactcacccaccactcacctcctgctgtgcaccccagttcctaacaggccacagactggtgtcagtccgtggcccagaggctggggatgcctggtccagtgggaagacatgggtgggagatctgggatgcccatggacttttacagagtgtgagtttgggggcaaacacacttggagttggacctcagctctgctgctcactagccaatgatctcagctcacagtgcttaatgttctaagcctcagttttctcatctgtaaagtgggaatcatagcagcagttctcagggatttggtagggtaacccacgtaaacatccatcccagagcctgacgtgccatgagaggctccacagacactggatctcagcttctgccctggaaggaagccactgtccccagaaccacttccgggccagagtgaaggcagctggacagcaggaggccaggcatttgcaggggcggtgcctagtctctgcagctgacagctgtatggaaccctgcagtgttcagtacaaagctccaggatgtgaaggatttgtcagctctcaggcatgcagccctgccctcaccctcctgtgatgaattgggccaggcaaacagtagaaataggagcagtcccctggctgtgcagaaaggcatctgcccactgggctcctgcttgtcccaaggaacacctcttccctccccatggccccaggtctgaggctccatcctcctgggaccagaggagacatctgggccctgtggagtcctaaaccttggccacagcatgacaagggcagggagtgctattcctgctctctgaacccacactcgttctggctgccatgtgtgtgcagcaccatctctccaagcagccgtcttgtggcttccccatccaatgggccgggatttccttgtaatcagccaggaagcattcctactctgtctgccccaacccatctcaagagggcacggaaagggctgggcacctgcaagctgacaaaccccattgttgtgggaacatatgtgttctcgggcacagttccctggtggtacaaaccgttcacctacagctttgccagctacatcggaagggccccatttctgcctctcctcccagaagatcatgtcaaagacaccagcctggccaaacctagcagagaactgagggcccagtctggggaagaatcagctttctgctagaaggaggtgggccctgaggggagcagaggctctccctggaacagaggagctgatgctcagaggggagcccagggcagcccctgagcttggtgctgctgaggtgcaggtctgatgggatagaggctgtgcatgcagaggagagcgggaagctgggcccatgccagtggccctccaagtactcactttgttcatgcagaccaccgggccctggtctgcctggactgagggggttctcagtgcctcaacccagatagctctgagaaactggcaggccacggaaatcatcctggcctcctcagaaagatccaatagttcccaataatcctgccagtaagaatgcagagacagaagatgtacacacacacacacatacatgcgtatgcacatacacatgcatatatctttatgggcacacagatgtacacgcatatacatgtatacacacatatgcatctatgtatacatacatacacacatatacacgtatatgcatctattgcacacatttacacctgcacatatacatatataccagacatctatagacacatatgcacacatacatgcacacatatacatatatacagatacatctgtatgtacatatgtgcatatttttgtacacatgcatgaatacatatgtagatatacatatatacacatatatacatgcacctacaggttgagcatcccagatctaaaacccaaaatgcccccaaatcgaaaactttttgagcataggcctgaccctaaaggaaaatgctgatttggagcatcttggatttcagatttttgtatttgggatgctcaaccagtaagtgtgatgtaaatattctaaaatgcaaaatttgagacacttctggttccaatcacttcagataaggaatggtcgacctttatatatattacacacacacacatttttgtggcttgtgatagtctgctctctactgtgtgcacatcttcccacacctcttcacaaagaggctaagtgggcctttcaggtgcactcagcatcagcagctggcacaaaaccacctgggccgtcacccagccggtgcacacacagccacggtgtgtgtggagaagcaccagaccccatcgctaacgcagaacaggacagggctggccccaagcactcgggtccctcctgcctcagaacaaagccaggctcacacagacactccatgtccccaaggtgggggctcctggggcctctggctgtgtctctctcccttttgaattgcttctgttctgctttgcaaaacactgcctggtcttattattgaagttactttcttgggtttattaagattcttcttttactcaaatattgaccaaggcctgccctgcccccaccgcttaactggcaaacaggctgtggagccataacctgacactagacataacgacacaacgttaatgactttaaacaaccgggagtttacgtcgaatacatgttctatgtgtctaattttcacccctggtgctcatttaaattcttcgcatgttttaaaaatttatgtcttccttttcccatctccctgaattttactccagcctaatttataagaaaaatgtgctttgaacttttaactaggatgctggagaacaagccacctttcattcctgatgagctgcgatcttttcccttttcttcagaccttcagttgatgatgtatttgcacacgcacacacacacacacacacacacacacaggagtatatatattttttctatgcttcttaaagaaacaacaagtccttttaaaacacctttcaaatgcacagtataagaagcactgtgggggagaggaacagagactcccagagaaggagtttccttaatgcttactggaatttgctattttcttcttttcatggaaaatgtgtctgagagcaccagtacagctattatctgtatcctgtggcctttgtgggtatttccaggcagagagaggactgagtctagtgtgcagagcggcactcccaccccacgctgaggcagcgcatccctctgagagctcaggggcagcaagggcagtgagggcactgcatggcgagagggtaacctggatcacaccaatgtgggatgcttgttgccaggctccacacacagtggataaaaccagccttctctcgtgagtgaggcctagacctgcagggtgggaagaggcaggactgggagaaggggggctgggaggaagatgacatcggatctgtctgcagaaatcatctgtcaagagtcagaaggtgtcagatcttgctgaatggtgggtgggtggtctctgcatcacctactggtcacccagtagggcgagaagggtcagaggggagactgtgtgcatgtgtgtgcaagtgtgtgtatgtgtgtgcacgcgtgggtcctcaccttatgtgtcacccctcatctagagctatttggctgggaccttggcattctctggagcagctgcagttacagaatggaagctccgtgcacagtctagaatcatctagagctttttggctgggaccttggcattctctggagcagctgcatggttacagaatggaagctccgtgcacagacactggagttgttcaccactgcagtccctagaacttggtctgacatatcatgagtgctcagcaggtacacaacgaatgaagaagtgtgtggaaagaagggaaggcagtcctcacagacatggaagaaaaattcccagccttagcaaattgtttcatgaagtaggaggttaatcctctctgatattaagagctaataagcattcttaagagctgtatgccaccaaactatgacttcgcgggggcattgggtaaacaggcccctccacacccggtgaggaattagatgctacgaaataagggcttgcgcctgtttcttaaggaatcccttactgtgcaatttttaaatttcccataagatcctctttaattttaacttctaaatataataaggatacatcaatattatctactcttgcatatgtttctactaaataatttcaatagtttttcttgaggaacttttagaaaatgtttattatttcactgtctagggaaaatgttagcaatgaagaaattacaccaaaaagaaaagttgacatattttgccatcatgaaaaacctgcccagagctccacaaaaaatcatgcaacagttcccaattccaaaatatattacaaagctatggttattaaaacaatacactactggcataaaaacagacttatagatcaatggaacagagagtccagaaacaactcatacactgccaagtgctccttcataagcatgaggagaatacaccatagggaagggtcgcctcttcacaggtgctggggaaactggatgtccacatgcaaaagaacggcatcggaccctcacctcacatccacaaaaacccactcaacatgggctaaagactgagacataagactggaaaccataaacgtactagaagaaaacacgggggaagcatgatgacattcatctaggcaaaggtttcttggatctgacaccaaaggcacaagcaacagaagcaaatgtgaacatgcaggacaacatcaaaccagtgagctcctgcatcagcagggaaacaatcagcaaatccagagggcagcccacgaaaggtagggtgagtggtgggtgtgtggtctctgcatcccctactggtcaccggggaggaaatatttgcataccacataacggataaggagttaatatttaaaatgtataggtggctgggtgtggtggctcacacctataatcccagcactttgggaggcaaaggtgggtggatcacttaaggtcaggagttcgagaccagcctggctaacatggcaaaaccctgtctctactaaaaatacaaaaattagctgggtgtgatggcgggcacccgtaatcccagctacttgggaggctgaggcaggagaatcacttgaatctgggaggtggaggttgcagtgagccgagatggtgccactgcattccagcctggatgacagagcaagactccatctccaaaaagtaataataataaaataaaatgtatagggacttcctacaattcaatagcaaataataatgataacctgatttaaaaatgggcaaaggactttagtagacatttctccaaagaaggcatacaaatggccaacacactgtacatggaaagatgctcaacatcactaatgatcaggaacatgcaaatcagagccacgatgagatacgtctctgtacccatcaggaggctgtgaccaaaaagacgtgtgttggtgaggatgtgtagactctgaacacttacatgctgttggtgggaatataaatggtgcaaccattatggaaaacagtatgaagttttctcaaaaaattaaaaatagagccaccatatgattcagcaatcccacttccagatatttatccaaaggaagttaaatcaggacctcgaagtgacgggtgcgctccggagttcatcacggcattgttcacaggagccaagacatggaagcacatgtcccccagggacgagcgggcaggaaagcgtggtgcatagacccagtgggtgctcttcagccttaagacaagacggacaacctgccatctgcaacaacagggataaacctgcatgacatgacgtgaagtgaaacaaaagccaggcccaggacagaggctgcacgacgtcgctgaagcgtggaatctatgacaattgaacgcaccgaagaagagaggaggatggaggctgccgggtctggcgctgggggaagcacgggaaggggccgttccaagggcacaaggtttcagcgacgcggcctcaacgcggtctcgacatctgccgtacggttgagagccaacagtaccacgctgcacactcagggaagtgtcaacacggtgggcctcgctacacgttcttagcacacggaagtgaagtcccatgaaggaagcggagtcggagagggacgccggggcgggtttcacggtggacgaaggagctgcaccccgagaagtccagccaggtgccacaagccagaaaaggtcaggagccgccccagagcgtgcggcccacccaagccctgacttcagctcagtgaaacccatctggaccgtggcctcctgtgagagaataaatctgtgttgttttcctgcaggtttctgataagccacgtgtgttttgggggagacacaggaagccaaggaccaagcactttctgtgcggccgttctgttcttccactaagcgggcgttttccttcccagaaccctcggtggaggcattcagcagccgcctctcctgtgaatttttcttaaatatcatttggcaataaatcatagcgtgcccatcaaatttttccctagagaaaattattatttttaggcctttaaaacatttgctctttccttcttctaagatgatgtttgttttcatgcaggctaagatgtttttacctatactctatcacccacagatttctcaacccagtggggcagaaatggggatttgtgctgtttcatatggaatttgacattaaaaaaatccatgcagctgctctcacggggaggataatatcccccgcacctgggttaacgcagcactctcgtgatgcagagcctctccgtgaataaataaacctcgacagctctttctggagacggcaaagcagtgctccgtggatgaggccgttcatcctgcctcaccgccgttgctcctaacaggggtcgagagactgatctcgaaggcagcgctaagcggaaggcctgatactttcagcgtcggttcagtttctggtctggcgtaacttgcaccgtgtagcggaatcagatgagaggcacaagacgcattgtgacaccacataagcaccacaaagagaaagctgtggattgggtattgggtattcatatatatgtgcatatatatatgtgtgtgtgtgtgtatatatatgtgtatatatatgtgtatatatgtgtatatatatgtgtatatatatgtgtgtgtatatgtatatgtgtgtatatatatgtgtgtgtatatatatatatgtatatatatattttttttgaaacggagtctctctctgttgcccaggctggagtgcagtggtgcgatctcggctcactgcaagctccgcctcccgggttcacgccattctcctgcctcagcctcctgagtagctgggactacaggtgcccgccaccacacccggctggttttttgtatttttagtagagacggggtttcaccgtgttggccaggatggtctcgatctcctgacctcgtgatccgcccgcctcggcctcccaaagtgctgggattacaggcctgagccaccgcacccggcaggtattcatattttaaaagttaaaaaaagcaaagaacctctttctttctctaataagatgttgattaaattttaagtgaacaaggtacaagaggtgaaaacacaacatctatttccacagaacgtccgtacgagggtgttcccaggaggaggagtgcggcggcctgggaggcacatggatgccgagtctttggatcagcagagggtcgttgagtcgctttgaggggccagacactgttgtaggagctgggagcgcagcggggaagcacgctaggggtccccttgtcgcggagaagggacaggcactatagtgaccgggtaatttctagtaaggtgtgatgtgaagaaaggagaagagggcacagtgatggaaggtggggctaagcagaggcctctgagcgttaggacgagaagaagcccagcctggaaagaccccggggagaaacacagaggccacgcaggctggctgtggtgcctctgagggatggaggagggcatctgtggtacctctgagggatggggaggccgcctgtggtgcctctgagggatggaggaggccgcctgtggtgcctcagggatggaggaggctgcctgtggtacctctaagggatgggggaggccggctgtggtgcctctgagggacagaggaggctgcctgtggtgcctctgaggtatgggggaggccggctgtggtacctctgagggacaaaggaggccggctgtggtgcctctgagggatggagggggccggctgtggtgcctctgagggatggagggggccggctgtggtgcctctgagggatggagggggccggctgtggtgcctctgagggatggagggggccggctgtggtgcctctgagggacggggtaggccgattgtggtgactctgagggatggagggggccggctcgggaggtggttcgtgatgccgtgtgttgaaggctgtggatcttgtccttggtgggtgcaaagccagcagacatttccagagggagagggatgtgacttaaattgtgacttagaaagttcactccacgctcagaacactgggcctgaggagcacacgctggagtggaggccctgggccagtcggaggggcagtgtgcgagtcagatgagggacccgcacatggagctggggcaggacctgctgtaggtcccaaggtgaggagggagccctgggctgggtctgctctggtggggaaaatgaaatgtctgcttggccaagttacactggggcctgcagtggagacgttgagtaagtggctagaggaacacacgttcagcgtggggaggtctcacggcaagagatggcgatgtggggtctttggagcctggggagagatgaaggccaggccagcccggatccgaggctgacagcagagagcagggctgctgaagcctcggtgcagggagggcccgttgccctcagcatccctgtccagcacctcccacccacgctccagcctcacccagcccttcctccccacgagcacacagcgtgctcctgctcctgctggccccaccccgatggtgggccaggcccagctgcaaccactacctctctgacccgatggggttgtcatgtctgaagggcttgccacgttattcagtcacatttaggggccaaatctagaagttggagaagaaaggaggagggggcagcaccctagtcacaggggtggtattgaagatggcacgggggtctcctctcctgctgccttcctgggagagggactggagggcacaggtgctgagaagaagtggagtccctgagtggagccgatgggatgtggaggaaggcctgaggagccggtgggacgcccaccctgccccaccccaccccacagcaccagcatctgctgattgagtttaaatatcaacggttcaatgtgtagagccatctgtaatacttttagccccagattctttcacatcaataggcaaaaaagaggtaattaataaaacgaacataaagttctaattatagggtgtaaatatcgctctcaggagaattattaagatgaaggatgggttttgtgattaggagaagaaaataacctgcccaggggaatggaaaggaggcagacattctcagaccagaagcgacgtgtgtgtgtgtgtccgtgtgtgtccatgtgtgtgtctgtgtgtgtccgtgtgtgtctgtgtgtgtggaggggccactgctaacgactgtacagccaaatgggagaaatggccggtctgttactgatgcaaacaagaaagccagcatggtgacaaaatatttagcatggggacaaaggtcacagaggcatccttgtcatctcccagaggtgacaaatcacaggttcgtctcagaggcaatttcacattccaaaaggtagagaaataattcttttctatttttatttttatttatttttttaggactgagtctcgctctgtcaccgaggctggagtgcagtggcacgatctcagctcactgcaacctccgcctcccaggttcaaacgattctcctgcctcagtctcccgagcagcttggattacaggcgtgcgccaccacacccagctaatttttgtatttttagtagagacgggatttcaccatattggacagactggtctcgaactcctgacctcaggtgatccacccgcctcagcctcccaaagtgccgggattacaggcatgagccacgacgcctggcccagagaaataatcgttaaagaaatgtaggaagacagacctggggtcaaaggaaagatgagcatagtccccagtcctccagcttgagagctgcggggcctctggaggttcagaggggtctcaggaatgggctcagaattcaagactacaaaggatgctaaagacaaagattcaggctccaaagaaaggaaggaggacacataggaaaatgtaactgacaggtgcacacccagcctggcccaacgcagcccctcaccatggtctcagggctcagggagctcctggaatgcaagcttcgcgttgaaggatcccacaggcctgcagggcagctctctggccaggccctgccaccgagtggtacgtcccacagcacacccaggagcctgtggccgcctcccgtccgggccttggaattccttttggctgacagtctttgcctgtgtgaccctcacgggatgcctcccacgacctcagcctgtgaccctcacgggatgcctcccacgacctcagcccataagcatccctgtggccagcttgtgtaacctgccaggcaggaggctgggatgaaattctcacttgccacaccttgtaaatatcaggtgtaaatatcaccctcaggagaattaagatgagcgatgggatgtcctgcaggcccagcaacaaggccggactctcctccgcttcatgagaaaatgtgtgttgtcatcagatagcctttggggctgcctgggtgcagattcgaggctacctacttctcatttcacgttggaggtttcacggatcctacatattgcagagaaacctgaggtccgtttttggttttgctttatagtgataaatccgggatgacacagccgtgggccgtgttgagggctgggatttcggtgcagttgaatccccggctgtggccccagtgcccgttcatgggcccctcccgtgtgattctcccagctgagccgtgagttcgtctgagcggcgagtcggaactcgaggcagatcactctttgctgttgagatggttggatcagtgtgccccaaaatctcctgtcgaaccgtaatccccagtgttgggtgtggggcctggggggtggtgactggacttgggggtgatttttgaatggttttgcaccaccctctccttgctgttctcatgatagtgagttttctgagacccgtgtgtttaaacctgggtagcccctcccaccttgcgcctacgcccaccgtgggacgagattgcttccctttcgccttccaccgtgactggaagctccctgaggcctccccagaagcagaagctgccgtgctccctgtgcaacctgcagagctctgagccgattaagcctctttcctagaatcatccagtctcaggtgtttctttgtagccatggagaatggactaataccactgtcaaagatggtccaagtttgtttcctctctccaaccagatttttaacgtttccttctcttctctgcgcctttcccagtgatgaggacagtggcttccatgggcaggcgttcagtaaacagcacccagtgaactcagagctgccagtttaccccgcaggggcagcagagctgactaggattgggtgtagatgagctcagagcccacaaggccccacagggatgtcaccatcccggtaaaatgtgagattcgggaatgaataggaaaatcatgtgcttagtgcacgtaacatcagcagttgggaaagttcaccgggaaagaaaagcgccacaagtcctcgcatcaatacttgcagagacaaaataacctcaaggccgatctttcatgcctgtgcctgggcatccccgcgtctctaaggaggacagttatgtaatttagatggaaaattgacaggactgggcaggtccctctgattgatgtggaggccgtatctcacgtcctggaacgcgtgtgtttatttgctgtttcacggggcgggccatttttctccagccaggaagggtaggggtgtgcaccatagggcctctcccaagttcgcctcggcgcctgcccccctccatcacggtgatcaggtgtggccttagccccaggtttctgagggcgtcagcatcacatgtgtttgttctgcttcatgggctccctccgtcaggcaggtcagggtgtgacatgcaccccttggtgaccgatgggctggctgggtctcacagaaggtacaccaggtgagctgccaggtgccacctcctccacctcccgcctcccgcctcgtccacaggctcaggaaccctctggggatgagcacaagcactttcttttgaaaacgcctccatggcggaagttccttggttggggaggactttgttgttatcaatagcttgaaaatgaatcaagttccctgaataaacatgaggtcaacctcagcaacgttagtttgggcaaatgtcagagcaagcacagaaagtggctggaaggactttctcatgcgacttgtaaataaatgactgccgagtacagaactccaagggccacagatagacagcaccttgggaagaggttgagagttaaagagcagtggttcccagcctcagccccctggggagggtgagcaaacagacggtgctgaggccccatgtggagtcggagattttgcaggctgtggctggggcccagctttgctgcagctcctgggggcctcccaggtgcataggtgaggggcttttagtttgagcaccctccctcctgccaaagtgccccctagatgcacaggtgagggggctttgagcttgagtccccctcccaggtgccacccaggtgcacaggtgaggggcttttagcttgagccccccccgcccccgaccccgccgaagtgcctcctagatgcacaggtgagggggctttgagcttgagccccaggagcctcccaggtgcacaggtgaggggcttcaagcttgacacccccaccccatccccaggtgcctcccaggtgcacaggtgaggggctgcgacgcacagggatccatgtcttagaggaagtttcaatactttataattgcatccccgctaagtgagggaagcactctggcctctttcacatggaaatccctcctctctgaggaccgaggtgatgtgctttagcatgacaatgagtgcaggcagatatgaagtattttgtgatttaaattttgcttgtgatatttcaaagaggtttcctctggaaaaggttactgggagagaaggtagctcactgttctgctggtgagctgtctccacaactccacacatttatcgtggtttcaggctgggtgtcttcaggctccttgagctgctttgcagtaagtgacacaataaaaaatgtaaaatacagaaggcacccacttttcccacttacggttttactgggtgttcacagaggcgatgaagaaatgaaatccccacatttaaacaaagcggagagtgacagtgagggtgatagtcctattgtataattgcctcctttgactcagagagggagagcctattttcatacttatccgaaagcagtgaagcttcaaagaataggggcagacacaatgggctttcagagggaagctgccatcgtcgacgctataattggtcaccgcactgcccgagtgcccgtaggccggccagacgcagaaccggaagtgcaggcagcctgggtggagcagggaggtgtgagcccgggtcagagcagagaacgaggggaggtgtgagcccgggtcggagcagagaacgaggggaggtgtgagcccgggtcggagcagagaacgaggggaggtgtgagcccgggtcggaggtgtgatcccgggtcagggcagagaacgaggagaggtgcgagcccgggtcagagcagagaacgaggggaggtgcgagcccgggtcagagcagagaatgaggggcgagacacaggcggccccctcccggccacctgggccccgagcttgtcctgggcccctcgaggtgtgctgccgaggcccgaaggtggcctggagggtggggacccgggaaggggctgtggggccctcagcgtggcctcagaaacaccgaaagccttgacctcagacctggctctggcagagagggggccgagggaggcaggtcagccctggggtccctgcaaggcggaggaggcaaaggaggaaattgacttctgcctggaggtcaggagattactgcttctaagccatgggaggagaaggggacagaaacacccctgtgtggtgccaggggtgccacgaattatgccattcaggcctccagtggatctatacgtggccctgggggacggtgtctcctagaggctccgagctgctgacaggacacttaaaacccagagaagccaacgtgttttccacgtgtggcagaactcaccattgctcctgacagccggagggcgagcatgtgagaatcccacgtgggaatgaaccacgagcatccacccatcccaccccggaagaggcaccacgccccgcccttgcccccaccccagggtgaagccacgggccctggaggcccctcagatcctttcctcccccaatttctgtgattctacttataatttgaacaattcaagggtcaaactccacctctagaaacgtgcatactcacagggtacacagggggtccacagagcaccccaaaatgtaaaggttatcaccgccgcgagggtcatctgtgacatggagaccaacctctgccatctcacgtaatgaaacacctttagaaaaccttacaatttttgttcatctgccacattcttttcagcagaaactgtatttgctctgcagagggaacagcaggggactctcggctgggcgcctgtgcctgagcccgtcctgggcagctccaggccctcattctcccgaccacaaccgcagctgcagatgcagctgcgcccccttcctctccccgggcacagcgcattgtagaggggtcccattaattctgaaaaaaagccttacaagatagatagaaaatttatctcatttatttaagctcatcactgctgattaatcccaaactggggtcccttgcctccactttagaaaaagagatgagttttaaactcggcacccgcggccctgggagattgatccgcccggtcatgctttgaagttgaagcgcagtgcccatcgattgcacacattaaatgaccagccacgctgtagaacgtacagctcatgaataagaagtacccaagccctcctagtcactggaaagcctcaggtccagccatcacggggcagcctccgggtggcccatctgcgggctgtaggagcagagacccccggccccagcctgggcagacgtctgtcgtgcagtgtggccagcggacaagcctgctttcctcattcgcttacaaggtgttctgtgagcacccagcttccccaaggtcctactgagttgcttgggacactggggagcaggcaaagacgactagcagatgccctggacgtgcaggagccgtgccatgtgggatccccacccccgaaaacacaccctcgagctgaaggcagctggtgctgggacgcggagacctcggctgagctccctgggggtggagatgggcttctctccactgctggctaatgtccgccagagccacagcaaagaggggacccaggagaggtggccccggggagctgaaactcagggagatggcccagggctgggctggcctgagtatagcaagtacgctgcacaccaggcgcagatgccccgctgcgggcgcctggcctctcccgcggcttgctggctcagtgcgggctgcaggtcagaggccacaccttgcagaaggcagatgggaacgcgagccccaccccatgaggcagctcaagatgatctgtaagagtcactcgattgagcggcatgaacggggagggggcttcataaggccagagagttccaggcaggggccacttcgcccaactttgacaaactggcagtgtgacccccagaggggaaggacaggctctccgggcaaaggggactcctccatgacaggctggttttattttatcgaagcacttcgtggaggcctggtcggcaggaaaagccgcacatattttccgtacatatcttcaggattttggggatccgcgtgcgcccctctgatctgccctcttgggtgcgctccgagcgtgctgcacggcgttgctggctgtaggtgcgataccctccaggtcctcaggaaacatggtctgtaccagaaacctcctaggagaacgctttgtgtttgtgacataacaaatgtaagcatttttgatgttcaaagtcctctctcaaactttttttgttgccaagtgaatgtaaaatccagaggatgctcttggtcgagagggtgactaggagacgtgtggatgaagccccagagcccctccgctctcaccaccctgagtagggcaggtgggtgcagggagggggggcgggtgcagggagggggggcaggtgggtgcagggagcgggggcgggtgcagggaggacaggcaggctggcgccaggcaggcgtgtggaggcgggacccgggcacatacatgcatccgcctgcaccagtcccgacctcagagccaagcccagcggccgctccgcttcccaagcacgtaaaacacgccaggcacgagaatatgtggacgcgggcgcttatttcttgttgaattttgttctgttctgttttcaaacatggaatcgggtgttgcatcgtgttccatgatttgctgaaaatacttaacaaatacgaaactgtggaatatcttttcttatcacagcaaatggacgtatctcattcttcttagtcacataaaatatttaaataccctccgcgagagcttgtttgccactcatttatttgctgttgcaggcgatgccagagtgactgttctcatacacatacatgcacttatgctataattcttatcaattagattataagaaacgggattttttttgctcataaagtatgtgcatttttattgccaaattactttccaaaaaggctttatcagtttgcatgtgcaacagcagtatattaaaaaaagttattaaaccttttaacgtttaccaatgtgatggtgttaacttttgattttttaatcattacagaacggaatgtctttcatgtacttatgtcttcccctgagcttcacccgagcagagaaaatgctcctggaccctgtttcctcaccaagttgtaggagctatttgtctataggaaatagcaaacttttaatacttctggattaaaaaaaatagcttaggttttgtgacaacttgaacccaagattaaaaagtattttatattttcttctaattatcttatggtaaattgtttattatttagattttgacctatctgactttttaatattggaatctcacttcattttcttacacaatttcccacttgtgtttatcgggtggattttttctgtacccacgggtttgaaatgcccccttcgtcatacactccaggcccttgtgttgtcacgttcattcctagaccatctgttttgtactactggtctgaacgctgatcttcacgcaaaacacgatttaatacctgcaggagcgcccggtctccttcctgtgcccccagattgcttgacagttcctgagcatgtactccaggacctgaacccaaaccacctttagaaccaagttaatgacatcctgccacccccgcaccacacacacacaccaccatacacacaccacacacattcacaccacacaaacaccacacacacacccccaccacagacacacacacacaccaccatacacacacgtcaccaccccacgcaccacacacacacaccaccatacacacaccacacacaccacattcacaccacacacacccccaccacacacacaccacacacacaccaccatacacacatgtcaccaccacacacaccacacacacacaccacacattcacaccacacaaacaccacacacacccccaccacacacacattcacaccacacaaacaccacacacacccccaccacacacacaccaccatacgcacatgtcaccaccacacacacaccacataccatacacacacaacataccacacacacagcaccacacataccacacacatacctgcacacatactacacacaccacatacacatcacaccacatatactacacacacaaacataccacatactacacacatcacacacacaccacacacataccatatacacacacaccacacatataccccacacacaccacacatgtaccccacagacacacacaccataccacacacaccacacacacatacccccacacacatacacacatgcacacataccacacacacatatcacacccacatttcacaccacacaccacatacacacacactgtcaaaggctggggacctcaggggaccacggagccacctggtgtgtggctgaattcccttgttgtcaggtaacacttttgaagagaagcccaggccgccccttttctctccggcagagacctgaccctggaggcctcccacgagcctcctgagagctgaatttctgaggctcatgaagcccgaaacccagtctctctgaccttgtacaagatgtctgtgcccagggggcctggatgtcccagggtgggtctggctgccccgggaccaccaggagggaacgtgcccaacaggcagcttagaaacagtagaagccagcggcaccgggcggggagcttctcgagggagcggagagtacaaggcccagccagttttgttgtgttgctttcaaagtgtccttcaaaggtgaaccaaattcatcccggaagcatctgacttcatctgtcaccaaagaggaccagcccgccggaagacagtgatttcccccatcaggtgtgggcattacctaaagttgctgacctcctagaatttttgtgacgctctctaattctagcaatttagctcaaatcctaccattctgactgtcctgtagtgactgttacggtgacagcttgggaaatggaggcaggaaggggcgtgagctccgttccttggggaaggtgtgggtttcgcctctgtgagaaaggagatggctccagggagctatccccagcattggagaggtggttccagcggcctccagcatagcagagatgtggccccggctgcctcccacatggcagagaagtgggccggcagcctcacgtgtggcagagggctggccccagaagcctcccctatggcggagatgtggcccccgaggcctcccgcgtggcagtggggtggccccggaggcctcctgcatggcagttgggtggccccagaggccttcagagcacacatcttccccgcatagcccagcagggctgcatgcctgggagctgggctccatgtggcttctcatggtgggaaatctgccttctaggcccttcctaggggtgacgactaagaggtcgtgggggactctttggagcttggggactgctccagccccgtggaggcctgtggagagctcctccctaaaccaggatgggttctggtcacgttggttgatggcacacttctcccagggtctccagacagcagtgtcttgccaaggaggctgaaagcttcctgtactttcttttttttttttttttttttttttttttgagatggagtctcattctgtttcccaggctggagtgcagtggtgcaatctcagctcactgcaacctccgcctcccaggttcaagtgaatctcctgcctcagcctccccagtagctgggactacaggctcatgctaccacacctggctacttttttgtacttttagtagagacggagtttcaccatgttagccgggatgatctcgatctcctgacctcgtgatccgcccgcctcagcctcccaaagtgctgggattacaggcatgagccaccgcgcccagcctcttccctgctttttactggttcttctcttctttggcagaactctgtttgaacactgggatttgcgaatggcagagaggctgggtctggcttgtgtcggcctccaggccccggctgcgtggttcccaggggacccggtgctggctccccattgtccagacctccaggcctgtcagtgtcttggggacgtcgatgttgccagcagcttttatccactgggggtgcagaggtgtgagggagatgccaagaggggaacagcccaccccagcccttggcagcttggacggggcccccaggtgcctcccccagccatgagcacaaatgaagtccgagggaaagatggggctgggctcacccagccaccaccccaggggacccagatggcaccagctcaaacaccaccccgtctcccacagagcaggtgttcagggtgtcccagggaggccccggtcagtgtgaaatgcatgtccttgtcctccaggtcacggccactctcctctgcctctctctctgtggggtcgcctacaagacatgaaggacaaggagagaagcaggacgtgaggcccaggggctctcctggccccctagactgtggggaagccccctgcccgccctgcccactggggtgacccaggcacagcaacagctgggagtccacgcgccccccaggcccaccggctgctgcgccagactttctatggcatcttcagatgtcactcccagcagaggccagaccccctcctgtcgcagtttccatcaaggtggggcctggaggccacggatgagcccccttgctcacctgatccccgacaccccagaggggttgtgggcatccactggcacgcgggggtcataagtggcatccaagtgggtttcccacgaattgcttccagaagagccagtcccgggcagccacccccgcgtcccccgccgcacccgcgtccgcctcccgggcagccacccccgcgtcccccgccgcacccgcgtccgcctcccgggcagccacccccgcgtcccccgccgcacccgcgtccgcctcccgggcagccacccccgcgtcccccgccgcacctgtgtccgcctcctgcccctcaagctgtcccaggctcagtggcttcctcaggccatgggacctacagctgacactggcactctgtgtgcggtggtgcagacagcactgtgggatgtgccagagctgctccctgcacttcccacagtgggcactgagctctgggcactgggcaggcaaggccaaagccgctggaatgtgccacccacctgatgatgaaaccacagcaggctgaggttctgtgagtcttacgcgtttttaaatgtggctgtttctcttctaaatgttaccgctgccacatgaattcatgtttccaaacacattgcaatgagagggtgctttctgcacggatgtggcctggtgtggccctcaccggcagcgcctcaccgtcctctatctctggggaccatagtgaggctcctgagagtgggagcgagcccggtcctcaccccgtcaccaactacctggggacagccactctgtgcttccagcctcaagggactcacgctgtggacaagcccagtttccagtgccatccacagctgggacagtgcccaggagtgctttgtgaatgggacgaagatcacagcaaatgagcccacctctgggggcttttcccagaagtacaataaataatcttccttcttagacttcatggtccttaaactttataacaattcagatacttaggcagtttttcaaaacatgttgatttaaataaatactgaactagcactaaatgctggtgagaaaaccagcaagactaaagccaggatacgtgaacggtacctgtggggccctaggtgctagtcctggttaatattacctgtgccgttccccgtgtggtttgtgtgagcagggagaaccccacgcagggctggcccgagggcctgggatccaccccacagcaaaagcgctcagccagctgaagcccttggcgcgcactcggagtgcggctaacgctcgtgccccacagggggcagaggaggccaaacagcaggggcctggcacttgcacgggaccatctctcctgggagcagcagcacccagagccggcccagggggtccctgcagccatccccacccggccctcccaccctgctacccaggtgagcaggctggtgaacacgcacacaaaaaaaaccagtgattatgaactccaggaaaacctccgctgttgtgcagaagggaaaacgcaggcttcagctgggccccctgcgcgtctcagctcccagccgggcgtggcagctgctagactgtgtacctggaaaggatcgcgattcttctcccctcccgccatgcttcccaggccggccccatgcccatctctgagcaggctcccccttggtgtgctgtgcccacggtctccgtctctgccctctgcccaccgtctgcagaaagcagggaccctggtcctgggagaagcttccctccatgtctgtccagtgtagactgttcagatttcagcagagaccaggtttgcggatggcacccaggcaggtcgcaggcgctctggtcctggggaggcctgcccgcgagtgctggctctagtctgggagtggggccggcctggggcccctctgagccctgccccaggctccaaggccttttccaccaccccctttcatcctcgggggcgatttcgttttggagcaccgtggtctgttttcactcagtggctttggggttggggggacccgcggcagctgtggatccaccgtcaccatagagtgtggatttacaccactggccttggcgccccagacagggcaggccgcaccccggtgcaagcctgtggggcggggcgtgtccccacgtgggcccgggttatcctgctccatgccagagcccctgtggagagcctgtgctggctgcttctcggtgttcggtcagccttctcgccgctgtgccaacattctggaaacacacacacagctttgttcaactcctatgacgacgcgatgaaacagcggctgtaacagccgttacaagtggaaaaatggaaactgaagagaccgcgtgacctcagccgcctggacagagggcctcggctccctctgctctcctctccagccccactgctcacctggccactggggaggggcgcgtttcctcagagaaacagctgcccacccatttgaacaagtccaaaaatatcttgaccttattacttgtccaggccccctgggcccctatgtcgccccacacgatgggttcatttccttccattagctgcagagaggccgggtgtggggtcagggtttgcggtgaaatgtcgagacccagggggccctcggtttgcactgccacgggatcagctcagcccctgcccgtttcatacgggatcagcccagcccctgcccgtttcatacgggatcagcccagcccctgcccgtttcatatgggatcagcccagcccctgcccgtttcatgggtcagttgctcttcaagccctttgtggagaggagggtcaggccgagcgggatagggctttctctccagcgctgaggctgaggctgaggtggttcctgcagggcaggaaggttcccgcagccacagcttttgcaggtgaggctggacccagccctgagccttgtgggcgctgctgcaggtcggcatcttgctaggagcacctcctccagtgtgaagcagcaaacgagccccgggtgaaggttcgaggggctgctgaaccgcccccctaatccgtcactgtgcagatgctgagaccccagaggtgggggcaggccccccacttggcctcctgagacctagttggtgcctttccaactaggccaggctgactcacgagctgctctgggccagaagccacgtggtaagattggtccctggcctaacgttgagctgcctgtgccctgcccacaagcagaatttaggaatagtccctggaagcagaactaaacacacccatcccagcttccttctcctcctctgcacttacaccatgagtgtctctaccttgagagacttaaactccaaccatgtgggaaatgtttcagccactcatcctgaatttactcctgtgggacagcagctgcgctctgcttgaaagagtaagagatggaatatcctccattcaaccagcctcccagccctctggaaagacacctgccttcctggtttcacttttcttcttgaatgaaaacagggcagtgttcaagcctcagagggcctggagcaaagatgaaatgtgaacagcctccggaggaaatcactcaaaagtagggtcatacgaatccacatgggaaagtccctgttccgagtaagtgggagtggggcgggaggctgaatccaggacccacaggtgggacaggccttcctgccagggcgtcttctctgctgtttcaagagggctcctggaatcttgtttactgccatacttttctttgcagaactttttatagccaggatcggtcaactttagtatggactccgctggcccctgcatgctcagaattagtggagttcttagtaagatgacttcatactagattaaataagcacaaggtaatgttcaggattgtgggctgtcagctcctcttgggccagcagtgccgaggaacatcaggctcagacatgcgttcgatgaaccttcctaggtatggatggacgtatgtcccaggctgtgtggtgaggaccctcccggtgtgctgtgcatgggagtgtccattgtgcattacatattcagatgggaacgtgagtaacaggccacgtgtcacagcaccgccaaggcaggtgtattcgtctgttctcacgctgctaataaagacacacccaagactgggtaatttatgaaggaaagaggtttaatggactcacagttctgcagggctgaggaggcctcaggaaacttacaatcacagcagaaggggaagcaaacatgttcttcttcacgtggcggcagcaaggagaagtgccgagcaaagggggaaaagcccatgataaaaccgtcagatcttgtgagaactcggtcactatcatgagaacagcatggggtatccacccctgtgatgcaattacctcccaccaggtcactcccccaacatgtggggattatgggacaattcaagatgagatttgggtggggacacagtcagaccatgttagccagccagcaccgagtgcactcaaggctccccgagtcaagcagccagcacattctgtcatcccagcgcctctactatttaaggaaagagagcaaagcctttattttcattgtccattttcctctgattcctctttccaaactgggcatttttgtgctggaaagaaatcctgaatgttgatgcgatgctgtgtgatcatctcttgggtagtcattttccaaataatttcttggagtaccgacactcgtcgttctttcagggacccctgggggcagttggtatattatacatgtatgagtttttagatggctcctctctctcaggttatttctgctgtttctgttaagattatagacaacataactgggatgtgtgatttcataggttgaccctgatcagcttcccatgcctggatgatcagtaagaagccctggaccccctctgtggagggcgggctgcagctcctacccttagagctgattcaccgttttcagatactggggccaaaccggccctcccagacgcctgctggaaccgattccgcctggcactgcatgcatcccaacccggggccccattaattctcggatgcctgagtccagacccacttagcgtggttgactggagcctgtgccagggctgagctcatgagctgaattcttacatgaacaaattacttgcagtttggtctgtggctttgcactgcacacctctgtggccgcccctcagcatggggtctacggtcctgtgcagagcaggcgaggcctgggtaagccatcagggcaaatccacccacacctttggcaaagccagcccaggtctattccctagggacagtgaaagagatagcataggcgaggccatacctgtgtgcccgcacctgggaacctactcccgtctgtggcaagcttggaggacagtggtggctgaaaatgcaggaagcttctcaggcatatgggcatctgcctgaagctgctgtgtgggcatttcacatccacccctgaaagcccagaaagggctgacagctgctgccaaagtcagtggggtgtggtttgccacagaagtcagcgacagcagtgggatgtgatttggagctggctgggaggctggggcagggtattgaggctgaagtaatatacgttttgggtactgtgaagtcagatgacttgataaagatgcagaaataacgatttgactgagggcaagaaagcaacctgggaggaagctgggtcagcttgtcctcagtcaggaagcttccgccatgcaccatccaggagctctcccagctgcacgcttcatactcgaacttgtatgagatgggaacccatgacaataaaaccaggctctctgggatagtattgaaaaagtggaagttttcttagtacagattcatctcaccttgaagtctgagagcagacccagaagaattgattgcagtggtcgagtctggcctgattcgatggtgtttgctgcatttgctgggaccagaagaagggcacgcatgttgtaagcactgtcctcaaagagacttgacatcaacaacttggcacagggagggttaactgtgtgttattctgaaaatatgttttggtccggacatgtccaggcggtaatgtagcagaccctccactttgaggagatgataataacactagcccatgtgtaatatatcaaatcaaaagcagccgtggacctgggaaggacagacttttcatcaaaaggcctggtgctgtggggtcagggctgtggcagggcagtgctctggccataggaccgcaagcactaccacagccaggcgaagggagcccttgtcttgttccgcagaggggagtgagcatggctagaaggagccgcatgtgggtgacgtgggtgtgagtggaccaggatgtggggtgattgtggccgtgagcggcaggaggccagagaaggtttggcctggagctgcctggctcaggggctgcccactgcctcggtgggggtggtgagagttcaggtgtgcactgaggagagaagtgaaaccgacctttggttagtgagtattctgtcctgattgatctgtggggacccgcggggcagctcatcacggatgaggcagagaaagcgagtttggagagctcgtccaccttggcccgggggcacatgcaagcaacagtgtcaagtgctctctccgtgctgggtgtggccccatcatgcattccaacatagggaatacccgtgaccaccctgcgaaatgggtgaagccccattgtgcaaacagggaaactgaggcacagaggaaggcagtcccttgtccaggggcctctcacggtgaaggcgtgcagagccagtactggaagccagcaagagggctgctgtatgcctgacttggctgccacggtctgcaccatgtcgagctgcctgtggggacaagcgaacttcagttgctctgggccgtgttccgccatctgatccagcagcacggcccctccgccagccaagcctccttcacactcctgaggcctcgctgagcagccgccaccccttatataaactgacagatatggctggatgcttcgacgtcacctaaagcttcaccttcagagtgtgcactatcccatcctatttcaggtgttagctgggagtgggaaggccgtgtgtaaggagcaaggggagcgagcaaatgccttgctctgaggaacgtccttgtgctggaggtagaccaggaggacacacggcccagaggctaattctttaatagtagagatacgtggtgggatcataaacaaagacagtttcacgggcttttgctcgtcactagtgagccctaattataaagtatcgaatcagaattcaactagccaagccatcatcaaaaactcatagcagttcatcaataagtgtgtaaaatcctactctccatggacattgtggaccttgggaactggggtcagcatttttattaacccgtgtggacacagcagtctgagagttttccattcctcgagggctgcttgcggcgtgttgtacgtcgatggtatcagtggcgtcccagccctgcttgggaggacacacactgctcattttcagcaaccagggagaatgaaatcacccagcactcttcctcaggctgatgacctcggggtgccctgggtgacccagccatagggtgagcattcaggccacagcgccttccccagaccctcaggacccctcatcaggacatccttctggccggggcccctcaccccagctcgtcctggccagagtctagggtcagcctttgtgcttcggagactcctgcagcagggtgagaagcaagttatttagacagagaaggcaagcaccggagacagcctgccgcccccaccctccgtcgccctgctggggacaacgtggagggcactggcctgaggagggaatttgggggttcctgctgcctgtcaggatgtggagcacagtgcagcagtgtgtggtgaggggcagcgggtgggcggtcattctggcagcctgcagggtcccaggaaacacggtcttctttggtcagatgagaagcaaggccttgctcagcacaagcgaccagcacgtgacctttcacctcaggtcaccaagagtagcaacagttaggcctcctccaccgagcacatgccttgctgaccttgcccagggaagcctggcagccagggcggggctcccatggcaaggaggcagccctcctccaggagataagccgtgtccagcatcctcaatgtagcgctactacctctatatgtaaggcctgcacctggtgacctaagtcaggttttgcttctaggtggcatttgcttgagggtcccaagaccccagggagggcactgtctgaagaccccggcacaacccctcagagaacacggccacctggctgtgagcggagctctgcttgagcgctgtggcccgtttccagcataaagcaggaagttcctgggacttgagctgagcactgtgtggcttcatcattgttttcagaatgtggtctgtccagagagcagtggcataggaagacattgacttgttgcatatgtgggcattcagcgcctgtattcacgtggacatgtttatgtgggcattcggcggcacctgtattcacgtggacatgtttatgtgggcattcggcacccgtattcacgtggacatgtttacgtgggcattcggcacctgtattcaggtggacatgtttacatgggcgttcagtgcatgtattcacatggacatgtttacgtgggcatccagtgcctgtattcatgtgtacatgtctacataggcattcgatacctgtattcacatgtacatgtttatgtggacattcaacacctgaatgcacatgtatgtgggcatccaacacctgtattcacatgtacatgtttacataggcattcgatacctgtattcacgtgtacatgtttacatgggcacccaacacctgtattcattcacctgtgtacatgtttacgtgggcatttgatgcctgtattcacatgtacgtgggcattcaacacctgtattcacgtggacatgtttacgtgggcattcaacaactgtaatcacatgtacgtgggcatttgatgcctgtattcacatgtacatgtttacgtgggcattcgacacctgtattcacatgtacttgggcattcgacgcctgcattcacgtggacatgtttagtcgtcagcctgagccatgcaggcggagcgttggcttttgagaaggtcagttgccttcctcacttcctagcctgtccccagggaggaaaacagggagtctgtgtgttcttggagctctggtgtcaccgcggagtttgctgtgctcactttagactctggttctgtaacttttaattccttcagtggttcctgtctgaattggtttttgctctcgtttggtttgaattggggtatttttttttttttttttgctgtggtgtaaagatttttctaaaggtcctttaatgttatacaagtcaattatgcatcaatattatggattaaaccattttcctcagcagtggttgaaagaaactagcttttcagcagacatcttattctggtggatctttcagtgcttttaaagtaaataacaataaagaaattttcatttctatttcaaagttttactgtaggcattgcatgcagactgattataaatgagcgagcctgcccttcccactgggatgtgaagttcgctgaattatgtcagcagcccaggaatgactgctgtgcctaagcacaccttctggccctagctctgaatccacatgtgtgagaggagcatgcatgtccctgatgcagcgggactgccctttcatagtgtccgggggacaggacatgacaggcaggatctgccagagccttgctgcatccctgagcttagcagtgtggggcactgcgtgtcctccggcatcaggaaggctgcgtccctgagcttagcagtgtggggcactgcgtgtcctccggcatcaagaaggctgcatccctgagcttagcagtgtggggcactgcgtgtcctccggcatcaggaaggctgcgtccctgagcttagcagtgtggggcactgcgtgtcctctggcatcaggaagtcacagtgcatggccccttctgtaactcagcgaccgacatgggcgtgtttccaattccacttgtatgtgtttcttgtgtatctaacaagaatttgtggatctgtttgaatgtgaaaaaaatgcaagcattctctaaaattgaattgtgtgtggagaaaatgatactgaggataaaagtgttgaaaagagaacaggaaaagcggagaaagaaaatgagggaaaggaagagaggaggaaaagagggaaagccacagcaccagaggaggggagtggagaggtagggaggaggaggagagggaagaggaggagagggaagaggaggagagggaggaggagaaggagaagatggaggaggaggagagggaagaggaagaggagaggaaggacgaggagaagagcgaggaggagggggagaaggaggaggagatggaggaggagagggaggaggaggagagggaggaggaggagagggaggaggaagagagggaggagagggaggaggaagtggaggaggaaagggaggaggagagggaggaagaggaggaggaaaggtaggaggagagggaggagagagcatgaggagagggaggaggagagggaggcggaggagagggaggcaggaggagggaggagcagaggagggaggaagagaggaggaaaagagggaaagccacagcaccagaggaggggagtggagaggtagggaggaggagagaggaggagagggagaagaagagggaggaggagagggagaaggagagagaggaggagagggagaaggagagagaggagagggagaaggagagggaggaggagagggagaaggagagggaggaggagagggagaaggagagggaggaggaggagagtgaggaagaggagagacagaggagggaggaagaggaggaggaggaggagatggaggaggaggagagtgaggaagaagagagaggagggaggaagaggagaaggaggaggaggagatggaggaggaggagagggaggaagaggagagggagaaggaggacagggaggaggtgaagaggaagaggagggaggaggagagggagaggagggaggaagatgagaaggaggaggaggagatggaggaggagagggaggaagtgaaggagagggagaaggaggacagggaggaggtgaaaaaggagaggagggaggaggagagggaggaggtgaaaaaggagaggagagaggaggtggagaggagggaggaagagaagagggaggaagaggaggaggagagggaggaggtgacgccccctccgcctcactccttgcccacctccgagtacacagctggctgcggctatccccccgggcccagcccacctatgcacacctctgagtctgcattttgcggcggtctcctcactgaccatccctatagcatcacagagacagcggcgttactgtaggtcatgaacagaaacggctcaaacaactcaagaaacacagttctggccacgccaggcttacttggtgagcagatgccctgtgaggaacccagcctgcaggcctgcgggggacaccatgacccgggcctggggcaggaaaccctggatgccccagcaggtaccccagggcgtggagcttccgtccaggctccgtcctgcccttgtgtggggactgccccgaggctgcgcccgcctcagccccacacccaggcttgctgtcctgggcgactccctgcatgtgagcgccggctcccgaggacgaagccttcccagcgctgctgtgtccccatgtgccccgggcgtgctccacgctcctctcctcgaggcatcgagtcctgtattcaggaagcttctcacgctgccgcctccgccctgtgggttgaactgcaagggtttgttttccttccatccctcggccctgtccatgctggttgcaccttcactgtccccgttatgcctatgggagaatagggactgcccagacccagcagggtgaggtgaggtagcctggccactgcggctcatgaatttgggtggaaactggggtcctgtggatttctgtccctctaaagagcagctcatatgacagtagctgccgcagacccgaagggtgagagcgagtggttgccacacacggcgtcctgcagagtggcgccatcttcccaagtcacatctgagcctacactgccgtgacggagtgaggcgttccgagactgttcgcgttttcatgaaacgtttctccttcctgaggactgagggactccctggcatgtggacgttttcaggccctcagactctgctgacagcagttaggatgcaaggccaccttctcatcttccctgactttgctttcattgtgtcactgttctcatcaagaactttcagagactctggcatgtaagtagcagaagaagagaccatgttccttgaccagttattatttcaggccttttacctccactctgacttgtcctcatggttcctctagaggaagcctcccccgtcggactggtcctctcatctttggaagcctccccactcggactggtcccctcatcttgggcagatttctacttcccattgttgactcgaagacctcccctgtcgggcgtgccctctgctgtaccatgaggctgagtcactctggggtcctggatccagcccaaggccagcttcctaaccccttaaccgcagttacagctctgagccctgagcccacttttgccgacactgtcaccctccacgcacactgtcttgtgcacatgagccggtgtgtggtctcacaacctagattatgaactgcgtgcagagatggggggcttaccattttcttaaactcactgcagctcaacttccagtgaaatcttggttgggaagaataatattgacgtggtttatcccttctaaaccctcgcaggcccaccctaggattcaccaggcttgacaggcatgatgcccaggccatgctgggctcctgcatagccatttttacttggcctgaggccagcaaccctaggcattcccttgccctgttgtataaagacatcatggaggatggtgcatattctattcagcgcatctctgtgaggactcctggaacatttcttttttaatttaagaatagctatgattttcaaaaaatagattgtctgtttttgtcatatagacattgtggatcctgttcctctcttccccgtggcagctagggagctcacagccccatccgtagccagctcctagtaagtaggtccgtgtcatgggttttgcatactaacctcattctaggctccaacttatttcccattcttgttttccctatgttttctttttgtcacctctttttaaatatgtgtttactttgctaacttgtatgcatctttctggaatgaagtgaggtataaatgaaaaagcaaattacttagtgctctgtatgacacttaggatgtgctgtgtagagctctcagttggagtttattgattcattcaccaactgacttcaacttggatcagtccagttattgttaccatcatcacaaagagtccagaactggatgaggcggacacaagccccaccaaccaggacctgggggctgaggttcgggaacaaagacaccaatgggcagagaaattgaggctgaggaagatacagctccaaggaacagaggcaacacagacagagggaggcactgggccaaagtctgggtgagagggccctgggcttgggtgggaggtacagcaagccgcctggccccacagcccactacatctttgtgaagctgatgttgagtgcataggggcccctggccctcgcagcgggctgatggagaaaactgagcacgggctcttctccccagatgaagacacgggtggtgctgggaagaggcaggtgggcttgagcaaaggcgtctgtggggactgcagagctcgtcagggtaagagtcccacgcattgtaagaacaggttttcatctcctggaggttgggagccgcctctctcctgtttgttttctaggcatgactcccactcacagaaggggctgtgcttggtttgtgcttctaatgtccgcgtagagctaaacctcagctaaaggccagccggagcatgaccaaggaggcttgtcctgaagagagaggggtcagaaaagcggaggtggaggacccctgcctccgtctgctgcgagtgcctagaacgaggtcctcgcgatgagctgctggttggaaactgtagcatcttgatggtcccagcactgaggatgatgtgtggacatctgtgcaaggcaccttctcacccaggcctggatccagttctgggagttctgggaagctggttgtatcactgcccatttacaggggagcaggcggcccaggaagaccccgccagtacccagtgtacacccggagtcggcatgcagcctggaccatatcacccaggcctccagctccacggctccaagccacaccctggacagccacccgtggcctagcagcacatgggacctcgcacaaaggagctggggcgcagaggccagagaagaaagaagatgcaaaagcgaccaaagactcaatgtgtttacgtgtttgttcaaaaagatgttctcccaccccccacaggggtccccccagacccggccaagagacccaacgctgagacccaatgccgagagcctcgtgtgtcctctggggtcgccctgggtgccagctccacctgattcatcctagagagagtgtggagctgaggccgcccgcagcaggattcgcccaggtcacagtcgttcacaggcggttccgggagcaggagctgcacctggatcaggggcctctttccacttcctgccccaggtctctgggcagcactgagcaggactctgctgggctcacactgcagccaccatggtctgcgggccagggctctcacaaactgtgtttgtgtctatgtgtgtctctgtttgtgtctgtgtatctgtgtgtgtctgtgtctgtgtgtatgtgtgtgtgtgtatgtctgtgtgtatgtgtgtgtctgtgtctatgtgtgtctgtatgtctgtgtgtttgtgtgtctgtgtatgtctgtatgggtgtctgtgtgcgtctgtgtctgtgtgtatgtgtgtgtgtctgtgtctatgtgtgtctctgtgtatgtatgtgtgtctgtgtctgtgtatgtctgtgcctgtgtgtgtgtttgtgtctgtgtgtgtgtctgtctgtgtatgtgtatgtctgtgtgtgtgtatccatgtgtgtgtttgtgtctgtgttctgtgtgtgtatctgtgtgtatttctatgtgtgggtgtctgtgcatctgtgtgtgcgtgtgtctgtgtatgtatctgtgtgtgttcatgtgtgtccgtgtgtatgtgtgtgtgtctgtctgtatgtgtgtctttgtatgtgtctgtgtgtgtctctgtgtgtttgtctgtgtgtgtttgtgtctgtgtctgtgtgtgttcatgtgtgcctgtgtctccgtgtgtgtctgtttgtgtcttgtgtctgtgtgtttctgtgtctgtgtctgtgtgtttgtgtctgtgtctgtgagtgtgtgtctgtgtctgcatgtgtgtctgtttgtgtctgtatctgcgtctgtttgtgcgtctgtgtgtgttcgtgtgtgtctgtgtgtttgtgtgtctgcatgtgtgtctgtgtgtttgtgtgtctctgactgtgtgtgtgcactgccctttgcactgctttgccagcacattttccctgtgccgtgtgtgtctttctcctccactcagttgtaagctccctgagggcaggggctgtgtctcactgctctgtggagtcccagatccagcactctgcacccgtgacatggtgggtggctgttaaattgagttggcaaagaggtgtcagtgtcagctgctgcaagccacagaagggcatgaactggcagcaggtgggattagttttatatcagagatggagacagggaatgggggggcaggtaccccaggaatctatatctgcatagcaaattatcccaaattggagagccctgttttgctctcagctctataatctggtcaggcatgacagggaagtcttgtttctgctccactggcatcagctggagtggtccaagggggctggagggctcgccccaaagagggcttgtctacatagctggcacattgtggtggcagttgtggagctcagccagggctgtggctgggagctctgggcctctgcatgtggagcctccacaaggctgcttgggcttcctcacagaatggcagcgagtttcccaagaacaagtgtcccaagagaggaaatgggagctgccagtctctcgagtctgagcccagaagccagaaactggcagggcgttacttctgctgcctcaaccggccaagcgggcccacagcccccgcactcaggtggggaggacagaggtctcacctcgggggcaggtgcattctgctgcctcaactggccaagcgggcccacagcccccacactcaggtggggaggacagaggtctcacctcgggggcaagtgcgtcagagaatgtgtggccctcttcagcacacccagcaatgaatctgaatgcaggcgcctcatgaccttgctgtgtctggagctggctgaacgctcttcccgaggatgtccgtctacccgagctggagggatgtattagaggatacgaaggaagatttgatgcttttttcagatctgctctgtcattgggcaaaataagctcccctatagcgctaatttttaacaaagatttctccccaaaggagagagtaggatcatgtatttggaaaagctcacataccattgaatgaaaatgaaaagaaattagcttcacgcattcataattcctacattctctgggtgcacagggcctgacaacagcagaaagcctccggtttaacgtaaagaggtgggacctgctgagaccctcacctcagaaagtgcttaattgaaaatccagtttctccacatgatgctgctaagaatatttaattagcgttatcattaagcaagggtagttgttatactgacatcatgcattctgtgactgacacacttaaaccagcagaaacctccagtcatattctatctacataaactctgctctgaagctaagcatggttccaatatgttcctgaaattaaattcactggattaaacaaatagaattaagggtgccagaatttcatctctaaattgcagagcagtgttctagaagcagaagcagcattcaccggggccggtggcagcgggaagtgaaagtgctggggaggctcggagaccaaggaagccacagagaaccccaggccggacgggctgctggggccaagcgtggatgcggtagccgaggtcggggtgtgtatcctaaagcccagtaagccatgatgcctgcaccagaggccacagccccacatgtgctttcaggccatctgccgggtcttgggaagaataaagtgtgcaaaggggcgggtggcagggaggggcccatggcagcccccagggaatccaggtgaggagcgcctgggatagtgttttagatgtgaagcctgcaggtctgggagggagctgtggtggagtgggaggcaggaacgcgctgagccacagggagctgcggaagagagttccgtgtggaggggctggtgacatgtctgctgtgctgttacaaatcctggtgaagatgtgtgggtgtgttttatgcaggaccaagggagcccgtggcgtggctaaagccaagcccaacatcttctacccaaggcctgcagaaggtctggggtgtatcagcaacccatactgtcttcagtggagttgtggtggctgaattccaaaatcctatctgtgttccatttgcctgttgacattgctgtgatgtttccataggtgcttagtcaacctgtcacacctagaagtcaatacaccttccttaactgcccccccgacaatgaggggagtcatccagggaaggggtgtggaattccagcagggcgagctggttgccggcagctcattagctgtggcctctcagattagcagtaattaaactgtgaaatcagaccagcgccttaagcctggatgccgtcgggagtggcctggggataaatcaccggcatgtgttggtccttgcttggcacgggcaaagcgtgtggggggcggaataatgaggacattcaaccgctgccctcggtggacactgggctggccgcggtggaggcgttgtcatgacgatggctgggtgcaggcaaacgctcctcccgttcgctgtggttaatgaagatgatcatgaaaaattatgccaacattacggccatatttttatgctgactggcacgtgcaacctgatgccagcgtcagcacacagcggtgacagtaattatgtgttgacaaatgaggggacaatgtgaggaaatgtctgactcagagatgtgtgtgtcgacttcgccgagtaacttcttccgagggcatgtttgttctttaaagcctccataggtgccatggcactgtgggtgccaaaacaccccaatcacttgtccttattttctaaagaaagacactacaattaaagcagaaactgctcccctaagcagaatggatgagatcgagataaatcaatgttttttatattttaaggaaatcagtgtgatttccaaatgatttttccaaatgacttttcttgtggggtgatgtgtttaggtttttttgtaactgattttgtttctgaacagaaacatctggggtggagctggggctgggctggggcgtcgcagcccccttggcctctccaggagctggggagcctcacgtcatccccatcatggctccttgaagacaagtgttgcggccgcgtgctctcatggccgggatatgggaacgggaggccagcgtggggcgtccggcccggagccacactctgtcactgtaggggggtcgcttcttggccccaaagcaaagcctgaggatgtagcgtgcggttctgcccgtgtgctgtgcttcagtgaacacactcagatcgcacagccgaacgcagatgagctgctcggaggagcagaggacgatccgttgactgtaaaacaggcttgctgggcctcactctctctgcatctcctgtgctctggatttgatattccagcaatctggggaattcatagccacaaatataggttgcagtcttgttagtgaaatctttttttattgattttgttaaacaaagatgcttaagtagttgcaatctgaagtagagtttgtctttccagtttgttcttgtttttaccgtttggaagatcaatattagtcgccacactgcagagtgtgtgactcacagtggcaattctctttttaccgctcggtgtcagcaataagcaggaatcgtgtatggaagcgtcccatgactgtgccttcatgtccttaatgtccctcaagcgggctttcttgcctcctaagtcctacctgccttttgagtttaaaaacaataacaaaacaaacaaacaaaaaatagcaaggagcacagagctggaagtttctgcttcagctggggcctggctctgctccaggtctgagcctggcaggccttgccaggaccactggttcccaccgcctccacacacacacagcgtttctaagaggagcaggagtatagacagttctcaccacactgcagaggcacagcaccaaacagaacagtgttcgcctgtgaccacggaaggcagactggcctggcagtgaaagagcggtcgccctggccagttgctgacttgcacccatgggcactcacttccccaatgcagtgtttcctgggagagcaggagcattcttactgctgtattcgtgagcattcttactgcagggtgtgactgtgaggacttcccagccatttgtacgcaaaggcaaacaccgtacaaagtgtcaggcatcattatcaaggtagaaggagagagaaagattgggttatcctaagaacacagataacatggcagtcagtctcattgtaaaaccaagatgccaggaggaacagggaaacccctccttcttgttcagaagcttccgtggtccccttaaattggtagggtccaaggataaatctggtacaaggcgttcataagccacagatggatgatggacgtggagtgctgtgtgcccagcacagcctggctacttcatgtcaacctccctgcagccagggaagctcagtaccttgcccagagctcctcatctacactgcaagtgccaggatttgaatcaagacgtgccaaggcctggcccctaccctgcagggggagctgtggcaatggcagcccctggagtgactattgtatggtgctaggtggtgccaggaggagggctggcagtgtccagagggggacaagccactcccagctgggtcatcagacaggattccacccacccggcaagagccagtgctgagagctggccaggaagacagagacataagcccagaaaagaccatttctggtgccatcaactacaagtagagggtgaaggccccaacggaggtagccaaggggacgtgtttcgagagccacctgcaaagtggccctgtgtctcacccagcctctgagatttcaatgtcctgtcctccaagaaatggtgtctcagccaaatgctatggagcattgagcaagttcttgcagttctgggtaccttagtgtctcctccataaactggggaaaagaataggacccgcagcacaggcatttgtgaggaacacccaagtcatccaaacacactctgcaagtgccagcaattctctaggatagaagctctgagaatagctttttctgattcctcccgtgtctcttcagtgaaagtgtttgtttatgggtggatcaatggatggatggaggaaggatgggtggatagatggatggaggaaagaaggatggatgcatggatggatggatggatggtttggttgacagatgagggatggtggttggatggaagaagagtggatgatggatgggtagatggatgatggatggatggatgaaggaaggatggatgggtggatggatgtaagaagaatggatgatggatgtgtgggtgaatggatggaaggatggatggatggaggaaggatggatggttggatggatggatgggtgtgtgggtggatggatggatggatggatggatggattggtggacagatgggggatggtggatggatggaagaagagtggatgatggataagtagatggatgatggatggatgaatggaagaagaatggatgatggatgggtgggcggatagatggatggatggatggaggaaggatgaatggttggttggatggatgggtggatgaaggaaggatggatggttggatggatggatgggtgtgtgggtggatgaaagaaggatggatggatgggtgaagggtggatggatggaggaagaatggatgatggatggatgggtgggtggatggatggatggatggagtaatgatggatggatggatggatgagtggatgagtggatggatggaggaagaatggatgatggatgggtgagtgaatggatggaggaaggatggatggatgagtgggagtttgggtggatgaaagaaggatggatggatgggtgaagggtgaatggatgaagaatggatgatggatgggtggatgggtatgtgggtggatgaaagaaggatggatggatgggtgaagggtggacggatggaggaagaatggatgatggatgggtaggtgggtggatggatggagcaatgatggatggatggatgagtggatgggtggatggaggaaaaatggatgatggatgatggatgggtgggtgaatggatggaggaaggatggatggatgggtgggtgtgtgggtggatgaaagaaggatggatggatgggtgaagggtggacagatggaggaagaatggatgatggatgggttgtacggatgagggatggtggatagatggaagaagagtggatgatggatgggtgaaaggatgatggatgggtggatggatgatggagggatggatgaaggaaagatggatggatggttggatgggtggatgaatggaggaagaatggatgatgaatgacaggtgggtgggtggatgaaagaaggatggatggatgggtgaaggatggatgcatggaggaatgatggatggatggttggatggataaaagaaggatggatggatggatgaaggatggatggggagtgagtggatggatgggggaaggatgggtggttggatggatggaggtatggatgcatggatgatggaggaaggatggagggatggatgagtgcatgatggatggatggatggaagaatgatggatggttggatggatgaaagtggatgggtagatggatgggtgggtgggtggatggatggatatggatggatggatatggatggatcaatggatggatggatgggtagatggatgggtggatgaaggatggaaggatggatgagtgcttgatggatggatggatgaatggcaggatggatcatttcccagctgtaggacagacaatcggctcctgtcccctgctgtatgccaggcacgcagtctctcactcttttattttttaattttttattgtggtaaaatatataacatttgtgatttttaacctttaaatgtacaatttagtggtagtatttacattcaaaatactgtgcaaccatcatcactatctgcttctaaaactctttccatctttccacactggaagtctgtccccattaaacactaactccccagcccccaggacccactgtcctacattctgtctctatggatctgatgactctaaggaccccatacgagtggaatcacacagtgtttatcatattgtgactggcttatttcacttagcataacatcttcaaggttcatccatgttgtagcctgcatccaaaatctctgccttttcagtgctgagtaatattcccatgtgtgggtggaccacatgatgtttatcttttcttccattggtggacgcttgggtggcctcacctcttggcttctgtgagcgctgctgctatgaacatgggcgtgcgaatctctctctgagtcactgcattcggtgcttttgggcatatgcccctggtggaactgctgggtcctgggctgattctgtggttagttttttgaggacccactaacagcgactgcatcatgctatattcctccctgcagagtgtgccagttacgattcctcagcattctcgccagcacgtttttgttgtgtgtgtgtgtttagttacggccatcctagagggtgcgtgcatggcctctcctagcctccacatgctccactcatgtggctgcgactaaagcttccctgtgttcacggacatcatgaagatcaaacgaacatgagagtgtttggaaaatggtcacaggttagactgaatatgaggtgttgttgcttctctgaaaacaaaaggtgggcaccgtggtgctctgggggatggggcagccacatggggcagtggccacacagcagaggcccagcagcccctaaccctgcccggtgcagcctcctcctaccactgccggggctctcctgccctcaggagactccagcaagtgactgcactgcgaagagaggaccagccaccagccctcagcatccaagggaggaattaattccgaatgaagaggaaaccaagcagtgaggcaggctaagatttccagaagaatttaatctgcagtcaggttaggggcgtggccttcccccatggccaggggggcagctgctcccaactctgaaaaggaggtggaggctcagtgtgcagctcccctggggacccagccgagaggatccccaactgtgccgtggggtttggggctaggagaagggactcgaggccacaccagcctggctcagggccaccgccaacctgtgcctcagagcgaaggccgccccatggccacagtgactggggcaggctgtcttgggcctctggagagctggagtctgtgctgtcatcaccagggctgagcttttgttggaaaagggaagggagagaaaaatgaggagggcacatcacgccagaggtcatggtgtatgtggctggaaatttgagttggactggacacctcagggcatctccctctccttcccactgtggcctgggatggactctgtgcctgtgagtgggcagccatgggctctgatggagggttaaccctgtgaccgaccatgagtgggcggccgtgggctctgatggttagctctgtgaccatgagtgggcggccgtgggctctgatggagggttagccctgtgaccgactgtgagtgggcggctgtgggctctgatggagggttagccctgtgaccgaccgtgagtgggcggctgtgggctctgatggagggttagcctccggcaccagcacctgggcctaacatgcttttcaggggcggggctggattgtggctgcagggccttggacacgcagggacacacttcccaaggggggccctgatacccctccctgcatgcggtgcctggggccaccatgctcccacctctctcctttggctctgaaaagttttttcttttttctcttttttttttattattatactttaagttttagggtacatgtgcacattgtgcaggttagttacatatgtatacatgtgccatgctggtgcgctgcacccactaactcgtcatctagcattaggtatatctcccattgctatccctcccccctccccccaccccacaacagtccccagagtgtgatattccccttcctgtgtccatgtgatctcattgttcaattcccacctatgagtgagaatatgcggtgttcggttttttgtttttgcgatagtttactgagaatgatgatttccaatttcatccatgtccctacaaaggacatgaactcatcattttttatggctgcatagtattccatggtgtatatgtgccacattttcttaatccagtctattattgttggacatttgggttggttccaaatctttgctatcgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttgcagtcccaccaacagtgtaaaagtgttcctatttctccacaccctctccagcacctgttgtttcctgactttttaatgattgccattctaactggtgtgagatggtatctcattgtggttttgatttgcatttctctgatggccagtgatgatgagccttttttcatgtgttttttggctgcataaatgtcttcttttgagaagtgtctgttcatgttcttcgcccactttttgatggggtttttttcttgtaaatttgtttgagttcattgtagattctggatattagccctttgtcagatgagtaggttgcaaaaattttctcccattctgtaggttgcctgttcactctgatggcggtttcttttgctgtgcagaagctctttagtttaattagatcccattggtcaattttgtcttctgttgccattgcttttggcgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccattcattaaatagggaatcctttccccattgcttgtttttctcaggtttgtcaaagatcagatagttgtagatatgaggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgtgggctcttttttgattccatatgaactttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttggccagggcaattaggcaggagaaggaaataaagggtattcaattaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatatacaaaaatcacaagcattctgaaaagttttttcttattttggatgccttgttaaaaggcaagtaccccagcaggtgtcagtggagactgtgaccgctgaatagcaatggtgatggggtgaggctggatctggccagaagagggctgaggggcatggagaagactcggggagcacagggaagatgtgggaggtggggaggatgggagggaggacagggagaggacaggaaggactggctctgctcattctccttcgcacttctgtggagcagctgctctgggcccagataatgatctctcgagggcaggacttgtggttttatttgcgtcatgagcctttaggaagtttggggtcgtgcatgtagagctgaacgtggggacaccgagaacgtgcaccctgcatcccgactgctgagttcacttctctgcaaagcacaaatcgctgtcccatcctgggtcacactcctgggagccaaacctgggtgggattctgtctctaccccacatcagctgtaagatttggggcagggcgcagaaccccctgagcacgtgggaaactgatcaccacgtgggggatgtttgttagagagattcagtgggtgatgtgggggcagaaggaggcccctagagcagagtatggcatctgttctgaatgccgatatggcgttggggggacagcaccctggcggcctgcagcaccctctgtgaacagggaaggctggaaggaaggggtgggtccccctgacaggtaggggctgctggatggtcccactttgcccgcccggtctcttcctacactatggttctcactgatgttccctgggcagacaactcaggatgagcctctgtgagtgctggacttgtgttccatccagctcctccccaagagaggggcaggggctggtgccccaaagcaccagcaccccacatggactggcacattttgaaagatataacacaaagaacttccattataatcgctgcccaggcgaccattctcaacgcgtacattatttgttaaagtaatttttaaagcctcaaagtcatgagtccagaacttgcagatctgaacaccaacatcattgaccaataacagcaaccgctgaagataaaaagccaggccgccccggacagtgagccccacatgtctgagtcacacgtgtccgtcttccatttgaaggaggcctttgaaaagacagcagttcattctttaaagtctggctttaaattcaactttaatgaagcggccctgatgggcttacaaggagctgacactggacacgccaggctcctgggccaagcggctgacactagcagacctctgtccacctcgggttctcccacctgccggagttcccgcaggagccagtccatccaggaagcagggcctcccagctcctcaggaacatcgctccccgatgctgcctaaacaggtgcatctcagcccagcaggctcccttggcgcatggtggacacggtgctgcattgacaggatttgggcagaggagacgtaacttagctcggacctaagtaacaatgccgaccgcctgcgcccacggcgcccaggcaccgatgctcccaggagagggaaggggggagcggcagatccagggactcgaaccccaggcaggtctgaagggcttcacaggacatgatttttcagacccaagagaaacgaggaataatagagtcacttgcctttttcttgaaacgtcggaattatttgatgtgacttgtgtaacttggaaagtatgacataaacctaggtatgaaagttaaggagcgatgtcactcctccagttgagcaatggcctgacgtggctggaggggcgtaccgtggcagggaaaccaggagcacgctgtttgttagccacagagcagccacgcaggcagggctccatccgggaggcagagccactaggagtcccgtgaaatcagggattttctgagcagggccttctgctgtgcagcaagggttggggggtagcgtggggagctggggaagggaccactgcctccacgtctctgagccagtagggtggatgggcgggggtcaggagggacctggacacaaagcaaggacaccgcgggatgcaggagacatgccagtcccgtcctccagggacccctgcgtccgcccacccgggccaagagaggatgccccgcgcacgcagccttcccagcacagcagctgccacctgcctcggctccctttagcctcccaaaccttgtgcaaagtccaccttggccagctggacccagagctgcacgggggccacggtctggggcccgcgtcccagcccggctgagctgaccagctgtgtggcctcgtgccacctacctcgcctctgagccggtcttgccctttggggacatggaggttaccctgactgctgtgcaacttcactgaaggagccgcctgagcggagcatgacccaggagcgtgcaggccacggggaatggcgcctggacaggcctggactgtgggcaacaccacgctcgtcatcatccatatttggatgtggtcggcattagtacctgtccagtcaattacgacaccggcccttttcttccccgcaaccggcccactgcagccacgccgggagctacggggagcacatcccatcccgcgaccgcatctcccgctccgtcaatcccgcgcgtcccctgcgccgtcagtcccgagaccgcgtcccccgcaccggcaaggctgtccctcccgcaaacccctggcttcaccacgtttgccctggggctgccccgtggatgatccaccacgtggtgctgccttttcagtgcaccagagagctgcttcagggccctgcgggagatccagcactgccttcttgtgcgcggtgtctcgggcgtcaggggcggagcctggttcattcgcggggccccaggttaagttcagcagctggggctcttttcaaaggtctctgaaatcacctgtttgtagagcaagtgggctttgagcaattatttcccttgttcttcaaaagctgttttgcaaggctaggtttttaaattgcaataataatttatttagggggtgggggaggtttaaaaaaaaaaacttgtatcttgtgagccacagagcataccagtcgaacaacaggtgaaagacgcacggcttcgagatagaaaagatcctcatagcccgctaactgccaagtgcttgcatcttaacacctcccgccttccccgactggaagaccttcctctgcccgtatccaaagttccctggggtcctgcccagttgccccggccctgcccgcgcctgccggggtcctccttgtccccaccggccgccgagagctccagcactcctgcctcagtcggagggtgagctgggcctgcggcgtggagcatgtctctctgctctcccgctctgccttccaggcctggcttctgtgtcgctgccataggaggcggctcagtgctcctcctccgtgggccacttctgctgtgggttcctcgacggtctctgcctgcacggtgcagactcagccttcacccatggccaattctgctgtgggttcctcgacggtctctgcctgcacggtgcagcctcagctgcaaggctaggtttttctatgtcgtaacaataatgatctctttagggggtgggggaggttttaaaaaaaaacttttatcttgtgagccgcatagcataccatagtccatccactgcccgtttgcttttctggcaggggtccaccccacacggcggctcctggccccacatccctgacttcggcccgtccctcacgcgtggccctgcatgttccaggctccgtccatgtttcgcagaaagactttttcttcttcatgtgcttaagtgaccagcgctcccatccgcacaaccctggctgaggaataatgacatggaaagcgacgtcctctttcccctgagcagtttctcgtctatcaggaacagggtttttttttttttttcctcccttctcctgacatagtcacccataaatggtttggccttaattcctatgaaggtaaggacactgctgatgttccttgagtccccacgctagcagcttctcatgcctttccctgctaagctccgtgctgtattgcttccattgcgcagtgagagcagcgcaggcgcagatactgctactccacaaaacaggaggctgagctttagaaggttaaaggctgggcgcagtggctcacacctgtaatcccagcactttgggaggctgaggtgggcagctgagaccaacctggccaacatggtgcaacccgtctctattaaaaatacaaaaattagctgggcgtggtgacggacacctgtaatcccaggtacttcgggaggctgaggcaggagaatcacttcaacctgagaggcagaggctgcagtgagccgagatcgcgccactgcactccagcctgggcgacagatcctgtctcaaaaaaaaaaaaaattaattaaaagattaaaaaatttgccctggtttacccagataataaattacagagccgagatcctaacctagaacttcattattcactcattcatggaaactcttttggaagtgccactcttccagataattccacttaaaaacacatacacgtaattctttgattgtaaagaagtctggtctttctggcatttcctactgtttttcacaagtatatttttggttaaaactatttttgtgcagtggtacaaatcctacccataaaatgtcagggtagtcagatgccaagtaaaccactgcagcatttacctacacaatgccagccccgcccagccctggctgggaacctgggtgctggacgctgccgtgggaagggcctgtgaccaatgggaaatgctcgcattcttctttttttcaaatttattttagaatcgggggtacgtgtgcaggtttgcttcctgggtgtattgcatgatgctgaggtttggagtaagaatggatccgtctccaggcagtgagcatagtagccaaggggtggttttttttcactccttccctctccccttcctaccccctccctctgggggtccccagtgtctgtcattcccatctttgtgtccatgggtacccagtgcttacctcccactcataagtgagaacatgtggcatttggttttctgtttctgcattagcttgcttaggatcatggcctccagctgcacccatgttgctgcaaaagacatgatttcattctttttatggttgcatagtattccacggtgtatatggaccacattttcttataatcaaatgaggatgactcaacttctcaaacccccccgtgaagacacagctgtaaacatgaacctgccctagaagttcgatgaacttctcaagaaaggctgaaatactcccattcgtacccaggactaaattgtaatttttaaaataacaaacatcatcagaagctactgtttggaattacagattttctcaacatttggcacagtactgggtttctgggtagtttttgtctttgacagcttgaatagtctaaacatctcaatatttacatatttacatctttcataaagatttttaagagtaaaattataatattgtctgggtgtggtggctcacgcctgtaatcccagcgctttgggaggccaaggcaggcagattgctgagcccaggagtttgagaccagcctgggcaacatggagaaaccctgtctctacaaaaattataaaaattagccgggcgtggcagcgcacacccatagtcccagctcctcaggaggctgaggtgggaggatggcttgagcccagggaaggtgaggcttcagtgatcccagactgcaccactgcactccagcctgggcgacagagtgagactctgtctcaaacaacaacaacaaaagcattataatctaagttcttcctccccttgaagcacaccccgctgcagagtgttcatgaagcaccttcctttctctgcagctccagtgtttacgccaccttttacctgaaatgaccaacttgacgtggcatcccaataactacaaagaaaactaactacaaagaaaacacgcatgccaagtagggctgggggcaccccgtgaacttcagtaaaacacaaagatcccttgagaagggcccccccagactgggcacctttccagccggagcctcggcctcctccaaaggtggtgatgaagccaccctggcagagttgcagagggagtcccgtgagtgcagtgggtgcagagaatggaaggccactgtcactgtcacctctgacacagccaaggggggacaggggctggtctaggttgatgtctgcccacggtcccacaccgcctcctcccggttttctttctagaactcagtgcttggaccaccctgtttggtggaagccgagtgtcggggcatgtccgcctgcccccagctcagagcactgccactgctttgctagacaggcccatgctggagaagcaccaggtaacgtggctcagtgtcctgacggctcgtgagtccacaggagcagcagcacaggccacattccccacacggactcagcctccaggcctgagtttgcttctcccaggactcaggccccacaggcttcctcgggaagggcccgcaccaggccctgctcttcctgagcccacagtggacgattgttttcacaccccaactcctcggagttgcagctccttcctgggttgccacagatcccagccacaacgcctggtcctcccagcctctcaccagcacccacttcagataggggagcggggaaccagagaccaaggcctcccaaggatggggtcagctggtgccaggatgaggagggagcaagatgctgggcctggtggcaggtgtgggcgtgatgcctggacagcagccatggccgcggatgggggtgctgtgctaggtggctttggttcttgcctggcaaggaaccggtgggggatggggaggtgggcagggcacggttgcagatgccaggagagcagggacctgcagccatgcacgcatgccacgatctgggaagcgttagggcaggtgtggggcctggcacatggtagagaacggaggggaggcgttaaggcaggtgtggggcctggcacatggtagagaacggaggggaggcgttaaggcaggtgtggggcctggcacgtggtagagaacggagcttcgactagaaacatggacattttcagaggtgggggtgttggaggaagggtcactgccatgctgtgagctgcggcccagacggaggccactagggctggagtgaggcccagacgggaggagaagcagtggtggctggtgcctgtgctggtcactttgtaatgggctttgtgtctggggctgtgttctgatagcacaggaggctggcaggaagggaaaagcttgcaccaaactgcacttcctattgtaagttctcaactttcccgatgaagggtctgtgggaaccacaccccacagcacagttcctctgtggggtccagtgggcatcggccagggaacagcaccgtctcctcccacagcacagcagacatgcctggcacatggcactgcccgggggacagaagcccactgcgcggggtgtgggttccgacgtcagcagagggaggcgtttaggatttgagcagagacataagtgtcagtagcttcactgtccttgccccctgcacgcaggcctggagagggtgcctgtgccgacaccccgcctttcctcccagttagttcctgccccttggagaacagccacaccacagaaatccatctcctgaccgtctgttatcagcactgccggccatggcaaaaccatctggtcactgactgtctgggcttccagcaggagtgggtgctgccagatgtttgtcataagccctgaacccttctgaaaggcggcgtggctgctgcgagggtctgtcccacggctgttccttgtcttggcggccctcgccatccctgagatggagctggccatctctaatcacagatttccagagtcagtggtttgctgcctttgatgggtgtcctctgttctaaaagatgaaaatatggatgctggactccaggtaggagaggaagctgcaatcagggcaggaagacggaaacagagagggtggcctctgtacctggaggtgggctgtaggttaggtgggagcttgtggctggggagaggatcagatttgataagacgaggatgggctttcgggtgaagaagccagctggaaacagggaagcagaagagagagtgcgcgttgaccctgaggccagcacaaaagggcgacagccacaccgcgcaccagtcgcccagctcgaccccaggggagctctggcctgggctgcccaggaagggagactggacgagggcacgtgctcgcccagagcacagctgcagacccatcctgaagcctgccccctctggggctctcagaggatgggaagctgtggctgtgccttccctgggatgcaaagtcaggtcatgttcggacaagtcaccatgttgttgaggcagcacttacgacgttccccgctacatccgtgatggccgacctgtcttagccgccctggccactcggtgcccccaccctggagaaaacccagccgagccaggccagagctgcagacacagcaggcaggtgggctctgaagagcccctcgtgagtgcgtgtggaggagcctggggtttggggtgcaggagctcgtggatcctgcttgggagcttgcagcctgaagaccagagcttttctgagcatatctaccctcaggggtcaagaaatcggaatgggagtctcgcaaggccgggctgtccagggcaactgcaagtcccacttggctgcaaagtcccatgtctatggaagcatctgcccatagcgaaaagcggagatgtgttcacggtggtctctgtccttccccctttccatccctccctccctccctcctctctctttagaaggcctgtgttagatgtgtttcctcatcccgtaggaatggtcccctcggtcttggtgaacatgaaacaaagggtgcgggcagttgggattctgtgcgcgcggctccatcagccttgattaagttctccaagtgatgtcgggctttccaccgcgtgtcagcggtgcagagtaacctcaattaaacagtcatttgagggagagagaagggaaaacgccttccaaacaatgatctcgtgtgtcttagcaacagccaagcttcaccttctcaaagaccctcccacgccgaggacagagacacctcccgagcgagcgcactccgtgggcgctggagagcaggcactcagccactcctgcgagctgccggctttccctgcacacgctcagcctcttgatgcctgggtgctaaattacatctgacatttaatttaaatgcatggtgccttcattcaaaaataaacccgctgccacagccagggcgttcgccgcatggatttttttctttccacctgctctccctcgctgaccccatcctcactttgtccagtgcgcgcaaactggaattgagcctgtctctctcctcgggatattgccttgtgccccccatccacgagcttcccttcacatgtcagcatgtctccagttgcaatttataaccgagaaagaaatcaatcccttggtcctgcggctgcaggtccccccagcctactactgggcgtcgggagcctcctcggccccacagctcacagcagctccccgccaggatctgggaggttttcccagagttgggcaggacgctcactggtgaggaggctctttagagcccacggtcgagtagccctttctagagaagctaaagatgcggccagaaggttccacggcctaccagcgagccctggctcgtccaggaagatcggccgatggtgccgagctggcccaccccagaatgcagctgcaccctgctccaatgccacggtgtctctgggaggcaaaccctgaggaagccatctcaggcgggctttacacccttccttccagctgtttccgaacccactgaggagctgaacgctgcggtacatttaagaatttctctctcaacagctcactgggtactcgacactggagccggagggagaggacaactgaaagcctcaggagtttgacattttgaacttttgccaaaacctatttccaaaataaactggagacactccaagaaatgccagatacaactgccatcctcgggccagccttcctagcttgcaagaactgttcactcagatattggcagggggtccctggggctgggtctccagcagctccatgttacctgccacttcctgcctctcataggtgcggaggaagcagctcacctgggtggcatcttgctgcttccccaaggagctggcagcaggctgggacattcctgtgcagtagtagcagctcatcctctacgcctcactccctacatccggccagcctcattgccgtgggggaagccaagacccagagatttgattgttttgatcgtttggccaaaaccacacaacaagaaacaagagaaagaacattggtagggctgcttccaaaactcatccttttttctctaaatcgagcattctctaaaagatgatataataaaaattatgaacaacaagcaaccaaccagtaaaatacacattacgaagaaggatcaggaccacgtgctatgttgcaggcctgagtatgcatgccaagcagaagggccacaagcaaaagagccctcagaatcccctggggagcccacagcacagagaagcaggcctcagagtcacccgaacagtctacagctcagggacacaggcctcagaatcacgtgaacagcccacagctcggggacacaggcctcagaatcacccggacaccccacagctcagagatgcaggcctcagaatcacccagacaccccacagcgcagggacacaggcctcagaatcacctcaacagcccacagctcagggacgcaggcctcaaaatcacccaggcaccccacagctgagggacgcaggcctcagaatcacccacacaccccgcagctcagggacgcaggcctcagaatcacccgggcagctcacagctcagggacacaggcctcagaatcaccctgacaccccgcagctcagggacgcaggcctcagaatcacccggacaccccacagctcagagacacaggccgcagaatcactcagacaccccacagctcacagccgcaggcttcagaatcacccagacaccccgcagctcagggacacaggcctcagaatcacctcaacagcccgcagctcagggacgcaggcctcagaatcacccagacaacccacagctcagggacacaggccacagaatcacctcaacagcctgtagctcagggacgcaggcctcagaatcacccggacaccccacagctcagggacacaggccacagaatcacctcaacagcctgtagctcagggacgcaggcctcagaatcacccagacaccccgcacctcagggacgcaggcctcagaatcacccgggcagttcacagctcagggacgcacgcctcagaatcacctcaacagcccacagctcagggacgcaggcctcagaatcacccggacagcccagagctcagggacacaggcctcagaatcacctcaacagcccacagctcagggacgcaggcctcagaatcacctcaacagcccacagctcagggacgcaggcctcagaatcacccggacagcccacagctcagggacgcaggcctcagaatcacctcaacagcccacagctcagggacgcaggcctcagaatcacccggacagcccagagctcagggacacaggcctcagaatcacctcaacagcccacagctcagggacgcaggcctcagaatcacctcaacagcccacagctcagggacgcaggcctcagaatcacccggacagcccacagctcagggacacaggcctcagaatcacctcaacagcccacagctcagggacgcaggcctcagaatcacctcaacagcccacagctcagggacgcaggcctcagaatcacccggacagcccacagctcagggacgcaggcctcagaatcacctcaacagcccacagctcatagacgcaggcctcacaatcacctgaacagcccacagctcagggacgcaggcatcagaatcacgtcaacagcccacagctcagggacgcagacctcagaatcacccagacaccccagagctcagggacgcaggcctcagaatcacccggacaccccacagctcagagacgcagacctaagaatcacccagacactccgcagctcagggacgcaggcctcagaatcacccagacaccccacagctcagggacacaggcctcagaattaccgagaaaccccgcagctcagggacgcaggcctcaaaatcacccaggcagctcacagctcagggacgcaggcctcagaattgcccggacacccctctgctcagagatgcaggcctcagaatcccccagacaccccacagctcagggacgcaggcctcagaatcacccgggcagctcctacctcagggacgcaggcctcagaattacctcaacagctcacagctcagggacgcaggcctcagaatctcccagacaccctacagctcagagacgcaggggtcagaatcacccagacaccagacagctcagggacgcaggcctcagaatcacctcaacagcccacagctgagagacgcaggcctcagaatcacccggacagcccagagctcagggacgcaggcctcagaatcacccggacaccccacagctcagagacgcaggcctcagaatcacctcaacagcctgcagctcagggacacaggcctcacaatcgcccggacaccccacacctcagggacgcaggcctcagaatcacccggacaccccacagctcagggacgcaggcctcagaatcacccggacagcccaaagctcagggacgcaggcctcagaatcacctcaacagcccacagctcagggacgcaggcctcagaatcacccggacagcccacagctcagagatgcaggcctcagaatcacctcaacagcccacagctgagagacgcaggcctcagaatcacctcaacagcccacagctcagggacgcaggcctcagaatcacccgcacaccccacagctcagagacgcaggcctcagaatcacccggacaccccacagctcagagacgcaggcctcagaatcacctcaacagcccacagctcagggacgcaggcctcagaatcacccgcacaccccacagctcagggacgcaggcctcagaatcacgcggacaccccacagctcagggacgcaggcctcagaatcacccggacagcccaaagctcagggacgcaggcctcagaatcacctcaacagcccacagctcagggacgcaggcctcagaatcacccggacaccccacagctcagggacgcaggcctcagaatcacccggacaccccacagctcagagacgcaggcctcagaatcacccggacaccccacagctcagagacgcaggcctcagaatcacctcaacagcccacagctcagggacgcaggcctcagaatcacccgcacaccccacagctcagggacgcaggcctcagaatcacctcaacagcccacagctcagggacacaggcctcagaatcgcctcaacagcccacagctcagagatgcaggcctcagaatcacccggacaccccacagctcagggacgcaggcctcagaatcacctcaacagcccacagctcagggacacaggcctcagaatcgcctcaacagcccacagctgagagacgcaggcctcagaatcacccggacagcccagagctcagggacgcaggcctcagaatcacctcaacagcccacagctcagggacacaggcctcagaatcacctcaactgcccgcagctcagggatgcaggcctcaacacatgcggattcccacactgcctcaccatccccctcaactgctcagcagaccaggcagctgaacggaagagatctgcctttaatgggcatcttctgctctagaaactgctgaggactgtgggtgcagggcagtcccgtgatctccatactcagggccccgtgaagactgtggggtgtatagaggcccgtgatctctatgctgttggcaccgtgaggactgtggggtgtatggaggcccgtgatctccacgcccttggccccgtgaggactgtggggtgtagggagtcccgtgatcacactcagggccccgtgtggactgtggggtgcagggagtcccgtgatctccttgctcagggccccgtgagtactgtagggtgtagggagtcccgtgatctccacactcagggctccgtgtggactgtggggtgcggggagtcccgtgatctccttgctcagggccccgtgaggactgtgggttgtagggaatcccatgatctccttgctcagggccccgtgaggactgtagggtctaggggaggcccatgatctccatgctcttggccccatgtggactgtggagtgtagggaggcccatgatctccatgctcagggtcccatgaggactgtggggtctaggggaggcccgtgatcttcatgctcagggtcccatgaggactgtggggtgtagggaggcccatgatctccatgctcttggccctgtgaggactgtggggtgtagggaggactgtggggtgtagggagtcctgtgatctccacactcagggccctgtgaggactgtggggtgcagggagtcctgtgatctccacactcagggccctgtgaggactgtggggtgcaggggaggcctgtgatctccacactcaaggccctgtatggactatggtgtgtagggagtcctgtgatctccatgtttgtggcgtgcgtgctgagtgcatcctgcagccagagaaggagctttgtgatggtcaaatcagggcgtgcgtcaaacatgttaggtttcatttaccgactgcctggaaatgggtaggaaccagatcgttgggtggtctttgctgctgtatcagcttcctcttgggtgagcgttttgctttatccacacggttctggagcctacaaaagatgctgacatttgagagcaaagcagcggcctccagcctgccctgcagatgctggcaccctcactcagcctctgcccagtgtcccagacgttttggggagataaatatcaggactgaggtgcaaatggaggggagaagagaggtgagcattgtcggaggagcccagcattgtgcagcctgccctctcccccagcctgcctccctgagcctgccctgtccctgagcctgcctcccacagcctgtcctctcccccaacctgcctcccgcagcctgtcctctcccccatgcctgcctcccgcagaccacccccggctctcagccttgcgttcgtctggagcaatgtttacagtgagagggtggacgagtccgtgcagaagcttctcatccagcagatcactggctggatctgtgatgacctgggctgagacatacacagaaggacctgggcagggccccaggagctctagggtctgcccaggggccaccgttgctgactgtacgagctccacctctttcatcctcatttcttcccctgagaaatgctggggtggccactcctggagctgtctcggtctataaatcttagctccgtgcaaggggagcatcgtgacccaacccagatgcggtggcatagggactcagaggcgcctctcagacacccgtagtcctcgtaaggaaggtgccgcctggaaggggacccacatttcatggaggcagaagtgaggggtggtggggagtgaggtgacacgcctcagggcccctcagagatgccgggggactggggtgcggctgaagtgaacacccaggggctgagggaagccccgagtcgtttggtaagaggcctttgaacccattctgttgctttttcatcagcctggatgtgcctgagtgatgaggacagtggggatctgtggcttcccctccacctcactcagtgtccaccaggcagacagacctgtccttgggggcccttccacatcctccgtcttctgcacacgttctgatggtactgaagtgcctcacacatttaaacatgaaaacagcagactcttactactttctaaaattcaaaagcagacccaatctcatatcttaaattgaggttctagatggctactatattatacctctatttgtgttttaaaccaagaattattttaaattttttaatattaaaatggaattctgagcatgctcaccagagccatttattcttcccagagcagattccatcgttgtgtaatggacggcacatcacggcccgatgctgggatgggaggcttgggtctgttgaacgggcgccaggtcgggtccccagttcctatcaccttaggtgacgttccagcctcttccacttgtttgagtttcaggctccttgaatctccttcgatgtctgggagagctgctgtgttcaccccgttgaggccagctgacccccagcccaccccagcatcacggcttctgtgccctccatgcctggaccacctcgcgcccgcttgtttacgctctgattcctccatggtcttgctgtacccagtaacctagcacgtagtagcacctcaggaaacatgtgttgaattaggacttcccataaaaacagaaagcatgaaggggatccagatggtgtcaagcattagctcttctaagctgcgtcagagtcgtgccccggagcacgtctcctgcagcagcatcgccccgtcacggcaccgcctcacagctcccaccacgacacatgcaacgtgcaaagaggacacagggagctgcgacttccgtggctggtggcaaagaaatggggcagcactttcacagccatgccaggaacctaattcagccaacctggaaataactatcccagccacggccttgccagaagcccagctcagccaacctggagattgttatcccagccacagccttgccgagagcccaactcagccaacccagagatagctatcccagccacggacttgccagaagcccagctcagccaacctggagatcgttaccccagccatggccttgccaggaacctaactcagccaacccggagatagctatcccagccatggcttgccaggagcccaactcagccaacctggagatagctatcccagccatggcttgccaggagcccaactcagccaacctggaaattgttatcccagccacaagtgtgggtcccacttaaatggaggaaggatgagtcacaaaagcagggtaatgtggcctatcccgtgcctgtatcgctggcaggtgggaagcctaattcttaggccctaagcatagcccgccgcaccgattgcaggctggtcccaccgtgagcagacagcactcctggctccactccacagcttagccaggaggattcaggcaggtccaagcccattaccagacctcgctgtggaaggcggctgacattcgaacccactggatgggcatctaagtctctgacctttgctgatggtcggttcccagagctgcctcccctgccctcaccccaagagacctcctgacctgtgagtatctctagaactctccagaagtcagatgcagggagctgcccaggctcagtgagtggtccgttcattacaaggttctctccaccacagataacacaagcacagcctggctcagtgagtggtccattcattacaaggttctcttcaccacagataacacaagcacagccttagcacagagcattgggttggatcatgcatcacgttcatgcaataccgaagcattttcaagacagattaaactgagtagtgggatggtcctcttccttggctacttatgagtatttaatatcaatactttggaattacaagcaaaaggtattaggaagaagaaactaagctccaagttggtatcatctcactgagactgtgtctttctgcccaatgtgtcaagctcatgaataaaagatcaagaggacagttaaggggttatgtgaggagttcaaagctcaaacaaagaacagcaacagacagcagacacacatcttgagatggagttggtgctgctcaggcgaacagtcccccaccctagattctgggtgtgcttggagcttctcaccctcgtggggtacacgcatctgcagatggcttcacctccaaaatgctgccctgccatccacattcatcgtttactccagcaatcagcaaacctagatacccacttctggaaaaaaaaaaaaaaacagaagtcagctcatcaagtagtctctctgtacctctaaaactgttcaatgaataaataccctcacaatctcaaaggaatattttctgtcctacttgtatccaagtaactgaatttacttccttcttccttttcaaaaatctctggagactgccccgtctaaatacagttaagtagctggttaccccagtcacctgtttaaaaacatctggagactgcccatctaaatacaggtaaataacgcgttaccccagtcacctgttctccatctacatatgcaaaagccctcgataactttggcccttttgatgctcaaatcagtgaccacattcacatgagttacaggtgattggaaaaagcctagttgtaagcattgagcacactcagtcaccgtagagagatacatctagaagggaatcgtgctggattatttaggtgtttgtcaacacagggccagaccatccacacagaaagagcgctggtcagattgttggtccctgccacacccgactgcacacattcatttattggttcgtcgttgacacaacttctgcaatctgatggagaatgcaaagatgaaccagacatagagctggccctcaaggaccccaagtctaagaggaaagatgagcagagaagtaactgagctaggagttaaaaatgccggggacatgaagagcaaagctgagagaggacagaagcccaggagatgccaggtgcagtgtccacaacatccttcttcccaagggccacagagactatggtttggccaaacagttgtccccttcttccctcatagcttagaggactccacgtacaaccagtaaaactgacctcccagagggaggagagccactgaatcgtgcatgggtcatgtggacgggtcttgcttcttcctgcaaatgtccagagagaggtgaggaagagagcgtctccggggagggttccaggagggactgattcttgaagtggttttgatggaggagaagcatcctagacaagatgaacagcgttagcaaacacacggggaagggatgatggggctctaggtgccgaagagccttcagtgggggactaagagcaggccgggcacccatgggagggaggtccacaggcaatgccttccttcaccaattctcagtcttgggcttgttggccggaaacagccagcagtagtaagacacacctttcattttacttactaaagatatgttgcaatcagtagtcattatcaattgataattgattggcaagtcattttaaaaagtgaggaaatcaagtcccaggaaaggtgctggagccaggctcttttccatagggctggtggacagggcctttgccgtcatggagcctgtggaaggaggcgtggggtggctccgactgtgagttagaagcacctttggcctccaaatcacatgagcatcatctccccccttcccttgttgctcgtttcagtagcatctgaaatggagagtttatttgattattttttcctctctgacaaagtaaatagggttttaacctgtggtacagagggaacaaagtggcccatgggttttccaataatattttggcccttgctcaggctaatgggaactttcaaaaaggcggggagagagagcggctctaattataatctgaagaacgaatctgcttacaaatccatcagaacttgattcctgggatcccgtgggccaggggcactgaggtgattccgaggcttgctggaaagaagccagtgcccatcgggatgggattctccaccctctcattagctcgtggattgtttaaaagaaaaagcattgattaggagcctctgagaagctcccgccactccttggagccctctctggggaaagacgacaatatttcagttgctctgtgtgtttcccctgccctgggcactacccacccccaacccaggtgatggccatggcagcatgaagtcaccccgtggacagagggagacagggttccggagctggtcaggctcccgcgttgccgtggacggagggagacggggttccggagctggtgaggctccccctgccttgccgtggatggagggagacgatgttccggagctggtcaggctcccgcgttgccgtggacggagggagacgatgttccggagctgaagccgaagcaatttgaccttgctggttctctggtggcttttctgagtctgggtcattgataggttagtgttctgtgccctacaggaacctgatccaccaaggaaagtgttaaatttaacaatgtatacataataacaaatctgcatctgggcaatggcattaaggtagctcaccatatacaaagcaaagtgggtgtatgtgtacaacacggttaaataaagtgataaaaggcatatggaggaaggggtcctgctggccgaatcagcaataaaaaagcacaatataatgtacagttaaacccatgtagatataaaaaaattaatgaaaagatccagctgtgctaaaagtggaaactccatacagtcccagtgattccgctctccctgaaccctggctggctctggcttctggaagaggaagaggtcagaggaaagctgctctgtcttgctggggagccatgcgtgagcacgcagagggggtggaatgagcggcccaggagctcaggcctccttgcggtcaccttgggaggtgtcctgttctctgccgtcagaaccaaagcacatccatcttggagtgtcccaaaaacacagtatggtgaccccagggctgatctgtgtgcaagatgactgaaattagcatctgccataatttggtatttgattccataacaaccttgtctggtcacacctggggagaaagagctctccaagagtcccagatggcagttggcattgagttgacctcggggcagctgaaggcacaggtgtcactctgcctgtatggtgaccgtcagaactcaggacggctcttctcacaacactccaagatactaccctcaatttcttgctggcactttaacattttttacaggagaccatcttttcctcccctcatagacgaataagctacaacgcaggtgcccctgggccgcaaacccatctccaaaggctgcgagactctggaggcagatgccggggtgagagagtagtcaggaagaagaggcattttaccagtttccctcggctgtcccagccaacatcacatctgctgctgcttatatttgtgtccagctgctgttatgtgggtaattcaggggcaattcagaggcatgaagtttcagacgagactgagagccatggagtttgctttaatctccggaacatggaggattaaccgtgtgaccttgggtgagtcccccccggctgtggctcttcatgtctgcagtgggttttagagaaaggcctgtctccctatgtcacagagatttgggaacaagaaatgaaaactgatgcagaaaccactcaaagctccttggaataaagatactatctgaattgcaggagcctatgaagaaaacccctaatgcgaagttaaatcttaaaatcaaatccttccaggtgctctgtctcctgggctgcacccctctctcctgactcttttccatcttcctccaaaccaaagtcgctggggatgtgtgggtggctggtgggacagccctaatttgacctgtgagcatcctaaggacatgatgcccctaccccttcatggaactagaaataatacatacaaaaccctaaaacacgtgtccagaaacagcacggagctctgaaataatacatacaaaaccctaaaacaagcacgtatccagaaacaacagcacagagctctgatttctcctgtgatgagccgtgatgacgacttcaatgcctaaaatgtcaaatatcgagtgattttattcaaaatgaaaaaacatggattttgtcctaagcgtcagctcagtctgcatgtgagtgaccagccgctggctgcaccacaaacaacccgggaccagcaccggcagcctgcgtccctcccacccacctctcggataaggctcccatcagagaggagcctccagaggctgagaaacttcacaggatgccaaatgcttccatgagtccctggtcttgaccctgccctcctcccttcgctcctctgctgatgaacttcacgccagtatcaggctctcaatcccgctccccagcacctccctcccctctggggcgcctccttcccggtggtgggagagatgtcgaattcagacgccaggaatgttgaaatgtcagccttcccagagcacacagatacgtccccctgggtcacgtggagcttattgtgtacggccacattcctgttgattctcagctgcctgtgagatccttattctaatagatgtttcaaaagaagtataataccgagaggccttaatagtgtttaaaagtgaaactttcatgacaagatataatttcaaaataacagctctccacaggaacagtgaggccctttggggcaccaggagatggatgagaagagaggaggggtgagtggcagagccctctcttctgacccaggcattcccgggagcctctgtccctgctgctgcaggtctggccaaggcagcaagagcccctcggagcctcctcccccgcccagacaccaggtcctccccgcatcgggggtggtatttgcagattaacgcacagcatcctaattcctagtcaggctcttccagaccttctaagccggccttgtggccttggtggctggcgccccagccggcacccacgatgctgtaaatgctcccgaggaccagggcccttcctctgtggaggggctgccacgcccaggccccattctggggaaagcaaacccctccctgtaggggaacactctggagctcaactcaggaccgtgagtacgaatgggagcgcctgggcccagagaagccaggccaggggatgggaacttgctgctgcgtcctcgcctcaggggataaccagggaagctcagccctcctgcctgcgccccctgcccgggcacaacgcttagcttccactggaggtgaggctgcccggccagagagcaccatgctcctgcatgtagggctcactcacagcacacgtgccctccaagcccagcgcactcagactcccagatcaggttgaggtcgtgctgaggctcagcgaacagagcctccaaaccacggacacaggaacactgctgggggccgcgtccacacaggccccagtctggggcgagcttgggcttctcagccctcagacaggagagtgagctcgccaggccgtctggtgaaggaagacgcatgaagataaaatcggggagcaacgtggcgtgtgtaccgaagcttcatgaaatacatgtcaaattaactttttaaatgaatgtgtgaaataaatacagctgcaaccaggacgtagttcacttctgtttatccaagacgcctggtgtgatttcttgctggggtttcttcttactgagaagatgcattgcccccgggagactcgggaagcctctgcaaagggcacctgaagcaggagcacatttactctaccctttaaaaatgtcatccccatcccaccaggacggagaggagcttttcatttgtagagggaaactgttaccccttggctccaaaaccaatatgtgtccagccgggcactggtgggattgtacctcctctgattttttcactcaacatggagggacctgcatgtaagatgtaggtgagcgccgtccacgaaagagcaggagacacgagactccgtggccaggggcggacaccaagcctcccacactaagacaagcactggccatgctccccaagccgtctgcgtgcatctgtgtgtaagtcatcacgggtggccgtgcccaggaccacagactgggtgcattaaactgcaggacacgtctgttctcacagctctgacagtcccagaccaagctgtggggggcggcgggggtgggggcggttcttcctgtgacctctctcccgggcttgtggacagcatcttctccccatgtcctcacacggcctttccctggtgcaggcacggggtgtctctcactcttcttgtaaggacaccagtcctgtaggatcggggccgcccttttggcctcattgaaccttaattagctccttggaggtcctgtctccaaatataggcacatggggatcagagcttcaatggatggatttggggggtcacaattcagcctataacaacctctaaaactgcaaggccagagttaaaccctgaatctcgcccagatttaagcctggaacacagaggccttctggctaagagcagcctcctttgaatggtggtgggaaagggaaggttctcgggctggtgtgatcgggtgatgtatccccagccagagatgcttggggctaccagtggtgaagctagggcagcgggtgccggcctcgcccaggcaggaccaggacacatgctctgctccagggcatgagatccaaggtgggtgtttgggaacggggcccacccaccggccgtctctgacccttctttgaagcctgtctgtcacgtcaccttcagctcagaaagggcctggagaatcttggggcagcttctcttccaggtggcttgaggcatgtgccgatcgctatcaacacaccgggaattcagagcccacccagcctcacgggggcctcctttcccgagaaggtactcagccactgcctgccaggaggacggggaccaaaggcgcccacctgctccccacatttgcggagcgtctcccacaaacaacactgagagtgtcactaaagaaagcgcctgccccgaggagtttagaatccagccaaggaggcgagtcatgttctgtcatttaatgtgttttgatgccattcaaccccttcatatttttaacaatatgttaagtagacttccatttattttagccccagctgccttttgagaaagctcaattacttttgaacaacctaatcatttccaaagggcagcttcaaaccctcattttctaaagcagctcagcagccctccaccttcctgggccgctgcacacagttgagtgtggacgcagataagatgcaggtcaccagcaaagtcagatgcactcctggccgctctctgatgacttggagctcaggatggacaccatacagtcagagatggctgcacccagctgggtccacaggcatagtcagtgggactgctttaccaaagggactcatcaggttagtccaaaaacaatacattcgatggatcttcccaccaaattcacgcaagagttgcttgagtgtctgttgggtcaaaatggccaatgtggctgtgcacatgaacacggagcttcgccggccgaaccacgggagcaacacaggactgtggccacaggagccgtgttcagctgagcacacggcgctccccagcaggtctgggagacaggtccaccaggccaggtgctctcggtgccagcggcaccactaaccgtcctgctgcagttggcatcacagccagaatttgtttggggagatgggactcctgcatcgaggcagttagcggctgctatttaataatctcagatgtgtgtgcgcgtttcctccatagcaacttgcctcccacgtcgacatcaatattggaaaacgcaggcacatggccgagcgccaggtcctggtgtgggtttgcctctggctggctgccctgctggtcccgggttcatccatgacacgggtgggactgaatgtgggatccccaggacccttacagttccaggttattgtaacagttttgtgttatcatttcgaagccaaatgagaatggcttgaccccagatgtaagtacagccttgtaacgcttcagtaagatgggagcagagttaagaatagagactgtttatttggggcgtctcggctgaatcaccatttagtcactgggatgttgctaaaatatttgtacatctctggggctggaagatgttgaaattgtttctttgcctgcctttttccatccattacaaacccaaagagctgaaatttaccttaaaggtagactcattatattcaagcatgcttgctcctgaaggtgtgtataaatcttgtttgaaaagctgaattgggttttcctggaacaaacattgacagtacctaccctggaagcctatgactgtgctgggtgcatggaatggaaaagagtaactgcgctgggtgcatgggacggaagagtaactgcactgggcgcatgggacggaagactgcactgggcacatgggacggaagagtgtgctgggagcatggggtggaagagtaactgtgctgggcgcatgggacggaaaagagtaactgtgctgggtgcatggggtggaaaagagtaactgtgctgggcgcctgggacgggaaagggtaactgtgctgggcgcatgggacgggaaagggtaactgtgctgggtgcatgggacggaaaagggtaactgtgctgggcgcatgggacgggaaagggtaactgtgctgggcgcatgggacggaaaagggtaactgtgctgggcgcatgggacgggaaagggtaactgtgctgggcgcatgggacgggaaagggtaactgtgctgggcgcctgggacggaaaagggtaactgtgctgggcgcatgggacggaaaagagtaactgtgctgggcgcatgggacggaagagtaactgtgctgggcgcgtgggacggaaaagagtaactgtgctgggcgcgtgggacgggaaagggtaactgtgctgggcgcctgggacgggaaagggtaactgtgctgggcgcatgggacgggaaagggtaactgtgctgggcgcatgggacgggaaagggtaactgtgctgggcgcatgggacgggaaagggtaactgtgctgggcgcatgggacgggaaagggtaactgtgctgggcgcatgggacgggaaagggtaactgtgctgggcgcatgggacggcaaagagtaactgtgctgggcgcatgggacggcaaagagtaactgtgctgggcgcatgggacggaaaagagtaactgtgctgggcgcatggggcggaaaagagtaactgtgctgggcgcatgggacggaaaagagtaactgtgctgggcgcatggggtggaagggtaactgtgctgggcgcatgggacggaaaagagtaactgtgctgggcgcatgggacggaaaagagtaactgtgctgggcgcgtgggacgggaaagggtaactgtgctgggcgcatgggacggaagagtaactgtgctgggcgcgtgggacggaaaagagtaactgtgctgggcgcgtgggacgggaaagggtaactgtgctgggcgcatgggacgggaaagggtaactgtgctgggcgcctgggacgggaaagagtaactgtgctgggcgcctgggacgggaaagagtaactgtgctgggcgcatgggacggaagagtaactgtgctgggcgcgtgggacggaaaagggtaactgtgctgggcgcgtgggacgggaaagggtaactgtgctgggcgcctgggacgggaaagggtaactgtgctgggcgcatgggacgggaaagggtaactgtgctgggcgcatgggacgggaaagggtaactgtgctgggcgcatgggacgggaaagagtaactgtgctgggcgcatgggacggaaaagagtaactgtgctgggcgcgtgggacgggaaagggtaactgtgctgggcgcgtgggacggaagagtaactgtgctgggcgcgtgggacggaaaagagtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcatgggacgggaaagggtaactgtgctgggcgcatgggacggaaaagggtaactgtgctgggcgcatggggcggaaaagggtaactgtgctgggcgcatggggcggaaaagggtaactgtgctgggcgcgtggggtggaaaagggtaactgtgctgggcgtgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagagtaactgtgctgggcgcgtggggcggaaaagggtaactgtgctgggcgcatgggacgggaaagggtaactgtgctgggcgcatggggcggaaaagagtaactgtgctgggcgcgtgggacgggaaagggtaactgtgctgggcgcatggggtggaaaagagtaactgtgctgggccatggggcggaaaagggtaactgtgctgggccatgggacgggaaagggtaactgtgctgggcgcatgggacgggaaagggtaactgtgctgggcgcatgggacgggaaagggtaactgtgctgggcgcatgggacgggaaagagtaactgtgctgggcgcatggggcggaaaagagtaactgtgctgggcgcatggggcggaaaagggtaactgtgctgggcgcatggggcggaaaagggtaactgtgctgggcgcatggggtggaaaagagtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcatggggtggaaaagagtaactgtgctgggcgcatgggacgggaaagggtaactgtgctgggcgcatgggacgggaaagggtaactgtgctgggcgcatgggacgggaaagggtaactgtgctgggcgcgtgggaaggaagagtaacacaggccctgtccccagggagacctctggacttacttatttgttctgtccatgggttttgtactgaatgtctgccatatgccagatacggttctagtcaccgcagagttcacattatgagcaggcagttgtcacacgatgcaactaggctgtaacagggctttctgcctggtgcagaccttcaggaaggcacctcgattaccttcctcggaactcagggtgggcttggcagagcagctgatatgcgggcaaggttttgcatgctaagaagtgatttgacaactggacgaggttagcaggagcttctcagtgggggcagcgcagaggtgaagtcgtaaaggagcctgctgtcctaaggctgctgggaactgcagggggtttacttgaatgagacaggaccccctcgtccagggctgggagttcaggagaccacgtgtggcacctccattttctcttcagagcaggacgtgagctcacctgccacaaaagagggggcattgggtggggagttggggagaaggggaaagtcctagtgcagtccccatgaggaatgagagagagaacaagcggaagagctgccaggtccctggcgggagccacgccgaggtcagagccctcccctgtggcttgcatgtctccgccatgtgcccaggcggggagcagccccggggccacagaacgcctctgtagcggggaagtgttgggagggccggctctgtcccctaggcgggccgtgcactgttttaaagaccccactgtggtcatcatcacctcctaactataccgtgtacaattccacttggtcatacccttcatcgtgaagcaatctcactgcattttaagagaggttgaagcattttgacaacctcagtaatgggattttggcagatggagggggaaatggcccagcctttattttcagttgtgccatacaggagggcaaccgctgtcacccctggggcaccacctcggccaggcgtgcgacctcttgcccaggaaccccagaaagggggctcaggggcttaagctgctttcaaatgtctgccgcttgcgacaccctcctctgttttggctcctcatcctcgtttttctagaagaggaaaggacagtagccacatttcaaaaaacagttccaggaagtttactttgtctggcgtagaagacgagccttaaagccagacacagttaaagagcaactctgattccaggacatgtgtccagccacagtgacacagcttcaccccgagtgcccggggggggggcaggggtggtggcctgagtgggactcaggtgccatccccaggggtctcagaacccagaattgccaggctctgtccctacttggttaaaattttatgcgaatgtggactttaccctataagcccatatcgttattgtataaaaatcattttctctaaatcttccaatgaaagtgaccctcgagcacaatgggccatgtctatcttgtggtttctgctccctggagagaagaatgccctgttcctggcccactgaatccaatgctggactcctccgagtcacactcacagacacacgtggatcaggtttaatctaaacacctgtggcccagtcaaatggacggtccttccctcatccgcctgccgctccccgtcctccacgtggccagcaggtggcccttatgggtgtggtgcagtcactacctgggcaccatctctgccaggcgtgagacctcagccctcttcctgggtcctttccagcacatgggctctcagcgtcctcaccctagcgaccctcccaggacctccctgcaggactgggtcaggaccaggaagccctcggaccccaggatggccctttgcaggtctcaggcactgcagagctccttttgcaagctctgatgttgtttgatggtgtccggctcaccagaggctccactcggacagcaccagcacagtgcccacctgccttcggggaactttgcattttagcagcggaaacatttcctcaaagagaagtcttcccaggagtccctatgcacggagctgctgaagatggagctgtccacgggagcagagtggggggtccgggacctgaaggcatccagccctccagagcccagggttccagccaccgcacagactccagccactgtgctcaagacagctcatgggttcccacctgcctcccaaaacaaatctgggccaagtggattagagttttaaattcattcttttttaaaaatacatgaagattcaaagatgggcagatgcagaaaatgaaatactctatattgtatttaataggaattctgtccaaaaaaaaaaacagagatgggtatatcaaagcaattatcaacttctgcatcttttctgttttcctccccgactattttcaaaggcccggtatcagcccagattcccattgtctgtgtccagacaacgaccgacctctgtgtgactggatcacgtgagccaaactcccctggccccgggtcagcgccgtctccctcgaggctgtttcctggtctccttgggacatttatgaggagagctgattaaggtggtgccactcctggacccagagaaagagttcttcatgcctgggctcagtggggctcatggaagtctcttctgggggatttgaggttctggtctgggattgggaattcattcctttttgttccaatttcattaacctcatataagaagcaggtaaaagcaatttatgcaaatccttttttcaatagtctaagacattttaccttttgataatagcagccaggcaaaggaaggagccgcagacaggcaggttttgaggccccaatttaaaatctgagctacctttccccacctcttcaaaagcctttctgtggataagttaagagtgtaatcccttagtctggtacaaatgttttaagactttgtatttctaaaatccaatttgagttatccttgaactttaaagctgttttgtccactgagccaagggccccgggatgcagacaagtgtggcccagcccctcgcccccgtgaaaccccagccgccatgggcgccaggagccctgtcagaggcaggaggcaccgacgcagatgctgtgggcttgtcctttctgagaaagatcttcacgcgccttcttcccctagacggagaggcttggggtgcaacagcagcccttgctgctggccacatggggctgagggtggcctgtcaggaggctgtacaaggcatgattgcaggaagcacagtgaggagaccgcgcggcagagtcggccccatctgtgttctcctggcttcgtgggacccggacaccccaggcctccgggctgcatgtgtctgcccagctgagctgacctccttgccagaccctcgctgggtacccaccgggtaccaggtggccctcaggagcccctctgggcctccaggtgtagacgggagaggcagagcccacagacgtctgcagggtgggagctggggggcccacagatgccccatagcagaggggagggtgctcagctgggaggaggctctgagtgtggaaggatggagggtgggtttctgggcacagggcagccagagatgcagcagtgcaggccccacagactcaggggtccaagggcaggggctgctgcagcttcaggcagggccagcagcagagctggtcgcgggggtctgggctcaatcactgctcacggctcacgcctcacactttacgtgacacttctggttctctcaagcctttttctcagtaatacagaatctcatagttacgtaaacgacacaaaacagaaaatggatcgtcctaaccgtttttaggtgcacgcctcttagcattgtatgtgttcacaacgttgtgcgagcatctccaccacccatttccagaaccttccatcatcccaaactggaactctgtccccagtaaacactgacccctgttcctccccccaccccggcagcccactctaccctctgtctctgagtttgatgactccagggacctcacacaagtggaatcacacagtctgtgtcctctagtgatggcttctttcactgggcagtgtccccagggttccctgtgttgtgctgtatgtgtcctttggtgactggcttatttcactgggcacatgtcctcaggactccccatgttatgccatatgtctgcaccccctcctcttagggctggtgacatctgtcagtgtggatggaccacattttgctcctctgtccatccgtccacagatgctggccttgcatccaccctttggctgctgtcataaagttgctgtgaacctggcgtgcaaatacctcttcaagaccctgctttcagttgttctccatggacacccagacatagggctgccggctcctatgggaattccatttctaactctgaggaaccgccaccctgttctccctagctgctgcaatagcgcagtgttcccatctctctgccttctcaccagcacctgttactttctgtttttttcggtaagagtcacgcacatggcatgaggtggaattgcactgaggaatcatgcttccccaatgattttggtgacgccaagcgcctctgcctgtgcctgaggtcatttgtgtgtcttctttggagaaacatgtgttcaagtactttgtgttttctgaacgagatggttttccatcgttattgtagttgagttgtggaagtttcctacatgttctggatattaatcccccactgcaatttgattcgcaaatcttttccccctttatatgggttgtcttttcgctctctggatggtgcgctttgacgcacaaacgttttgagtgtcatcaaacccaatttatctatttttttcttttgtgcctgtgtttttggtgttatatccaggaaatcgtggccaaatccaatgtcataaaggtcttgccctgtatgttttaggtctcacatttagctctgagttcatgtatgttctggccaagtgtgcgtccagccactctgctattcgctgtgagtcagcgcacgctcgggtgggaggtgacggtctggctcactcctctgcgtgtggatatccagttttcctgggaggcgagggtctggccacactcctctgcgtgtggatatccagttctcctgggaggcgagggtatggccacactcctctgcgtgtggatatccagttctcctgggaggcgagggtctggctcattcctctgcatgtggatatccagttttcctgggaggtgagggtctggccacactcctctgcgtgtggatatccagttctcctgggaggcgagggtctggctcactcctctgcatgtggatatccagttctcctgggaggcgagggtctggctcagtcctctgcgtgtggatatccagttctcctgggaggcgagggtctggctcactcctctgcgtgtagatatccagttctcccagaaccacctgttgaggaaaccgtcctttcccccacaggttttttaaaagtcagtttatttttgtttagtatgggaaaaagcaggttatttttaaggacacgagaattttatttcagatcagtacatttttaaggttataaaatttagttaatattatctttaaaatattgataatatttcaagccagatattgactctgtcccatttaacatgtaatgcatgccttttaatttactttaaatttatcatgtaagaagaagcatgattcatggaaagcagactcaacaatacacagatggtccccgcctcaggatggttggacttagtatttctcactttacagtggtgtgaaactgtactctgagtgctcacccaactacgctgttattcactttcagggcagtagtcaagaaatggcctgatatcttcagcactttatcataaacaggctttgtgagagatggtttcgcccagctgcaggcttgcatgagtgttctgagcacacgtaaggcaggctgggctgagctgtgatgctcagcaggttatatggatccagtacgtctctaacctagcacatttcgacttgcaccgggttcattgggatgtaaccccatgatgtaaccccatcatacactgaggaacctccatagtgtgtttatctgagaactgaatacatatcaaaatgtaaagtaaatttaaccaggaaattggctccaataatagacaaacaaagctttcagtgacctgatggctaatatccttacccgtttgattatagaagttttatgttcgtaattcctgttttatttgtgaattacaagagaaaatgaacagtttcaggctgctatttgtaagcaagcttctgcaaataaatgtgtttcaggtgggggtagcctaaatgtcacgtaaaccagcgcaattcagatgggggaagcctaaattccacccacaccagcacaattcagacgagggaagcctaaattccagatacaccagcgcgattcagatgggggaagcctaaattccacccacaccagcacacttcagacgggggaagcctaaattccagatacaccagcacaattcagacgggggaagcctaaattccagatacaccagcgcgattcagacgggggaagcctaaattctacataaatcaacaggtctcaggtctctaaattccacataaattaaatcaaatttggatagattgattcccagacgttctgctctgagcgttgtgtgcagcgtggaagtctttctggcctgctgtgtatgagcgggaattggatggtggtggattcgctttggggcatggcttcattgctggcttacgtctctcacacttgctcagggtccgtgttccttccagagcttgcctttcatcagactccatctgagcaccaatttgactgcacatccctgagtaggaaaaagcctcacgtttaacatctgcagtgcatagaacttccacagtggctggcaggtcacttgggtgggatgacagcgtctccggggacaaggatggacaggtggatgggtgaagagcatgaggtgaggaaggcctgggctgtggtagagaaaggagaggagggagaaagtgcttgggaacacagccggcgagcgcagtgacatgctggtgtggggagaggggcacggggccgagagccacagtgtggagctggtttgggactggagtagaagctggttcagggagaagccgtgagctcagtgggggacaggtggccagccggggaaaggccaggggacaccaggggaggcattcagccagtgctgtgacaggagagcctgcagctcaggccaggccagaccagagctgtccccgtggacattctggtgccagagtgtgggggcagaggccaggagaggcgtcagggcaaggggacagtccgtcagggccccacattctatgttcaccacagagcagctccgctatcctcagatgctggctttctcagcttgactgtgtgagttcctctttgaaggagaatttctgaatgtgacttaattcaattttgtgcttccaacaaatcttccctcattaaaaatagctaggagaccatctgcattggtgagagtctgggtttccgggaaatggtaacgaaactctgcagttgagccagggacgcaaaatgcatcgccctgccctgctggcggtgggctgttgattcagtgacctaccaggtgccaggaacaggggtgacctcacaggtgacacagcctggccccaccaccaagcatggccccacatcgaacccgtgggagcagagccccaccctgcaccgcctcgctcacccctgccttctcccttgcctctctggatgacagactgggcccctgctgccctctactcctctctaggctgctctcccaggtgtggggaggctggcactcatgcctccttccctcctcacccctgtcccccccggctgcacctggatgctgcgataggcagtgccctgccgaggaatggagggccgcccaggcccacactcgggccacgcaggagttgcttctggcgtcaagtccacacatttcagtgcaaacgcaaagcctccaggatctgggccaagctgccactccagcttcatcttcattcactgctcgtctgcaccacccacgggagccacgcacctttcccaactgcaccgacatgggcgctgggtcccaggttctgcctcgagagcccctgcacccccgccctgcccctggccctggctccatctgacatgacatcaggaccccccctgagagaccatgtcttctgtcaggcctcccctccctggcgggatcactcccttcccaatgccaggctgcagtcagcattcgtgagcacccaaaatatgccaggcagcatatgaggcacatggcacacgtggtctcacccgtcttcccaccagccgtgaagtgggtgccacgagcctcctcgcaggtggggaggaccagggcgtggggagctgacctcacagacacgtgagggtgggggccaggggctcactgtaacctcatgacagggaccaaatgctgccagatacagacaatgtttcttggttggtggctgctccgggggtggggggcgagactgaagcgcttttgcggccgagcaccacatgtcaggctgcgcacagcacgtggtcttcgggaaaagtctgttgaatgaagtgttctcgtttgaagacacatatcccttaacccctgagcctctactctagaaggaaggaggtttagaatgctctgtaacacgatgaataaaatggaagggtctgcaaagccaccatcctccagcgggagccccaggcccctggggtgggagcaggagcacaggaggagccctaggcagaaacccggctctccagggcaggcaggtcctctcagcctctccccaaacatctgtgaggaaaccgtgctgcagccacagtgtggagacatacacccttgccatcagccaccttcctcccatgcagcaagctcgggcacacccagtgtagaggggagctgcgactcagtggacgctgacactgggcatcggtgggaacagacagcggtgctgtggctcctgctggtgggacgctgggctcggctgacagtcaggaggcaacgcagctgtgcacatccgaagctctcgacgtgtggagatgctttggcatggacactcgtcccctgacacttcatcctaaggacacaattctttgagatgtgcaaagaatgaagtgcgtggctgttcattacaacattgctcatgatgcgaacatggcacatgaagggatgtggatgggagactttccgacgagggaagccccttgcagaccaggcacccctgacatttctgaagaagcaaatctcccttgtggatgcagcacccagagcaacactaatgggcctacaccgtgcccgttgtgtgttcttagcaggaattttctgtgccggggaacagctgtttctttctattcctttatatttttctaagacttccttttgccccgaagtcttctgttttatatctgtacctaaaataggccagagcacacacaccacggctgcatcctgagcggctgtgatagtcagctctgtggacccacgtccatcccgctgtcctgacacctccccgagcccccacacctacctccccaacatggggcctctgtcagaagtaatgagaccttcctcaactcgcgaggggctttcaccttgtcacacttaagaaacactcctgcgtcccgtgttttaggagagctagagccagtcacacggtgtcccctgcccagggctccgctgtcccagaaagactggaaatgagggtctcggctttgccacaggaatgggtgggattctgcctgtttctccatctttttgtaatttctattataaagagtgaggcacgctcaccatttgccgttatccttgaaggagtttctccccagaaagcgcttgatggagacgagggcacctgctcctggtgtgggaagaggtagctcgtggaagccacatgattcacgtgactccctcggtccccgcgtgcacacccatgcatcggtgcagccggggccgcagtgtccttggctcaggcctcctacgcagggaagcagggtcggccgctggatcacccggctgtgcagctgggatttgcccttgacccgggtgtgcaacaaggctttgtcctgtgggccgcacgcgttcccaaacacagagcaggagctgcaggaggcggagaagccagagtgacaaggtgggtttgggggtctgagggccccagaggtcggacattggaatgaccgattgcggcagccgagaaaccaagagtggctgcagtgtcaccgcggcatgatggggcgagggtagctaccaactgaacctaaggaaattcagttccatgataagccaagaagggtcaacagcgtctctcgctaacactgcagatatctggactggccccggggcctggtccctggtggtgccatgcagctgagaagaaattgctcctataagcgaatatctgacaccccagccaaaagtcttattctttcccctaaattccaaaggaatttcctctctattttccagtcgattggagtcgtttccatcggtggctgtcttaccagtgggtgatgagtctgagaaataggaaccatgtcttatttatctgtatgaccccacagcagtaactattataatgcctcagacttaaggactcaataaatattggatgactagacagaaattaattaatgaacatgctagcttcctggtaacatatgtaacatctctcttggtccacttagactgtaaattaatgagacctttgaggaatgaagaaagtacgcgggcaactgcgggaaggccggagattgcagaggctgtcttcagagaggggtctggggagctctttcagccttgtcccgcgggccgagcccactcccccggcatacagagctcctcttggaggggccctgctgatggtctggccctgctctccgggggcgctcatgccttccactgccactggctgttattctttctgccttcatgccagctggagctcccggatgccaagaactggacagcaggcacgaagttctccgcgttcccaggaggccgggatgtgcaaagggcatggccggagccgggctgtcctgacagacatgtaagcacacagaagggtggcaggtgacctttctctggagcgcatgacggcagtgctgtggccttggccttccactcccaatgggggacttcccacttctcagacctagagagaaggcctcagggtcccttgggaagcacgatctccgctccccctttaatgggtcgagaatggagacgtgagtcaggcacaaccttcagaagtcctggcacgaggggcctggaagctcaggtggggcttccgtgaccacctgcggccacacagggcccagggccagcctggacgaattgtaaagggaccctctcatggggcttcctgctcaggagaggcaggaatgggagatgtgggtttggctgcaggcctgagcaggtgttggaggacaggggccatgcactggggaacacgctcctggggagaccccctcctggagcccccagggccagagacgcctgcaggagggagaggtccagaagatggctgcccaagaaacagggcaatgtgtggggatggaggcaaggggtggggcatggcaggctacagtagcgctgccacctgcaggaggcggagaggccacagcgacaaggtgggtttgggggtctgagggccccagaggtcggacactggaaggaccgattgcggcagctgagaaaccaagagtggctgcagtgtcaccgcggacgcctggacgtgctgagactcaccccggggccatggagagtggctgcagtgtcaccgcggacgcctggacgtgctgagactcaccctggggccatggagagtggctgcagtgtcaccgcggatgcctggacatgctgagactcaccacggggccaccgagagaggctgcagtgtcacctcagatgcctggacatgctgagactcaccacagggccacggagagaggctgcagtgtcacctcagacgcctggacatgctgagactcacctcagggctgcggggcagacctggagccaggccggggactgcagggttgggaggaggaaggcgctctccaaacacgccctgtgaagccaccgtagaatcagactgtgcctccagcctgacctgtgctggccccttcctgtgagctccaggaaagtccgtgcttgaagagctcattcatgagtgccttgttttatttccttcacatgaaagcagagaacatgaattgttttaaaaatagcctctccttctacaagtcattatttgcagaaatagctgatagttcaaaaactctaaattcatttgccacgttcattcaaattgttctgatcttatcatctttcccaaatcccacatttattacagatgtatttattctttgtctcccctccctcctctatataatggtttaggagagattacaaaaggtaatttataacaggttaaaagagagacctcaccactcacagaaaaacgaagcattcccctccccagagtggagacgtggctttctggggaatgtggcccagggccctggccgcctgcccacacgcgtagaaatacatgaaatggctgcgcatgtttcagtcacttagagaaataccgaaaaatggcttcatataaacctctgaaaggtacgcggggtagcaattaatctccttccgtagtaaagagcccagctgctttggccatgatgaacatcagtctttgctcttgaaggcttcagaacaggtgtaacagggatggggcgcaggtgctggcccgcaggtcgggatgtgcctgctgcgtgccccggccaccccagccagcggtcctgcagcaaggagcagccggtgcccatacctggtgaagaggctgggttggccgctgcctggcctgagaggtgaggcgtggagctgtgtccacatgaggagacgcaagggagcgatttccatgaaggagtccatagacctccgagctctttctctgtagctcagctgaacaacgttgccaactagggagggcactggcttccgcggtcaattgcaggctcggacactcactgcaggcttagcctttgactaagtcagctgaccctgcagcacccaggtgcccacctgtgaccttgtggcgatgcatgtcccatgcaggtgctgagtgtccaagctgatgtttgcaggatacccacccgtggctcccacggcaccatcaggctgttgccccagatgtgcagttgttccctcactgggtcaccgacatgcctcttgcctccatgcactgagttcaggaccgtgaataagtgaggcttgttggacccaccaaatgtgctttttttagagatgcattttctcaaagcctcgtggatcgattttggtgatgctgtgaatgaccatctttgtgtctgtgagtccccgtgcagtgagaggtaacagcagtgttcctgcagagtctaagtggccaggcagtgttcctgcagagtctacgtggccaggcagtgttcccgcagagtctacgtggccaggcagtgttcccgcagagtctacgtggccaggcagtgttcccgcagagtctacgtggccaggcagtgttcccgcagagtctacgtggccaggcagtgttcccgcagagtctacgtggccaggcagtgttcccgcagagtctacgtggccaggcagtgttcccgcagagtctacgtggccaggcagtgttcccgcagagtctacgtggccaggcagtgttcctgcagagtctacgtggccaggcagtgttcccgcagagtctgtgtgaccaggcagtgttcccgcagagtctacgtggccaggcagtgttcctgcagagtctacgtggccaggcagtgttcctgcagagtctacgtggccaggcagtgttcctgcagagtctgtgtggccaggcagtgttcctgcagagtctgtgtgaccaggcagtgttcctgcagagtctatgtggccaggcagtgttcctgcagagtctacgtggccaggcagtgttcctgcagagtctgtgtgaccaggcagtgttcccgcagagtctttgtggccatggcccacccaacaactgcgacttcttagcacgaggactcaggtgtatgagttcctcacagccccctttttcagcccaaggcgatgcccacagtgtcctggcaccacctcccacccccagcctgtggctgaacccaaagggatggcccgggagctgatgggtcacaggccatcccatgtcccacgtgggcttctcaaaggttttggttcccatccctagttttggggcagtggctgtctcacatggggttagggtggaaaacagctaagtcagatcagagcgtggaaccccagagctggtgtagctgtacctccaggccgcccgctgccctgctccttgccatctgtgtctccccggagcatgcagcctgcctggagtgctgccctgggtgtcttttcagagtgcaaccctgcaacctcagcacaggagtctgtctccatcttgacaggcattgctgaagatgtaagtgctcccccagaacatcggggtgtgtaggccctccacgatgcgctgcttggacggcggagaccgccgttttctcttggcagtctggcgctgagtggatttgcccaaagtcacagatcaacttgctgttgcagcaggggccggcctgtttctggagtggtttagatttgggatgatggagctatgatcagcttacaccagcgcagtgcctggcagctttagcagaagggtcattcactgaggtccagccagcagtcaacagcacttagaaaacaacaaccaagaagagtagccagcgccaagcagaaccgggggcctcccctcctctgcgagcacacagcagcctcctcatgcccttcatcccctatcactttgcctcattctgttttcctcttcttcctttatggtagcggggggactggcaccccagtgtccttgcatctgtgctggtaggttgctgaggggtttcccgcggccgccggcctgtctcccaacactccctgggcctcattcattcccaccacgaccctcctcttgggcgcacggcctggactcccgcctccagccctccccacctgtcggtatttctctcccaccctgcagggggtgcttttctcaaggccattttaagcacacatttcactcattcagagtgaagatgacacagaagccaccagattcaagtgctcagaaagcaggacaagcgcgtcgggctcagagctcttccccaggaagctggcctccaaaagcaggagacggagaatccattcaggaaaagcacatggggctgggcgccgttccctggggagctggcctcggaaagcgggagacccagaatacattcaggagaagtgatcgggcttggagccattccctggggaaatggcctcagaaagcgggagacctagaatctgctcaggagaagcgcctcaagctcagtgccgttccccagggagttggcttcagaaagcgggagacctagaatcctttcagaagcatgtcggactgggcgccgttccctggggagctggctttagaaaacgggaaacccaaaatcggctcaggagaagcacgtcggactgggcatcgttccccagggatccctgacttcagggccttttgtgccacctctgttagtgagtgtcgggattcctgcaaataccagatttctggagggtttggaatattgattttctgttgaagaaattagggtgagcattttactcaataaaaatcaggaatcacaattcctaaactcatagatttttctacagatcttaagcctccattgttattcctatagtagctcgccctggataaaatggagacatccctcaattctgccaagcagagctgccgggaaagactgaggtcgcaagcccagccctgcacagggcgaaaggaaggaccactcagactgtcctggcctgggtcaggtgccaccccacaggtagtaactcatcaaagatgcgcagtttaacggactgtactatactgacagtaaaacgaactaatctggcatccatacactgtgtctgtcaaactcagtgatgcacacaggtttaaacattgttttttatgtgttttaatttttcatagccttctaacgtgacctgtgagacgtctctgcagagttgatgccatgaggtagtgagctcacctaagaatgtcatcgtcatatagtcagcaagaataagatatagaagacgatgccttcgtggctttacacacctcaaaatgtggagctgtatcatttatgtgattcttttaagacataatcactcaattgaaagcttggagcagataatgcatcttagtagccagagcttcgcggctgccattgtatttccgctccttcgtgaaggggagcgaggcgtgctctgcagagcagcaggtgtgtgccatgtgagggctggagggcacagcccacgagagctgcttcgtggggctctcaccagttctgtggctccatgtccagaccagttctgtggctccgtgtccgtagcaaagctggatctggccacagctgtcgggaatgtctgagggattggcagagttgggaaagacgccggaataagagagttggacaaacattcagaaagggttacaggtagattgtgggaaccgcagaccagtgtgcttgccttggtccctggtgagatcctaggccgtatcagtgacggggagggagccgggcgtcacaccgtctctttgctgatggcatttcttgctgagagatggaggaacggctgttgacatcacaagtatagattttaatgatttttttttttacaaagtatccaaaagaaaagatagagacttggaacgatcatgccgttagataaatttctacctacgtacactattcttacaggctattaattaaataattacttaatgaggagaaaatagattaagtgcaaaggggttctctagaaacgtgccgtggggctattcctcaattctgttatattccacgatgttgtcaataatagaattaaagatgcgtcattgggttgagtaaacttttggaccatgcagtgctaggaggaggaggggtggatggagatgagggtctgagtaaggtctcccgctggcaccagaagagccctgcccaagtgcgaccatcagatggaaacgacctcaggggttttagagccagtgtgagtccactgtgttgctgatagcaggggatgcgcatggctcacccagaacaatcccgcccacagccacgttctgtgtggcccatgtgtgagctgcccgaggccgccctcaccaagtaccatgaacctaggggccttcaaacaacaggcgtttattctcccacagtgctgggagccagaagtctgagagcatgtctgaagctgtgctccctcctcctccagcctctgccagcacctgacagctcccagtgtccctcggcttgtggctgccccactccagtccctgcctctgtgtgtgacccgctccctgtgcacgtctgtctgtgtctgaatttccctttttttttttttttttttttttgagatggagtttcactctcacagcccaggctggagtgcaatggcgcaatcttgggtagccgcaacctccacctcctccgttcaagcaattctcctgcctcagcctcccaagtagctgagattacaggtgcccaccaccacgcctggctaatttttacattttaagtagagacggggtttcactatgttggtcaggctggtcttaaactcctgacctcaggtgatccgcccgcctcagcctcccaaagtgctgggattacaggcgtgagccaccctgcccagcctcaaatttccgtttttgatcaggacaccagtcctactggattcatggcctaccccagagacttcgtggtcacttgattacatctgtgaaggtcctttttccaagttacataacatgctgaggtcctggggttaagactcaacatatcctcttgaggggacacagtttgtactctaagagctcaatgagggttttcaaaattgagaaattttacataaataatacaaatgcctgatttctattttcttaatcaaagatctgagcaaccccagacccgcattcccagccagcagtacctgtgtgctctccccttggggtaggactggccgcccccagccacccagccccccttccacgacgcagcccctccccccactcatggtgctccgagctgcccggccccccttccaccacgcagcccctccccccactcatgtggcctgcccggccccccttccaccacgcagcccctccccccactcatggtgcccaccagctgcccaggccccccttccaccacgcagcaccctccccccactcatgtggcctgcatggccccccagacactggaggctacagcccctgatgtctaccctgttgtggcccacgaaggatttagacacctcttaaaaggaatatatgcactaaatgaatgctgaaataacaaagtcggtagaaaatgacggccatgggagagacacatatgccccctgaggttaacccggcagaactgctgcgtcccagtgacggagaccagggtcccagggatgcagccagcttggccaccccgggggcttgtcctcaggcctaggccctgcattagacagctgcctgcaaggccagaagacaaagaggagagcaggaggtctgccggggtcaggtgggcctgaggaagggaaggagggcatggagtgtgggcggagtcctcaggtcccaggacagcctcccacgtggtgaagggccaggactcccccgggctgcaggggagcacagacaggacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccctggaacctccggcgcgtggggctctcgcgtgtaacctggctgcctcctgcacatgggcgggctgagggccaggcgcaagggcacctgtgcccaggcggcaggcagtaggcaccagtccatggtgggcgtacagatggcagggctgaaagggaccctaaagatcctccggaagagatgtccccccaggggacatctgggagctgtgcacggtcctgagcggcttggggtcccaggcctgtggccctcactgcacagggttcttctgcagcgggaccccgcagccatgtcactctctgccctgggaaacatcctgtgccacggggcgggggggtgggggcggttaggcagcttgggtgatttttttattgtttgtagagatggggtctcactgtgttggccacctggtctgaaactctaggcccaagtaatcctcccgcctcggcctcccaaagtgctgagattacagacatgagccaccacacctggccaagagtgagttttaatgagcacacagtcactgtcttctcacatcagaagtccgtgtgctgagaaatgaggattctctttattctggacgttccagaaagcctcgtccaaggggatcgaatggacgcaggagggagagagctcagattttagctctttgttaggttcgtataacccaagtgccctgtgggttccccttgtgtggatgcttcctgaaactgtgtcctcacggccgaccctgtgtctcaggcgagcacccttctgtgggtggtggggacacacccatgcgtccgacccccacagagccacctgggcctctgtatgcctcacgctcctctctccagcatccacggtttgcccccagctgagggctaagtgagggaaactccttcaggctcacgttgtaaggaaccactgctcccccaaaacatccctgccagagccttgtctgctcactgatgaggattctgtctctgggctttcattgtccatccttgaattccagctccccagaatatccgacttgtatgtgtaaatctctgtcccagccatccgtggatgggccgggctgagtgctctgggacttcagaagcccaggcacgccgggctgaatctgaaggcgggtgtgtggcgcagctcctggagcaggcgtgttaaaccctaagctccttcccatgtagcaggaccgcccattcctgtgggccatgtggctgcacaacgtggagcgaggtcgaagtccccatagaagacagagctggggggctcgcagggaatttctcagaggggtgcccacttgggagggaaggagggtccccggcctctgtgtcactcacttcgtgctctagatgtccgagtaacccagtggtaaatgtccactgccagtaatttcccagcacctcattctgtcccacacacctcacttaggctctcagctacccgcaggaggaccaggactgaaagaattgtcaggggtcaaaatcgtctttgtcattttcttggaaataaaagtaagcagctcatttcagacactatgcccaggaggagcttttgtccagagctgtgcatggaagggcatcgtattgatctgtggcacgtatggcctccatctcccctgatgggagtcagcagggccgctctgtgtgaccacctgtgagagcctagattaaaatcccacccagccatgggcagcacagcccccgacccaggccctctgaccaggggcctcactcccactgggagaggcagaagccacagttgtctctctcggctcgctcctctgccgcctgagggtccagactgtagtctccagccccaggtggcttcccctccccagcaggagtgtcggttcccaggtgacagttatctcttttcaaagtcggtggggtgcaggctctagtagagaagagtagctgggagagcacgttcagctctcactggtggctttcatggagccatacgtggcttgttattgaattgtgactatgaccatctcatgtttgatgtaaaggataaagaaatgatggacctgtgggtgattatagccattctttggtttatggacccgtaagtctcacggagagcattatcaatcacacagtgccgtcacggctgcgttttcatgtggaatgctgaattgctttagaatgcataaagcagggagccgcttgtgactatgcgtgtgtggttttacggaagttggggcacacatgaggcctgccctggttctggtcatctcagacaggaacacggagctcatgaaccttctcagtctcaccgagagccctgggacggcccctccgtccaactctggagtaccttctgccacctgcaggtactcctgaatggccgagagccactcacaccactgcccaacctttaggatgatctggacagtccctgtggaaggaacgagtctctgtggccagctctgagtgctgcaggtcctggctgaagggtcgtgggcagatggtgatgcttgcacaagcagagagataatcgtaaggggacacagggtggcaccccgcctggaaggcagggaatggaagcaggagggaactggcaccagggagctggcagcagaggagaggatgtgcctgagcttcagaagggaaggcaacactcagaggcacacggcacggggcagaatcagagctaaaagaaagggtgcccatccgaggcaaagcacctttctccagcctcagccctggaaggccactgtcctgcttacagggacccttccttgcagagcagccagcggctggccccagcggcccaaggcagatgcacactgctaagggatgatagcatctccactttgcagtgacatttgctgaaatgagatcataaaatccacaaggactttatttttgagagttaaaactagaaatgttaactcttgtggctacttttgttttaaaagcagcataagaaatcttcctctggctgggcgcagtggctcacgcctgtaatcccagcactttgggggccaaggcgagtggatcacaaggtcaagaccatcctggctaacatggtgaaaccccgtctctactaaaaatacaaaaattagctgggcgtagtggtgcgtgcctgtaatcccaactgtaatcccaattgggattatgggaggctgaggcaggagaatcacttgaacccaggaggcggaggttgcagtgagcagagatcgtgtcactgcactccagtccagcctagtgacagagtgagactctgtctcaaaaaaaaagaaaaaaaaaggaaaaagaaatctgcctctgcctgtaatacctgccgagactgatcaagtcttccctgaagcttttaaactacagcgggttagcattgccatccctgaagggtacttagcgggcacgtatgttaactgagcttatgacatcaattcatgggaagctaatatagtgtcgactctatctccacgtgtgtggggggggtgtccatgcacgtgtgatgtgtgcttgagttggtgtttactatatgcctatgtgtgtgtgaatgtggttgtgtgtgtgctgtgtgtgtaagtatgctgggtatgtgtctgtgtgtatgtgtggtgtgtgtgtttctgtgtatgtgtgtgcgaggtacttgtctatgtgaatgtggttgtgtgtgtgcgtgtatgctgtatctgtgtgtgtttgtggtatgtgtgctgtgtataaaaggacaacccacagcactaaacctgaatctatagattcccaggtacctgcgtatcagaaaatatgttttactattaagttttctgtgtccttcatctgtctggcattctggagggatgtggtccaccttgatccggaaggcaccggggtcagattcactcagttcccggcattctggaaggatgtgttccaccttgatccagaaggcacctgggtcagatttgctcagttcccggcattctggagggatgtggtccacattgatctggaagatactggggtcagattcgctcatttgctggcaatcaggagggatgtggtcacgttgatctggaaggcactggggtcagattcacccagttcccagcattctggaaggatgtggtccacgtttatccagaaggcacctgggtcagattcactcaattcccagcattctgggggatgtgatccgcctttatccagaaggcacctgggtcagattcactcaattcccagcattctggaaggatgtggtcacgttgatctggaaggcactggggtcagattcacccagttcccagcattctggaaggatgtggtccacgtttatccagaaggcacctgggtcagattcgctcagttcccggcattctagagggatgtggtccctgttgatccggaaagcactggcatgagatttgctcagttcctaacattctggagggatgtggtccacattgatctggaaggcactggggtcacattcgcccagttcccacatcgtggagggatgtagtgcatgttgatccggaaggcactgggtcagattcactcagttcccgccatctggaggaatggggttcacgctaatccagacagcactgcgtcagattcacgcagttcccaccatctggaggaatggggttcccgctaatccagaaggcactggagtcagatttggtcagttcctggcattgggaggggtgtagtgcacattgatctggaaggtgctggggtcagatttgctcaattcccagcattctggaggaatgtggtccacgttaatccggaaggcacctgggacagattggctcagttcccggcattctagggggatgtggtccacgttgatttggaaggcactggggtgagattcactcagttcctggcattctggagggatgtggtcacattgatctggaaggcactggcgtcagattcacccagttcccagcattctggaaggatgtggtccgcctttatccagaaggcacctgggtcagattcactcaattcccagcattctgggggatgtgatccgcattgatctggaaggcacctgggtcagattcattcaattcccagcattctgggggatatggtccgcgtttatccggaaggcacctgggtcagattcactgaattcccagcattctgggggatgtgatccgcgtttatccagaaggcacctgggtcagattcactcaattcccagcattctgggggatgtgatccgcatttatctggaaggcactgaggtcagattcactcaattcccagcattctgggggatgtgatccgcattgatccggaaggcacctgggtcagattcactcaattcccagcattctgggggatgtgatccgcgttgatctggaaggcactggggtcacattcactcagttcctggcattctgggggaatgtggcccatgttgatccagaaggctctggcgtcagattcactcaattcataccctgcctcgcctcctgctgtgtgaccttaagcaggttaccttgtcactctgggcttcatttgcctgtctggaaaatggagggttttgttttgttgtgttttgttttgttttggagtctcactctgtcacccaggctggagtgcagtggtacaatctcggctcactgcaacctccacctcctgggttcaagcaattcttctgcctcagcctcctgagtagctgggactacaggcgcatgccaccatgcccagctaatttttttgtatttttagtagagacggggtttcaccatattggccaggctggtctcgaactcctgacctcgtgatccgccccctgggcctcccaaagtgctggattacaggcgtgagccaccacgcccggccaagtacaggttttaatggtgctcacctcacaggattattgtcagtttcacaaagagccttcctgcaagcatggaggttagtgctcgagcacagagttagacatttgataacagtcactgtcatttcatgagggttttttaattgtgaaaaaattgtccttagttacagacacacactctggggcttatgaagattactttaaatatttagtatatgtcaattctaagttaaaagtctgctttgcaagttacgagagcaatagaatggccgccgtaaactgcagtgaatacagatgcccctcattctgcttctgactccagtggttcctgttctgtcctggggcttcctcaggaggtgctgagaaggaaagaaagggaacacctgaggggcacctgccctccctccacgtgtgcccagaagcgaatgtggggagccaggaggtggtagggtgcccaggagagcgggagcagcatggggcagggcgggcccagccgagggtgggaccttcaggccctccattcccaagcacacacacgtggtctcttgcactcttcatcggtgatcatttttcctctttatatttgtgttacttaatcctattatctttaaggatgccttccacatttgtctgaaaacagaatttccattggcatccatgaaaaccaaggtcggagctcctagagtcaagatggtaataaaaagtagcagggcccctgagggtgtggatgccaccctgtcctgagcaccttacagccaagagctcccgggatcagttcattaagcccatgagtcaagtacattttattcccattttcagggagagaaactgaggcacagggcagtgaagccacttgcctcagtcacacagttagtggcagagcttcctctaaaccatggcagtgtatactgggcacccaatcgtgtgagtagaaacaggaatcttctaactcacagcatcagacaatctaaggaaagggattcctggtggcacctcaccccgcggaggatggcacccggagctgcagctggaaaaaacagaggccgtcagctttgggcgagtgagagcttcagagggccctgagccccacggtgatcacgcattcaaaatgtttgctgcactcagctacataaatattacagggaaagagaaagtggagggcaggggagaggcagcctcaccacagccccggagaaccagagtgaggcaaatgtagttttccgggcctcctgacctgccagtctcggaatcccaaatccagagcagcggcagaggacaagcggccgcggggagtgaggggagcgtgctgaggtgggggttggaccgcaggaaccccaccaggctggccgggaacttgcctttcacctcctgcaggtgcctctgcctggctgagaagaagttcttttgtggaagacccacgctgggtgttcccatctggttctctcctggacggcttgacgttgctagctccagtagttaccctccactgcacagcgagttatcccgaaacttagcttaacacaaccatgttttatcttacagtttctgtgggcctggggtcctggtgtggaccagctgggggttccagctgcgtccctataggctgtgctgagggtgtcctctcagctcagcagcggcagccccaggccctctgtgctgttagcccctgtccatgggccctgtccaccaggtttccccatcagccgccaccacctggcagcagacatccctcggagctcgaaagtcggtcggggaccccagtgtgcgtccttagcagccatctctgctgcctttgctgtcctccaggcatcggagtggagtcaccaggtccagtggcgctcaggaaagagaattccaggaggacggaggccctgggccgtctcagaggctgccggccacactgacatttcaagaatgagcccgttcaatttcaggacactccctttgccacaggctcagtttaggagctcttcttatttctctatttttccaaactttcgatacttccttttctccccttcatcttaatttaaggctttccacaaagagctctatcacagccccttcctaagaccggtctccaacagcagcagcttgaaaacagctattttggcccctcaggtatgaaggtcccctagtgtttcctggagacacctccttctgacctcagctccttctgagggacgcggggccagaggagagaggagcagattcggcagcgcggagcagcaggacggcgggtgtttgaaatggcacacacgcacttttctggtggcatatgttgtggtattcatttagcaaaaatccatttttaaaaccctggacctgtagactgatcaacagatgaaacagtgagctgagctgctgcctgcctttttgtgttgccagagattattatccaccatatgctggaagcctgatggtgagcctccgccccggggctctcaccaacgccgcagcacgcctgccggtggacaggagcctgtggagggcactgagccagccagtgagcgtgggcaggcagccctgtgctccccactgggctgtgagaggtgcacacacctcagcttacttctctgaggggagacacccatgttcaccagcaccgaccaggctttctcataaactcagagcccgtgtcagttacaccagcacctaccaggctttctcatagttacaccagcaccgaccgggctttctcacaaaggcagagcccgcaacagttacaccaggaccgaccaggctttcttataaatgcacagcccacgtcagttacaccaggaccgaccaggctttctcataaatgcacagcccacgtcagttacaccagcacctacccggctctcttacaaacccacagcccgtgtcagttacaccaggaccgaccgggctttcacacaaaggcagagcccgcaacagttacaccaggaccgaccaggctttcttataaatgcacagcccacgtcagttacaccagcaccgaccgggctttcttataaatgcacagcccgcgtcagttacaccagcacctacccggctctcttacaaacccacagcccgcgtcagttacaccagcaccgaccgggctttcttataaatgcacagcccgcgtcagttacaccagcacctacccggctctcttacaaacccacagcccgtgtcagttacaccagcaccgaccgggctttcttataaatgcacagcccgcgtcagttacaccagcacctacccggctctcttacaaacccacagcccgtgtcagttacaccagcattgacccggctctcttataaacgcacagcccacgtcagttaagagtgagaagctttcatacctagaaccgcagtgctttgtgagtgggtcagagtgtaggataaagtctgcatggctgtggccacagaacttcgggtaggaagggtctgggggcagcgctgagtgacgggaggagacgcccctggaaggtgcatctggagctgccggagcagacaccccctggcctcttagagtgtgtgtggtagaagcacagaaatggcagtgctcacacgatgcctgtgaccacattctatggaaaatagagaataaagaccaccatctttttgaaagactgatactattattgaattactattcaaagaatagtaactattattaatattattactggggggaggcttggaggctctggcggagacacgcggagctcagactgcagagaggagtgactccaagcctgcctgagtctgtagctaagaacggagctctcccctgtgaaacatgccctcagtgtgtgggttcgcataggagcctgtgtgttgattgagattctgccactgaccagcttcggatacttcatttacctctcagtactttggttttctcatctgtaaaactggaaaaaaaaatgcatgaattccacggtttctctgggagtgaaaggaaataaaatatgggaaagtagcttgacaggatggagccgctgctgtcatgctgactagaaagtactcgcctgtctccacgtgtgcgaaagcgtgcgtgtgtgagagacagtgcatgtgcacatgcgtgaaatgatgagcagtccgtagcactcacatgttctgaaggtgagggactcagcattcgacctcaaacaaatgaaaggccccgagcccaccgctgagccagccagggttcctcgatggggagagagtgtgcaggagagggtgagggtgccctcgcggccgctgaccaggggctcctggtgtggggaaggcatgcaggggaggtctggaggcgcccctgtgtgtccttggttgatcagatgaaagggagccagcctctgatgggtgtgaggaagggttggtggaattttcagggagggacaggaagctgttccagtggacaaggtagagatggccgaggctgagggtggtggatggaggggaccagaccccaggactgcaggaggccagccgccatcagcatagggggatggggaataaggtcagataagggatgacccgaaaaaagtaatgggatctgattgtggggaggacaaaagacaaggaagcctcaagcctcaccccaaagatggacattcaggacaggctgtcgtcatggaaactgggaaacccagtggaggaaaagtaactgactctgttgcgaacgtgcttggacaagtgagcctggtttttccgcagtgtcactcagaggtgctgtctgtcttagtgctcaccatgtctggggcactactcttttgaaatggccttttcaaatgcactcttaatggtggaagtgatatttcagatttgtttcttttttaatactctaaagccatttggagacaaggacagtcaactggaggagtgatgaggttaaggtgtggagaatcacaagtgaaaaagcttagaaaacgtaagactagatttctggttttctttgggcatatttctgaagacaattccaaatgggaatttcagaaatgactgagcaaggtcgaagtaggtatatcacttcctaaagtgtgtgaatggaaacatattagggagacatatagttacatgtggcagattcatgagggttttaaaagtggtctcagtacctgacagcaccctgttgcagattatatgctaatgtgccagacttgctagaatgccagcgtgcatcccaccgcactgaccgaggacatgcggcggctccatgcagttggccacttggcagctgagggtgagtcacatggaatcctgcaccaccaatgctccgtctcagtgacagcttaccctgaacctgctccgcactgtgtcagaatgaaaagcaactgggcagggtgcggtggctcccgcctgtaattccagcactttgggaggctcaaggtgggcagaccacccgaggttgggagctcaagaacagcctggccaagatggcaaaaccctgtctttactaaaaatacaaaaaaaaattcactgggcctggtggcagacacctgtaatcccagctactggcagcagaatcatttgaacctgggtgtcggcggttggcagtgagccaggatcacgccactgcactccagcctgggtgacagagcaagactccgtctcagtaaaaagaaaaaaaagaaaagaaaagcaactggctgcttcctgaatttttgttcacattagatctaaatatgtatagacatatttgcaatataaaatcaaaaaatgtcacttgatggtgatcatttgattttccttctcagtagaatccaggtacaaaggtgagctttgtcaggctgttgctgttctttcatttaattggagcctattttcatacattaaaatatacataggcacttttcttaaagaatatgtgaacaggacatggctaagttatataattgtgaaacaaacatttacctgaattacctgaattattgttctacttttaattccaaagcaacccgaggaaaagtttccaaatattgtaatggatgtgtagtatgtaactgacaaaatatgtgaaagagattttaaacaaaaatagagatgacctggttattcttcacagaattatcttgtttcctttcatctgaacataatggcactatttagccattttcaaaaaagttagattcttgttcatgtggtaatgagtctttcttacaaacattcaatctaaggaattttagctcagttttgaaaagaatataatctagttatgaaaatacaatatatatactatactgaacatcaactattaaatacgtgccttatggcattattctgtaaataataaaatattagatctttacaaatacgttgattaaaagtaatagatcctctatactagaatctagacagtgaaaaccggattcacctctagggagactgcactgtttataagtacctgtgcttatgaacagtattttttcaaaatgctacttttaatggacaaaactaataatagtaataatgaagccttgaggctttttctattctttgaattataactttgaagtttggggaagaaaagtctaaacatcccgacatatttgtcagccaatccttcaagcagaaatgtttgctgaaacacatacttggtttataagcacgtggtttcatgtaagcatgtcaagccattggtgggatatcaagtctatctcatcattgagttcctatttttggatttcaaaagcttcagattcatcggcatatgagccagcatgagaattaataataaaagctgagttgtgttggtgatttatttttcaaaacaaaaaatgacttgcattgttctgctttaagtaaagaattcatatttttcttgaaataaagtgaaataatttgaaaaaataattttagcatttctcaattttaaaataagggcattgattttatagctatatcttacatttgcactgcttacatttgcattgcttatgttatatctaacataagcaatgtggcaaaatcttatcttaaaaatcttcccagttcatgaatttgtcctgtgggataaactctgcttccagtatgcatgggtagatggtgagggctctgccaagacccagtatgcatgggtagatggtgagggctctgctaagatccagtatgcatgggtagatggtgagggctctgccaagacccagtatgcatgagtagatggtgagggctctgccaagacccagtatgcatgagtagacggtgagggctctgccaagatccagtatgcatgggtagacagtgagggctctgccaagacccagtatgcatgggtagatggtgagggctctgccaagatccagtatgcatgggtagatggtgagggctctgccaagatccagtatgcatgggtagacggtgagggctctgctaagacccagtatgcatgggtagacggtgagggctctgccaagatccagtatgcataggtagatggtgagggctctactaagacccagtatgcatgggtagatggtgagggctctactaagatccagtatgcatgggtagatggtgagggctctactaagatccagtatgcatgggtagatggtgagggctctgccaagacccagtatgcatgggtagatggtgagggctctgccaagatccagtatgcatgggtagatggtgagggctctactaagatccagtatgcatgggtagatggtgagggctctactaagacccagtatgcatgggtagatggtgagggctctactaagatccagtatgcatgagtagatggtgagggctctactaagacccagtatgcatgggtagatggtgagggctctactaagatccagtatgcatgggtagatggtgagggctctactaagacccagtatgcatgggtagatggtgagggctctgccaagacccagtatgcatgggtagatggtgagggctcttccaagacccagtatgcatgggtagatggtgagggctctgccaagacccagtatgcatgggtagatggtgagggctctgccaagacccagtatgcatgggtagatggtgagggctctactaagatccagtatgcatgggtagatggtgagggctctgccaagacccagtatgcatgggtagatggtgagggctctactaagatccagtatgcacgggtagacggtgagggctctactaagatgcagttgtttcactgccctattgttgcaatggacttaccttcttttatgatgaataaggacttctcactagtgtctgatgctcttccaaatattgtccttgaaaaaataactactggtggttaatacatttcaactcagagtcatccatatttgtctgtggaagtgtctttgttcttaaattatctcaatgccaactactatgctttactaggaggctgacctctcaaaacatcttgttttcaaaatgcactcattgttactttaaaatgttgttttctttaaatatatgcatgaagaaatgccttatacacatacctacaatatttttaaggatctatttttatttttatattataatagtaaatactttttaaaaatggatttagaaatcaaaagtattttaaatactatttgtgtactgtaaaattataaattactgtcttagtttaaaaaacaaaattgatttagacttctgaaatcaagagtctcaggtgttttttaaatcattttctaccttaccatattattttaaattcctgaaatatgtgttttgctttataataatcatgtttcccataacagtctttctctattttgtttaaaaatacattttctttgataatttagtgcatgggatatttattctaatcacttaaatgtgtaatctataacaatttggtgttccttaaattgaaaatgagattcttatcacagaacattaggttttacacataacaaatgtgaaatgcactttaaaagaagtattggcaggatcaacaaatcatttttaaactatttatattgtgtagctattttgtaggtcttggagaattttacatatattatattttttattcatcagccaaacaaccctaacttctatatgaataatgtactcatttgtcatatataaatgatttcaatcaacatgtctctcaaaaatattttgtgtcatgtttaaaagttttctctgaaaatgttattgaaatcatgtaaattgaaatttattattaaatgaagtctaagatctcatgaccaaaaaaaaaagaaaaaagaaaaaatcctcacatcattattcattcttcaaattagctgaatctagtctcacattattgccgagacacttttctaaagtattttcaagaattagaagatacattttcctgccctggaaataaaaagggaatttaaaataaagaaaaatagaatggaaatctggcgagtaacttaccagtttctgaagcaatagactaaaagaaccagcacctcaaatacaaacgcgttcttctcatgacccccctagactctagggcttagagtgtgggtccgccttcagctttggcgaggccagttctgcagccccactgaggtcaggccgcaccttagaggaggggtggtgggaggaaggggagtgagttggaggctctcagacataaataaccgtctgccacccagaatatattgccgcaggtgcaccaaggcgtggacgaggaagtgtgctgttctgctggtgaacccgcatggaacctttcaggccctctcacgatttttaaagtgacccaaattgaactgaattggtgccacctcccacccatctttcctcaaagcactagaaagacaggtcattaaattaagatcaaatcaggaatgcggtgctttgatgttggaagtgaaacactgagacaacggaagaagggactaacgaaaagaattgtatttatttgtgtattcactgtcaggtcatgtctgtgaagaaagcaaaaccagctctctggcctgtactaggctccgccttgctctggggtcgccggccccgtggccgccccaggacccccagacggcagggtctgcgtccccctagccctgtccgaggcccagggtggccgcgtgcggtctgcgccgccgtggagactgaggggctggacacggcctggccgagggagacggctaccggccactcctggccacctcggagagctcccggccgcctgctggagaccccagcctggatgaggctccggcgatccagggcgaggagagccgcgggctggcggggaaggtggtgcgaggtcgccgcgggcggggagggtgcgccagggcccctctggcctctgcccggagccggcctggccgggagctccccgaggcgacgcgcggttccccagctgctccccggcccagacctcaggtgcgccgggcgctcgggccgggcagggccatggtgggggcgccgtcgcccgcccctgtgctccgggtcgctgggaagacccgcccactccccggtgccccaaggccctgcgaccgcagcgggagggtcggggcagcgagggcaggatgccccaatgccccagcggccgatcccggggcctgcgcgcgttccccgagcctaccccgtcgccagcgcggcgcagccagaccctagggcgctcccagcaccgcggaggtcgggcctccagtcctggaggggtttgctctgtcgccaccctagggttctgcgatcccctcccagcccccgcggggagtcccgggaacaccacgggcacacacacatcagacacgcgcgcacacacagacgcgcgcgctggccgttgctatggagaggccggttaccagccaggctgagggcagcaggtcccctcctccgagccccctcccctccccgtcccttctctccgctgtcttcccctcttcccgccccggctcccgagtcctcctcccgccgtctccggccccccgccccccagcgccacctcccctcccctcctctgtctctgcccagggccgggcctggggtcgccctggagcctggctggggacgccgaggcaccggaggagggtggcggggagggacaggaaccgctaccactcgactctttgcccgagaaggtccctgggagggcatcccgggcgctgggggaacccgagtaccgcttctctctgacctgcccgccgccgcgccgcccccgagccagggtgcgggggtttttgcgggccttgccctgggcaggggggacgagagggccaaggtgatgtaccccgtccccgcctactggaggggttcactcatgggcagaggacgccagtgacgccgcagtttctcgcctctcgcgcccccgccgagccgcaccgggcctcctgcagcccgctcaggcctgcgggaaccatggcccgatgcgaggccacttctttgccctggagctttatgaagcgctctggccttgccctataaatacaaaaataaatgcggaactcagcctgggcctgcagtcagaggaaacggggtccttcggccacttttagacaggggcctgcagcggacggcaccgtactcatatctgtggaccacccccgcctctgagccctgccccctggggctcgcccccaggttttacagaactaggtttgtgagagaaaagcgccaggcaaggccctctgcaccgagcaggtctaggggcagcgccagagtgcaagggaggggaggggagactgtggaagcgccgcctgggcctggcctggggaggtggggggtgtggaggagttggccccggaggggccgggagcgggcgccgcgggcagccgggtgtgcggcgggaggggcgtcgagtggcgcgggccgccgtctccagctgtcccgggcgcagggaacaatggccaggcggtgggagaggggggcctaggagggggccgctggggtttccagaaaaggagaaactaaagagccctccgcagactgtcatctgcgtgtgacaagatctgcgcccccctcttcctttcttctccttgttcctgcagctgtgggcctcggagagcgcattgtacacacagatgttgggtttcagctctccggctctcgccagctccgcgggggcgccgcgcaccggggtgccccaacctgtggctgtggcccggggtccagggcctggggagagagagcatgggcgggaggcgcgggggggaggtgctcagtggtcctagtcgccccgagaccctagctcttctcgcccgctgcgggcctgactgcgccaggggccgggggttatgtgggcaggctcgaacgactgggagcgtggcctgtgattctgctccactccttgcgcccgcagagcggtggtctaggccagaccattgacctgggtagggggaagggcaaggacgcagctcgcacgcctgggttttcaccgccgtctcccttcggcgttttgggctggcggccgacattggcctggaccaaatggtggcaaagtctcaccagttccgcgtctcgcaagacactttctacgcgcatcgggacctaaacactcgggaggaccctggtaaagtgagcagaggggctctcgtctactcgccctgaatcattggcctgcttccatttggaaagggagcaaaaaggcccgaacggcaacactggaaaaggtaactgggaagaacgatatgccgtgcaattttctcttgccaagagtggcgacgcaccccacccacccctcccaggacaaaggtcacagcagagccgcgcgccttgacttttctggccgaggtctctctcccctcggtgctaccctgaacttgcccagtatgaacgatgaaagggagaaacactgaaaagaaagaaaaggcgaaggccctggcttcggcgttgtaccaatgactgacaaagctgatgtccattcatagtctcgggcgggagagggtgtttggagagccgcggccccttagccaattgctgtcagcaacatgtggggggggggggggacatcgctatagcaaccggtggctgggccgcgagccgcgccgccgccggccgggtgcgcgccgggccggatataaggcggggcgcggcggccgcgctggttggtgctacgcgcgcggccggcggccctaccgggaccgtccggagcccgccctgagcccgcccgcgccgcgccccggcccagcgtgcctagcccgggggccgggccggggcggagcacgcggagctgggccgagcggccgcgcagagctccggcgcctgcgggctccgagcccgtgccgccgcgcagccgctgctgctggagcagcgacgcgcggcacctttgtctcctccggccgccctagaagtttgtggtcagaagcggatgaccccgctagtctgtggctccagcgcagggaagcagctggctgtgatgatggcgctgccgctacccgcagctgctgcgccccgaggccgctcggcccggcgcacgcccccacctcctcccgcgcgggcgctgggcgccggcccagctgcaggtaaccaggggtgccgggcggggcgcgggcgctcgtagtgcggttgggtgggccctggaagaggcgagagaggctgggatgggggcggagggagcaggaagggcccacgagagcatcaccaggcgcgtaggtggtggggcgaggaagagagctttcgaaggctggagggcgcgcatgggggctctaacgggcaactagggcgtcggagagctcagttcagggggtctctgcctcgccgcaggactcctgtcaaaggcttgggccggcaggggagagctgcgcctgggatcatccccaagtgggtctagggtgggcctgtgaggaggagcgggcaaagggcagctccttctgagcgcacagatttggagggttggcagctgtcctggcccagcgccccgcagagaccgccccaaggagtctaggacctccgggacttctccccagcgctcttctctcggcctttcgcgttgctccccactccctgcagttccgaccattgcagggtgctgggggtgggggggtgcaggcacggagatgggaggcgtgtgggaaaggaggagggaaggggcgagcagccaggatggagaggcgccagtgtgggcgcattttcctctcagcccattttggggcgctcttcaccctcctcaccagggtccgggagcgcgcctccgagccatgggagtatcccagcgggcggcgaattgcagggaaccgagggggcctgcagggagaggcgttccagaggcaggtggggacgcctctgagaggccatctctcctcccccaaagagaactgcgctttctcagcgcctcccccaccccaggtgaggcggccgcgtgctcgccagagagaaacttgtgactggacccgaagctgttggaacgagggacttcatttccttccttcgtaactacctgtgcagttccgaacactggcctgctccgtggttttagagaagcgttgctccagggaatcgggcgaacccccaagttagagttaaaatctcagcacaattgccttttagggccggagagagtctcccgccctttttggtcctcagtgcgctgagctgggcgctgcgggctggacggctgggagaggggccccgccacagccctgaggacgacgcggttcaagtcaccgacctccgtcctcggacagcggccccggggtcccggacgtggtcccgcctcccgagctgcgcgtcccggccggcaccgtggagccacccgcctggagtccggagcgcagggtgtccgaggggtcttcgccaaaccaggctgtccttgcgtcgccgatcccagattttaggacgcgatcgaacaagagaggaagtgaaggtttgtgcggaggagggagctggaagctcttcctttcaccgacacagaggaaagtgccctcccgccccctcccaagcacacccctctgcgctccagagaagacggcggcggtggcggctgcgccgcccgggggctgcgagcgccgggattcacgggtggacgcgggcgtggttggggaccttggtcctccctcgcggccggcgcgctctgtggccaggaggctgggccgcagcaccctccgcgccgggacccctctcctggctctgaatacccgcggctcccgggaacccttggcctttgtgtccggcgctggggcctgatctttatgactcctgtggggatgcggtgaaccggcgaggggggagggacggggaagcgggggagaaagcccaggcaggggacggggccgaacgctgaccctcctttccctcgccctctgctcaaagtcgtgccacagaggggttctgacaagcgacgctaggcgggtcttgggttggggcttctgagtccgggtagaggaggcgaagcggtaacccccccagtcctgaagagggtctggttcttgcggggtggggaggccaggccccgtcccgagaagcacctggtgtggaaggcgcgcgtgcgtccaggcaggcctggggaccaggcgggcgggccaaaaataggggtcaggagccggtgccttaagtgtgatccgctgagtctgagtttgggtgtcatgaaaacgccagcggagagtctgaaagaggctgggggcggctttctcaggggcatccttcccctgctcagcctctgggtccctctctcccaccggaggcaatctgctggttagaattagtttgcacaagggtgcttccccctttggacatcagtatcataaatcttccctgatgtcttaaaacacagtatttctttaaaactgatgttttaggagtgcttaaagatggcaaatagacaatttattgcctttcttgtatattcacttttaagtgtatgcctggaaaaactcaacaaatagcccattttaaaacagtatatcccaacttattttcattaaagtttacatttaagaataatttttccttgaagattcttttcttttgcttttttgggttttttggccacttgaatggcagatttgcaagtacaatttcatctgcacggaggaacaatagctttcagttgcacaaagggcttctcccaccctgaattcagaccgcagtgcctcttgctctgataatagcttctgaaaagattttgtaatgcagagaattaatacatgattatttccgcctgacttctctcatttattagaattctgtggcaaattccaaattaaaagtagttccgttaacagctttaaaaaatacttttaaaatattttaagacaccccttcccccgtgttttcaagttggatcacttgctatggcctgaaaacttaaaatgttcatcagccctaaagtgagtattatattttagtaatgccttttagtaaatttagaatgaaatttcctaataattctaagaggattcatccagcaaaccaaagataaacttgttacagcaactcattaatggtctctaaaactgacttctaagttttaagagaaaaaggtatttataatttagtaatttaaatgcacacaaacataggatgaggctgggactgaaatctgattccttagaaatgatacaaatgaaagcatcaacaatgttagaagtttaacattaactggcaccgagcacctgtatccctacgtctttatgatgcaagcatattttaatactgcacatcgtgactcagagaatgaactgctcctgttaactggttatatcacacaaccttggaaaaggactaaatctggctacccgtcaacacatatttaccataaagttttgtatttgtgtggctgtatcagctctcacaattgagtttgggcataacatgtccttttttcttttcttttaagcttaccacatggacagctaaaaaagttctgaaggcattttcccgtaaatggctcacaagggcatggggtggaagcctcatgcacctccactcaggggcatggtcaaaataatttaaattggtcaggacagtgtctgcagatgctaatttctaagacagctccacaaattgtctctgtggtcatacacttattttgaatcacaacttttgcaatactgtctattctaaatttgaggagttgcaggtgcagacggttgagaggaagaaatatgcgatattgtacttcatcttattctcaagatagatctaacctgggataaaattaacttaatcattcctgattatttttttaaattatactattcctgcctctgagaactcagcactgaagtgtgcctatctgtgcatctcccccacccgggacgcacccctgccgctgtgttaccaggcctccttctccctcctcctcctcctcacttcttctctgttccaaactttcagtcattgagctgccgctgtacagaagggggtgttccgcttttcaaaaacgcctgactgtaaatgtcaaagtcataaatatttaaacataattttctttcaatttcaagtcaagactgataagatgcctctaattagtctgggctctctttggggtccacccgccgtggtgcagccttggggggtcggtgcccatgggggagatggcgctgaggaccaccaaagccacacctgggtcaagactgtgcctcaaactcacttttaaactcatttctttctcttaaaggccatggctagcaggagtttgaagattttttttaactccacaaaaagggagtcaagtcattgtaaagttattggaactcaatcacttagaaaaaaattctttaaatcttcgtttcttccgggattcctaagacctgacttgcagccaacagtttttccctccgcatcaccctcctgctcagcgctgggtgggacacttgaaaccgtcctgggcgtggagggaagacctctttcttcggtttcttctgcggcgcccgcgggcgggtaggaagcgggtttcccagccgggccctgggatccagcgacttctgtgtcaggccggtggaccccagtcggtccctctgtccagcgtcccgcccttccctgcagtaagaccctcctcgccctcagccccggcgctgcccgcggtcacgactccccggctgtccaggtcccgcggccccgcgcggtcgccctccgggcctcccccggcctctcccaggttgcaggaggggcctccttgtggaccggcgcggggaggtgggcctggggcggctcccacccctcctctgctgggacagcgcgggcctaggcagcagggagccgggcgaggttggtggagacaggactccagggcactggggctccttgcttcccctccggggactcctgggacccagcggggacccgggaggagagccaggagctctccaggcaatcgctctccttgacatttttctttgacctttgagtaaatccaagcgcgccaagggaggcctccaaagcaggcccggttccgctcccgcgcgtgcggagcgtgtcgagggtcccggcgacagcaggtgtctgcctccctgggaacagcctcggctggccccgggtccctcctgccgcccgcagaccaggcctcctcctccggcccccgcgcgtcccctgccctcacctggcccgagtgaccgcgggcagcgcctgtgccccttcctcggggagccggagccggcggtcgccctgcgcctcggaaccccacacacccgcgcgcacagcctgggtgccactgccgggtccgccacacgccgtggccccgccgccccctcagaaccagggtggtcaccgcgcgcgtgtgggcctcacggcgcggggcaggaaggttcgggaagtccctgttcccgggcgcagtcatccacgtgagcgcgcggtgtcctcccgacgccggggcagcggggccggggtcgcctccgcgctggggcggatggaggcgcgcgggggccatcggcccggccgggatgaggggtgggagggcggcgggcgccccctccgccggtcgcgccgcttcctttgttgttcttgttccgtcggccaaggccaggcgggacccgcgggaggcgagaggcgaggggcgaggggcggcgaggggcgcaggccgggcccccgggaaaagccctcccgcccaggtatggctccgggggacgcggccccgcaggcgaacatggaccctggggtgggcagaggacccggcccctgtcccggcgccgcttggacccacacgcctctcgcatccggggtcgcggccgctcctccccgcctggggccccccgcgcgctctagggtccctcgcgccggcccaggagggcacagggcggggctgccgcccacccgggagaaccagcgcccgcgcggggaccgaggagaccccggcccgggggaggtggcgcgtggccggcgccttaggtttcgtgaacgggctgtgcccggggaggggcggggaggggcgcgcaggagacccggtgggcggaccccggcggactctggggctgggtcgcgcggctctagagtgacttctttctggaagaggctgtgtgggccggagggaggggggcggaggggaggggaggggaggagaccggggagggggcgcggaccggatctccacgcgaagggcgacccggcggcgagacccagcggtggctgcggggtccggaccaaacggggttcgggccgctcccctggttcccgcccctcctccctctcccggctccctgctcactcccctcccccaccccgcgcctcctctccctctcccccctttccctctccctccccctttccttccctccctctccaaagcctccctccctctccgcggcggctccaccgcctcccgccgctggagaacctcgcggtcctcctccgagccgcgcatccaggcaggaaaatccgggcgtcttttctcatttaacccgcgtttccattaactcagtcccggcaccagctaatccgctgcaccgaaggcaaaaggaggctaattaatgaccagcttttccagtcaagaccggcgataattgctttggtggcctttatgattacaagataaaaacgggcccggcctgacataagaggcactgtgtacgctgggagacgggaggaaatgaagagttgggaggctgaatacggagcagaaaattactaatagaagagagataatgaataggccggccaggcattcatggggaaaaatccattttgttaccacgcgaaattaggtggtggaaaggggtttgctaattgttctcatcttgtagcagccaggaccaaggccgggcgtgctcccccattcactccccgagtcattgtgcagggcgcgcggtctgcggggcggccttcccattttcctgtggcgtccttaattgttgctaatataccttctaatgaagctaatgaggggagagccgtgcaactatttgcacgtggagacaagtgaaatgcaccgaaagggctttctcatattttcaccagccctacccccgccctccaagaagcagtgagaatctgaagggttttcctcgctgagaagtgaagttccaaaggctctgcagctcctttcaaggaaaaatacgtaggtgcataggtggcaagtgttgtggtctgcaccaggccactcctggagagtgactggagtcaggtgggattcgaccagcgctcgcctttcaagacaggtggatccaaatcccctgacctgggagggagaatgttctgtgaagatgcacagagccagtcccacgttcctttgttgctgaagatgtgctggacttggtggctacttgaagctgcagaaggctccgggcctgcccaccctcctccaccgccaagcctggcctccccccagcacccccgacaatcattgtgcaagctctggacaaactgctgtgcccggttagaagaagggatggatactttacttaaggcagcaaattagctgccaaatacgttacataaatttgaaaaacagccaccactgaaggaaaaagtgatgcctctgactgtcctcttgagcacgctgcaatctgcgatgtgctattttcaaatgatttctgcttcttctttgacgggggttgttccgcagggccctcccgttgtggctccagggccagcacagcgtcctgtggggctgagctttccactttcaagttgcatttggagacgtgtgtttttaggaggtcatgctttgtcaggagctaacacacccctctctccttgttctgcagaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggtaagaggagactttttaaaaagtggtatatcggatttatctgttgaacaggcagatgatggcgttcctctctggcccctcctccattcccagcagttgttcctgtatcatagtttggggtcttttatgaggacagtttggaacttctcatcagcattcgtgcaaatacgttgcagccacagttgtgcagctctgtatccgtctgctcttcttggatagcctcgtgttaactctggaagaatgttgttaattagaagtgtggaaaaagtacagtacatgaatgatgtattatctgttatcttagtttggccactactactgaaaagtgccagagttgcgagatcatttggcgtgtaggtgtttgaagatgtctcaaaaatcatcggcttcctcggggtcttctgtgaaaagatcctttgacctgcccagttgccaccctgtgctgttgtccggtccagtgaagcctaacgctgaccaggggaaggtgacccacacgcgtccccatgagggacaccttctctagaggcaccacagacacccctggaaatgagctggaaaccggggaggatgcgaggaaggcaagttcagaccaagtcgggcatttttaaaaaaccacagagtttctggaagttctatggcgcacatttcgtatttagtattgtcctgtaatgaacataggccttcggttttaacagcagcataagcccagaatacttacaccagtcaaggcgtttgattcctttgcatataaaatatcatttaattccgagaagatattcccatctgggaaggtaggatgactccttaaccactgttttaaaagtttggtcagtacatgtgtaagatttcctcattggactggatcctttgttttctctagtcacatgattacagtgtgcaatacgtcttgtaaataattcatcatttttacagtcgtatgtaaagtaaatattattattccatcatcagagttacatgggtgggctctcaagctctctccacaaagcgccctccagcaccataccctcctgctgcctgagctccttggagctagcttttctatactctgtgagctctcaggaccctcccccacataaggaatttacacaatctctatgcttaaaagagattgaccacaagacagcttttcctcccatttcaaaattcctggtattgccattgaatggaggaagcctccagttttctggagagggtcaccagcccggtcaggacgatctttttcttacaaagaaatggcaacttcaaatgtgttgaggctggcatttcagttgcagtgcatagctttgcttcaaagcaaaaggaaaatcacgtttgaagaagcagcctgaaaaaaatgtcacataaactagtaagaatttatccagaaattccattgagcaagaccttcaatgtaggatgccaggtcttcaggccaagtctgtgtcagtacataaataaattatcacaccagttctgttccatgcgtgagagacggaagatcatacaggcagagatttttagaaagcgtggcgccctttgatatactttgaaattcaaatataaaatattgatagaatggaaaggttggacttgcatgcagaaatgactaatttgaaaaaaaaactgcaggttgaaaatgcatacttaggactgagtttgtgataattaacagaaaaaaaaaagccttcccagtgacagctctaattaatagtatctgtaattaaaatcatgcccttccagcaggaaaattgtttgaatttcttggagtgacctttttgctgttcctcctgagggcatggtggttaagttgatattgattttataatgagctccggtttgtttaataagaatctgtaatccagacaataaatgaaatgtgtgcttttcttcaatccagattaataaaaagggaaaaaaactttttttctttaaaaatgtgatctaggaaaatttggaaatgaaatgagtgtaaagactttctggttggtttagctttgaaatcaccacaaaatgccctttagggaagtactttgattaaagtgggggtttgccccatcacggtggattgtttcccggtgagaaagttctaggtgccgaaccattgtgttgttgtgatttgtgttttggcggagcaggacgcagtagtgaggatgggactgtatgattgttcactttgaagttagctgagtaacgtgtcaaggactcagacaattgcggttacaaggaaaggatatttactttggtaaatgaagcaggtattaattcattaacgtatccatatctcacttgggttttctatcacagccatgagtcccctgtgaagtgtaaaaatctgtttgaaaagttttttaaaatattgcaaacataaaacaaatttcaggaaaggtgtcttctcgcattaatgtatttatttctggctcactgaacctgtgtactttgctgattctataatcacagtgaggttgtggatgataactctcatcactgggttacaaggaaaatggaacaatttgatcttatgctttatttcatggggacatgctggaactactcaattcattgtcttaaagcttctgaaaaataaaaagattattgtgcaaggtaggtgagaggtaggtaacctcggagagagagaatggtaggtggcaatatcataagttttattaatatcagaatatgaagttacactttaaacaaaagaacttgtgttcttacctggggaaaggaaggtcaggagcagaggtgttctgatggagtggaggagacgggtgcgtggaggtggtatcctggggggcactggtggcctcagggtgtagagctgcgtcctccctggggttccaaaaggtgaatcctcatgtcctctgttaaacagcagctgggttagtgtcctggcaaggcacttcccgcgtgacctggggggccctcatgttgccaacctctgctaaagcatttgtccgcctcagccctgataatgcacgcacatcattagtgcttgtacagaacccccccgccccgacccctgtgtgtgtgagtcagagcctgggcttgggaccacagggggcccacgttgtgctcctggggagtaagagagcttttcttaaaatagttttgaagcagtaaggagattgaattactagcttctaatgcaaacaccttcaaacatgtttacctgtttttcctcaaaatagaactatttcatggacagggtcaggatgttagagctttcttcatttacatgagtgtgatatttttgtttgccttacctattggaaaagcaaatcttttttgacagactctcatatttttgacacttaccaggatatcaaccccatcagataatccagccaagtttaatttgctcagactggagcaaaaattgggtgtattaactttcagaataactgaaatatattcttaaaggtcatttgtttaacagactactcgcaccaaacttctccccattgttttagtaaatgttgttttttcttctaaatagataaaacatgatatatttggattaattctgtacttcatgatgtaaaaatccaattttattgacttttattcttttttttcaaattggcatagcctgtcatatatgcatatatgtgtgtatatatatatttatacacacatgtacacacacacacactaaggataatgtgaagacatggaagaattgtgatttttggtaccagtatactttatgcattcttttttcatgtaggtgtcctatttctatggaaggtgattgggtaaaaactgtgccaaaaataagttgttagatgattagaagacattctcctccttttctctcggagtctctttgaatgttgcatccatttccttgaggctttgatcatctttgagcagcaagtttagtattctgccagcccactctcccttccccgacatgagggcagagactcctgcagaattttcagcaagttctcttttgatggtttatttcacaatacccagcaggtttccttgtgtacttggaggcctttggaaccaaacccagaggaaagcatgcatccgggccacggggacctcctgtaaacacagcggctaagtgcacgtctcggtcgctgctgctgctcccattagcaagtgattacaaaggcagtgacagtgtggtggcaattgctgcgatctgagggtgctcagttgactggggctggcgtgtctgcaagtcccaaatgcaccctgacttcttacccccggtgcagaaagctgagttctgacaaagagcacaggtcacgccttggttcattctctggggctttaagagaccgttctttctctaggtgagtttaatcttcaggcattggtgtaatcacgagtaatagaagtaggatgttcacaattaaattggaaaacagtgacttttactgaggtttacttgaccccaccagaagtttttaacaaagccttttcaatcagctctgtatcttagaatggctttcctcactatatatttaaatttccaggtcaaaataatatattttttgcaaaactcaaataagcaaaacctatgctgcttcaaaaatgaagggcaccctgtgaaaactgtgccaaatagtttacaagtataaaaatacaacattaaagatcatttgttatgaaataattatgattagagaacattttattgtaaagtcaagcctgaaaatggaaatttttctaattttataatcctttccaaatgtagctgatagtacagatgtctacagtagaattctcttgaaactttcgagacgtggattcggttttgcagattgtccgggaacagactccaggccccgggagggcaaggccgtgcctccctcctcccatactccatggcggcacagaacttccctggactaactaggaatcagcaaatgctaaatggttgtcacgctggtgccaaatcccatggtttctgatgtgaaggaaatcggaaggaaacctgcagaatttagccaggatgatgagggtaaagggtacgtgtcgtccccaatgtgggaagaacctgtttttgtttgcctgtgtgttcagtatagatcatcagtatgtggggtcagccggcttggtttctgcaggctccatggaatcttctagataccttttcaccatgagtctgaacgtttttctggaaagtgcccctttgaagtgcatttttctcataaatctgaagtgttcacagatgcagtttccaaaagcagtgtacatcctgccgttttgcccaaaatgcttcctcagatacagctcctgagagatagagctcgatcttcagagaacaatgaagtctcgaaaggtggccagagaaacctctaaacataaaacagaagcatgctgctcgttggggtacagcaagccactccccccatcagacagtagtcattagatcagacttaattaaaatcacagagaccacgcagtgagatatttggaaataaaaaaaaaattggaaagtctgagacataaaatgtggagggctgaattctgtggcttcattttggcactaggccattcctatgtttgccttgaccttggtagcttttcacacctgggtatgactcgaataactgcttcctaaggaagccacttcctgctacacacaaggaggggcgcaggaaaggaggtgggggctgcaggcttcttccagacgtgctcaccctgcactccagcagccaaggaagagggctgggccccgggaggaggatgggtgctcacacagcaccaggggaggggcggtgtgcgtggtgtctgtggagcgggtgctgcttcccttaggcttgtgttgtgtaccagtccgcctcacacatttctctgccagaaccagagaacacttccttctcgtcaaagccagggtcgctcctggggtgacccctgcatgcacagcaggtccttccgagcccctgttcctaggcaccccctgtcctcatcagtcacccaccccgtggaaagggaccctgtggaaagggacccaggacaccttccccaggcatctcattatctcccaaccctgttttacaagggggcaaagtcagcagcagataaactgagaggcgccccagcccacagggccagtggcagagctgcactgggcggtccccagctgcgctgtccccactgcagggtgttgaggggctggcccgggcttttctgtcccgtgggtctggacagctcctccaccatcttccctcgtagtgtgaggcactgtgggagatttgggaaaaggtgacatcctttcttttctcggttgatgatttcttggagatgaggagtttgcaatgaaagtgaaccggcggtaaacagcattagtccacgcatcactaggaggtgattcgtgtgaaactgaaatcaaatccttggagatgacagaggaggggctgggccaggtggtgggtggagctcttggcggctggcgggagatggaggcgtggctggggcaggtgctggagccatctgcagggtagggacagacccaagagggtgggcatttgcagggctgccaggaggaactgggctagagggaagaggtcctcccagtcaggccaagagtttagacagggagctggggtgtcgtggaaaggactcggctgcaagttgtgtgccggcccagagaggtcagctctttgagttcgtgacaaggacaaaccctgcagtctgtggcgctccaagggacggtccatggctcggtgtggctgagtgaccccaagaggatcagaagaggcacattctgcctgctttcacccccctccgtttcttccttcttatcttattcccctcttgccacacttttcatcttttaactttttctccaatggtgaaattcatggaagaaaggtgccattgcccttccattccctggggtgcgaggcccagcccctccctcccgaaggccgccttcctcatctatgaactggggcctcctcttgggccgccatgcggatgagggcagccctgtgggtgcgggtgccacgtcagctctgaagcgctgcccgagggtgacttgcccggtctgcagcgactgtcagtgcccgcggggctgggatgggtgttggattcctgcctgctcctcccgtttccagggtacccgtttccgcacacttcctcctcggcatgagctgctcccctcccttagacctgattagagaggcgggacacattttctgaactaaaactgaggacatggtgtctgcaaagcatgcacttccagagaagaaaacagaagcaaagccctgaaacctgggctgctctgcagaattcaagacacttgatggaaggtgttcggagaaggcgcccgggtgagccaacacccgggtgagcccctgtgtggtccggggccctggggggtaaggtcaggtcttggtgcaggtgcagcctcgggcatctgtgctctgaacacctcacctcccagcccaaggggcttcagggctcacatcgaggtgagggctcggcaggagggaagccctggtcaggtgggcccagctcagcgggaaccctgctgcccatggcgggaggcaggctctccgaaggacgcgagccgctgtgaaataaagtgggtgttgggaggagacacttgagggagtaaagggaagtgtaaaaaagtggattaaactgggatttcaaaagaaacagtaggcggtggggaggagattccagcaggcgggtaccaggaggtaggagtgggtgtgagcaagaggcaagtcccacccaaggggcgctgtgcttgaaggctgggtctccccactccctgcctgtagcctctgctctcccggctccccttggggccaccgtccctcgggaggagggcatcgttgttggcaaggagaagaagcctcgggtagctcctggagcctcccccacccagaactgtgcagacccccccggcaggaggagctcggcgtgggaggagacgcccggcagggccggaatctccaggtgacagcctcgtgcacacgacagggtgggactccacaggcgtgtacagaggtacctgcgcggggcctcaccttggggccgagggtcctcaggccgttgctgtaaagcagaccttcttctcagcctctgccttgatgggcacgagagagaatgcgcctctgtggtgaatggcattatctgtggtgaaatgcattagcctgtcaaaaatggcaaagcccagctcttaacacaacacgtacaccggcataaaaggaggcaagacgctgcgcggggtggtgggatgaggaatgatggctggagccgccacggcatgcaggagctgggtgttacaagaggagaaagcttcgggaaaagcaattgcacgtcaaaccgaggaggacccagcagatgaaagtcatttccaaatgtcaaacggggatcacttcgaggacgtggataaggaaggctgatctgccggccgcctccagcaggagtccccccaccctcgcctcctggggaggcctccacaggacaagtccctcgccgcctggctgtctcttctctcccaggcccaagtccccttcggcccggagctctccatggctctctgctctgtgagccccgcctcctccttccctcccctgctgtgttgggggttcattttgccatggctgacacgtgggggtccccagagctgtgattggtgttggcccgagggtcacccctaaggattggacaccttgggtctgggtgggcagacagccttggaacctcgggatagctgaacttggagctgacccagaaggcgttttctcagaaagcttatcgcttctaagggtagaatcccatattctggaacaacggggacagcagagaacttgatcttacatcagagtcggcccagtctgcctttgtgaaggactccccagtgtgaacccggaaacagacaacactgtgaccctaggggagccctgggtgccgggtggggcgggcatggggctcagagaacgcggggagccctgggtgccgcgtggggttcagagtacgtgagaacagaacgtgggagaggaagaaaaaggcaacggcagagggggcctctgtggggcgggagaggagcatggaagggcctgagctcagagagagaggggccaggacagagggggcctctgtggggcgggagaggagcatggaagggcctgagctcagagagagaggggccaggatgcacaagggaaatggaggggcttccaggggcagacagctagctactcctctcccattttttcaggtttatgtggacgtgaggtgggcagagtcaggcatttctgcaggtgtctgaacagcggcttttcctgttccatgggggctgcagaatagtgctcccttcttcatccagccagctgttctgaaactttgttgctcaaaatgtaacgtctccgtggcttttctgctttgggagaattactgatggttaagaatgaaatcttgggactggcacaggggctcacctgtaatcccagcactttgggaggccgaggcaggcagatcacctgaggtcaggagtttgagaccagcctggccaacatggcgaaaccccgtctctattaaaaatacaaaaattagccaggtgtggtggcgtgcacgtgtcatcccagctactcgggaggctgaggcaggaaaattgcttgaacctgggaggcagacgttgcggtgagccgaaatcaaaacttcatctcaaaaaaaaaggatggaacctgggtatgttatttctctattagcaagtacaagagactcactagaaaggtggcaggtgtgaacaagcaccctttcaagattttttaatgtacaggataataatgcagccccagaattgagtgtctgggtctgtgctagtgtgcgcctccaggtacagtgacttgaagaacagatgggaagattcgcagacgattacattagccagtaaagctacatgttttaaaatacataattcactacagagtttgtggaatgtggatttgatatacaggtttaaacttggattgatcttatgccatttaatagctaatcaattaaaagagtttacaagtgataagtgctgggactattctcacattgatgtataactggactgagtgcctctgaggagagcggaagctggatttgccctctgggtaggcgtttcgtcgctttcagcttttttggtgaagacgatgatgcaggagagtggacaataacgcaatcttcctggaatggcctttcccgacctggaatcacctttcctggcctgtaaaacgcaccctgaaaccagagatcggatgttcctgagtgggaggaaatacaatgcagatttttttgcaaaacaaaatactaaattggatggaaactggagctggtgtgtgagtttcagaattatttctgtccccatcccagggatttcttattctctaccagattcaaggagaacaaatatacaaattgttaagtgagccccaaacgtgaagctgaaatgtgaaggggaaagtctagaaaacgtgtctgattcttctgagggtggatttccaggctccccttcctcgccccgggcatgcgtctgtcttgctcaggccttcccgttcccagtgggcccctcgcttctccagggggtgttttcagacacatcttgagatttcaaatcaaccccaagtgaggcggcagagctgacaccccacgtgcgacccgtggcccctgcaccccagtcagcggtgtcctcgggccggctgctcccagcaccctctgcaaagttcactccccaaaaaccctcacactccctccacgactcgctcacgggttttcctccagggctgctgccccacccgtccccttcttggggtacagcgtagacttttagaaactccccgtacagaccttagggctcagcacccttcggtcagagctgagacctctgagaccgggattcccagcaggcccccagaccctggccttcgggggtctggtaggaagaagctcttcagggcgtccttcaggccttgtgcagttcaggtgtcactcagatcagttttaggtagaataattgggccccagaacgacgtgcagttccgaaaatggagaagcagctgctccagtagccgctccgcccccagcccgcatgcccctgcccttcctttggcttaattaagctgtggtggccaccgaatggaaggatgtgaataccttttgtgtccctgggctgggctcctctgcttctgagcctttgtttgcccggctccctccgttgcaccgccccccctcccactttatccctgcagaccctcccatctgtccagccctgtgcagaccccagtcccctgagcttccatctcagcccggggtggcccgtcccatcccgaacaccagggccctattcatccctacctcccctttatcccttctgccgcctctgcggtgacgtctcgtcaccatccctccagtgtagggtgacttcctcattgtgttggatggaggcaggcctgggtgcagagcgggccttgttgcccacaccagaccagcccgtgtggggacagccttggcttcccaaaggccaggtctgtccaatagacccacagcacccaccggggacctttacatgctcgataagaatgaatcgatacattgaactaagatcttgatgtggtaagagcaggtctgtgggcagggggcggggggcgggggagcatgtaaaccctcttggaaaccatcctgtgcaattctcaggtccagagtcctgcccgcccatggggagtcctccctacgcgctgcaggctgaagatgcgggtgatgacagggatggcacatgaaaatcagcccttattctgagcaaaaagaaaattaggaaggtgcaaaagtttcttgtaaaaaaaacagctgcccgttctctacttccacgtcaggcctgggctgctctgaaggcggatgacttgtttcttactgactggctattttaaattgtctgactatgaaactgaaaagcaaggttcagcctgtggggcctctcaaggctggctttgctcacagaggtcgtgttggatctgtgaactttgaaggcaccactgacttttttggaagcccttagaacttaattgcccggtgagtcatcctccgtgggagccgggaagggagggatttgtctcaccaacggcagtctggctggaggggctttgctgcggtgtgactggggtctcccatgacaacgggaagggttgcaggcatcgtgggttaaaggtgctccctctcacatctaagatgccacctttatggaagcattaaagaccatcacagaagccggtcttagacatgggctgttccagagagaagatgctcattaaaattctgtgtttccttccaatgtctttattttcacaactgtttcctggtttcaatctgacgttatcaggagcagagcaaatgaagaaaatgaatgtctttagtcttaggggagaggcagtccctaagaaaaagggaggcaggaggtcgggtttcagcacgtcggtcactctcggatgcagctgaccgcgggtcccgtgagcccgtacgtgccttctgtgcttcacgtggagcacctgcgtttcccagccacccaccaggggcttcaggagattcaaacacagccctcacctccccagagcaggaagccgcagctgtcggccggcgggggctcgatgcagctgctccagccgtgccccttgctgctcccccagggctgccttggtgtgggacactcggtccctgagcgagccgtgatctggaggccagggatgctgaccagtgtgcaggggctcagcgagggcccctctgcaccacgtagatgctgtgggtacagaaagcagacagaaggacttctgctcttgagtgtgggaggcaggggtatggacgtgaaaataactaggaaacagcacacgcctggatgcccggagcccggccgcgaggttgtgtggggactcgagaaagggctggtgctctgggcgccgcagggatgggggctgagcgagcggagaggccgcttttttcctactgatcttaggctgttccaagactgttccacatttagaagagtgttgaaaattatttttcacttacatgaaacatgtctatatctttaatttttgttttgagaaaacatcttgcgaaatgggaagaactcactccatattgcttggccaacatcgctcatcgtgggctgactcggcttgtttgcccgtgcgtggaaccccttcctgcaggagctgtgcttacagcccctgactgggtgtcgtcgtgtgtcaggagcggggaggggcctgcagagctctgtggccctggcttgggcgctgctgtcaggggcatcctcccctgggtgtgtgtgtgtgtgcgcgtgcaaacacgtgtgtgggttgttcttggtccaagtgtaaaagttacctggacaccaaggagaagccactggaggcggtgggactgtgtcaccagagcagcgttggccacgtgggccatgagccgaggacgtccccggcttagatcacggacaggctcggctgccggggccctgactccgtggcagaagaagggaggctcccctggcattcaggggcggccgtgggccatttgctctccagaagtgagcgtggccctgtgttccctgaggtctcacagggctgccccagatgcacccagaccccggagcaccttgtagcggtgccgatcagagacctagcatggtggagtgtttgtgtaaagtcgctctcctcaacgaaatcattggttactgctcctctgctcccagctggccttgctggcctagcatgtgaggcggttccttctgagtccctctgagttttatgatgaaataaaatcaagtaaaactgtgtcatgatcggggagaggtgattatacaagaaacctttttttctttttttccccactatgacacatgaccccgtttaacaacctggaatatttttccccggccttttccctgcacacgctttctcaacatttcaccttcctgtttagatttcctgtcgtcacgtgccctgcagcctcagtgtcaaactgacagagcgcaggctttttccttaaccgttttacattcgagccacctgtggttgcaccgggccccgcggcttctgctgtgtgttgccctctgagctgaaggccagggccctccccaaacagagccggttcccgttcaccacgttctcttggtgccacgtccagtctggagagtggcctttattcctccccagcagagcccagtgaacccactttttcctgcccagctttgtacgtttaattccttagtgttgtcctgttactagtgattacactctcgaaataaccctaaaaacccaaggctctctgtgcgcacactcgggcaacacggcttcattcagttggctcccggaagcgtgcagagaggttttcctgaaacctttgttgtcctggtcttcttttggcagaattcaagaatgacaggtctcttctctgagtgatttccactctgtaattttctccatcagatgctgagttaagagatgagacatttgccttgtgatgtgtatggatgaatttctgcccccagaatcctcttcagcttattttgcacattgtgttatagagaagtataagatactttgaggactctgcggacacgcccagggccccggcctgggcacagcagaggagcaggcggctctacggcgagcgaggactgtggtgtccgaatgtgccgtgctgaccatggcctcctctgtttgtgtgctcacacctgaggagctgctcagagcacgggaagctttcagggtgggggctctgggtgcagcactgtcctgcggggatggtcccacgtgactctgcccagggcagggtgctggtgtgggcgcttgcagtgccactgggctcacactcacagttccagttggctctggatgtgttggaggcagcaccgagctgcaaaaagatcaatttttcacatttccctgatggagagtttctgcgcctgggtgcggacgcgctgggtttaccgttcctgacaaacgctgccccgtggggagggtgttaggtcgtgaggcactagcatcacattgagttttgcggtggagcatttccatttagggcaacagtggaagacgccaccatcttctttaaaaatgcctagttactctagttttactgagagggaggaggcagggagagggtctcatcagcaggacagagtggccagagggtcatccagtgcggacagccctgggggtctggcctccttggtattgtgtcctggaaggaggccctgccagaggcccccagctcccgtgaggctgtgtggcttctctgtgcccaaatgtagatgcgggcactggcagggggatgcccacacccgtgtaagatcagtgtcccacgggccgagtgtgcaagtcaggctgtgtactcgttgcacccacctgagatcagtgtcccacgggccgagtgtgcaagccaggctgtgtactcgttgcacccacctgagatcagtgtcccacgggccgagtgtgcaagccaggctgtgtactcattgcacacaccagagatcagtgtcccacaggctgagcgtgcaagccaggctgtgtactcattgcacccaccagagatcagtgtcccacaggctgagtgtgcaagccagggctcgtactcatcacacccacctgagatcagtgccgcatgggccaagtgtgcaagtcaggctgtgtacttgttgcacccacctgagatcagtgtcacacgggccgagtctgcaagccaggccttgtactctgtgctccacacacatccaccctcagagtcctcccaacaactctgtggagctgctctgccttcatccccatttcacagattaaaaacacacacgcagcttttggcagcctgtccagtggcacacagccccgggtgatctggacccagagtcctggtcctcagcctctgccttacacggccacaccgtgcagatctcagctctgtcttggcttgctttttttgccaataatggatttcattttctactgtggggttttttttttttctaacacactaatggctctggaatactttcttctcaagaatagaggcacattataatcattgatattttactatggagatgacctgcaaaaccgtgccctttttccattattgcaaatgcgtccttctcactgggaatttgacatgctatccttaataattttcttaataactttctcaacacctaagaggggccagacagctaaaaagctacagagcagctatactgagacgcagggaccttcagagctttccggaaagatgtgagctccatctccagggacaggcattccaaaaatgcaaggcagcatggcacaaaaataaatgacttcccctttgtacctggaattttttttcttttttttttttaattatactttaagttctagggtacatgtgcacaacgtgcaggtttgttacatatgtatacatgtgccatgttggattgctgcacccaccaactcgtcatttacattaggtatttctcctaatgctatccctccccctggcccccagcccctgacaggctgtggtgtgtgatggtccccgccttgtgtccaagtgttctcattgttcacttcccaccgatgagtgagaacatgtggtgtttgattttctgtctttgtgatattttgctgagaatgatggtttccagcttcatccatgtccctgcaaagaacatgaactcatccttttttatggctgcatagtattccatggtgtatatgtgccacattttcttaatccagtctatcattgatggacatttgggttggttccaagtctttactattgtgaatagtgccacaataaacatatgtgtgcatgtgtccttatggtagcatgatttatagtccttttcttagttcacatatatattgttttttcttcgctgctaaagagtatgaattgggaagagaaaagaaaacaggtttcatccacaccctggtgggagtggccccgtgggtgccttcagggccaggcaggcccatgcccagccctcagtgggatggagcctccgtccagctcctcagagtggggagggaattcacgagtgccgccgacatcgcagctaaatctacaatcaaaagagttatgtggttacatctacctttcttcttcattcatatttaattacctgttggttattgagtcacgcaaatgccacaaggtcttactcgtccttacaaactcaaggtcgccaagctgcacacactgggccgctgtggctgaaggtgcattgtcgcggatcataaacagagccatcttcgtgattgttaggctgagtctggatcttaaatagaagattttcctttaagtgaagtggctggaaggattggaccttctgtccggccaagatctgtttgccaaaaatgtgtcagtgcccccaggccaggctgtgcaggggaggcccttgggcccctgcaagcaggcgctgtggaggggcaggtctcggggcttcctgcttggcaccactgccggttaaccccttcagcaggctcgtgtggcccacaggcctcgctctggggtgttcaccatctgaccaggagagttttgttccgggtgaggatgcaccctttgtgtttaccgaggattataaatcagggaaatttcaaaacatgatggggctggcctccagctttctctcagaggaggctcatgttgttgattttgctttataaattatcttttgctcaaataaaatgctctcgagatcatagctctgtatttttggcgggtgtaggcggacagggtcttgctctgtcaccagggttggagtgcattggtgcaatcatagctcactgcagcctcatcctcctgggctcaagtgatcctcccacctcggcctctcaagtagctgggagtacaggtgcacgccaccacacctagctaattatttttttggagatggggtctcactatgttgcccaggctggtctcaaactcctgggctcaagggatcctcccacctacttcccaaagtgctgggattacaggcgtgagccaccacgcccgactaccgttctgtattttaaactcaccacacagaatggtacttagagtattcgtagtggcgatggccatttctgtcactggctgacaggagcccccgctctgtgccctgggcccccacagaagtctgataatgaacgcaggtgatacgggcagcggctgctctcgtctgatggcagttctggtgtgatggcagctgatgctgtaaccttcaactgaggttttaaagaagtatgtgtgccacgctgtccattcagtcatcgcctcagcggtcagcaagctcacgcctccgttcagcaccgtggatgcgactgccttttcaggtgtggatgctacttttcaatgaagagtgaggagtgtggccccctcccccgctgtagccagtcactttctagtcttgggaggggaaaaacagctcccagtggcatctccagtgagcccacactggcagccttgcttagagggttagagtcacctcatgcagggtggaaatgtcccaaattataacctagagcgatttcaaatgctgtgaggtttgtctcgttggcactggctaaaccattactaagtcaagtagcgttctacatttcttattccattctagtaagaagtgtgtttttccttacaaaatttttaaatgttaaggtaaaggactgagaatggacagactatagaatttccattatgaatttggaaactataatcagcctaaaggaccagtgaatgagaccacatgagatgcccctcagtgctttctccagcaagccatgaggcagaatccaggctccttcctggcttcccccacgtctggagattcccaagagtgtccagggaagggtggagagggaggggccggtccccactgtgaggagctctggcaggtggcccagaaaggggccacacagcaaggggaagggacgctggcaggggcaggccacagtgagtgggagaggcagcggccaaacgtcccagcccccgtccttggagggagctggcccgaccccgttccccgtgagcgcagcagactggcgcatttccagctcacttgtgaggaatttctgtttctgtctccagtagatagatgtggctttcttgtgtttatcgccaagggagacaccaggagttgggcctgcagccacgtcttcccgggggcacgtgcaggacggccgacagccagtgccgctgggactccagggtttaacttgtcagtgtgatgtcatcacggtttccacgcgcacagcccttgctcggtgacctcctcgcgggcctggtgcgctgttcgccccttgccacccctgccgtacctgcagggagtcgccgatgcccggggaacttcttcccagcctgggttatggccgggggtggagctcgggctgcagaaagtggcttcgcggccaagcagaatgtggcaaaagcaatgctttgtggatgtcctgagatacggcgtgaggcaggacactcttcagttggtcccatgacagccacactgacttagcaacagctgggttgaatgaggtgtgaacttctgactgaaccgtgctgcgtgaacgtggctgagccgtgaggttaggtgggcggtggatgcaaggccttcccttcagaccctgcatgcacaagaagcacacggtcggcaatgttacttcaagcttgtagacatcgggtacatcccatgtccaaaaagaaggctcgccctggaaaagcacattccgaaagcagtcgcggcatggatgcagagcgctgtgcccgcagcactgcccacccaggaggctgtagggagtggcggccccttctctctcctcctcctccttcctcgccccgtggaagctcttacgcacctccaggccccatgcctgctcacacctccccatctctgcaggtgccattgcggcctagccttggggcctgagcctctcctgcctaaagctttctttgacctcaagttcagggagggtcccctcctcccggccccacggcaccccttcccacgaacgcccaacacgtgctgttgctgtcattcccatcgcttcttgcggtcactcgtgcccagctctgggtggcgtgggagtgctcgggggtcagggcccggcgagtctgacccagcctggctcagcctggtgttcctggcaccctgtgcagtgctgactcggcaagggaccatagcaaacctgattttgaataaactaataatcatcgtagtaggaacagcaaataatcacctggtgtgtgtcaggcacaggcccaaagcctcactctaagcatgttatcttatttaatcctcccagcggtgaagtcggtaccattatcaccacttcacagatggggaaactgaggcacacagagattagtgttttcccaaggccacacagtcagtaagacctgaagcccagattcaaaatcaggccctctgactgcaggtgctatgagtgaatgagtcaatgactgccctggacgtcaaggaaaagaaccaaagttaggtctgtttttgcagttctcatcctgctcctctgaagacatacctgttttctgggtcctggtttctaggaggcgtccatggtggccccgttgcctctgtctcagggcagctttgtggaggtgcagagactctcctaagtggcaggttcccccagagccttcagaaaagcctgcgctggtgatgtgagggaaacatggctggtgcctccggggagccacgtcctgcccatcgtagtgtccagggaagtaggacgcgtctctcacctgcccccaggctcaggggcagcatggggggcttcagccccagacacctcctccacccaggacccggcttccccaccatcccgttcctccctgcaggccattcctggccttatcactgccaacctcctccacccaggacccggcttccccatcatcccattcctccctgcaggccattcccggccttatcgctgctcagatgtttgcctgagccacttgctgaatagaaacttggtagcggtgggttcagagcggagcagcgccgggctagagcacccgcccccgttcccaggcggaagcccgcagggagagcgccttcgggcaagagcagcgtccccggccgcgcgttgccttgctgtgggcacacccttctcccacggcagcgtctccctctgcacaggcgaagagctgccgccacgggtctccagcattctgcgccaagctttcgggggcttcctctctgccagggacatttttcttggatctttatcgcagtttccctcctttgaaaaagttaagaccttcaagaagaccctgcgctgcgcagtgacgcgagaccactggtgagagccgcgggtccccgctgagcggcaccgaaccctgggtctccctcaccgtgcaccagcactgagccactgggcactgagccacccgccggaggaggcgatgtcggcttgtccagctctaaattctgcgactttggcccggtgcagtggctcacgcctgtaatcccaacactttgcgaggccaaggcgggtggatcacctaaggtcaggagttcaagatcagcctggccaacgtggtgaagcccgtctctactaaaaatacaaaaattagctgggtgtggtggtgcacgcctataattccagctactcgggaggctgaggcagcagaatcgcttgaacccgggaggcggaggctgcagtgagctgagattacaccactgcactccagcctgggcgacagagcgagactctgtctcataataatagtaataataaattctgtaacttcttcagaaatatctttacatttgccaagccgtcaagagtttggctctggcttagagaacggccctaacttctattcactaatacgtctctcttactcatgaatgcttgaggctttctctgtagctgcctccatgctaagcactgaatatacaggaaaccatctattttaatcttcacagtaactataggattatctccatttataaagtgaaaaaataggcttagagacctttagaggttttcccaagttcacatgaaaagtttgtggttgtttgctattggtgactttgggagaaaaataaatacaataaaaacggaagtttgtggtgcagcagggacctcagtcctgtggggcctcttggtggcttcaccctccatggcactcaggaaataacagagctcagacctcactgtagctctcccatgggtggcaaatcacaggatgggcatggaactagcttgattttttatttttatgtgagtaaatctccagcgtttcaaatcctcttccccagagggtcacattctcggaccctctgggttccctgagctgtagctgttctcatgctttggttggacgttatttttctggagaaattgtgtgaagagatagaagttacttcagaaacatttctcagtgtgcttttcccccacgtcaagcaaaattcatgtgcacaattgagaaataaatgagatgtatactcaggttggttactggtatcatctaccttattaaaatcatccctcattgggtggatcacctcaggtcaggagttcgagaccagcctggccaatatggtgaaaccctgtctctactaaaaatagaaaaattagccgggcgtggtggcaggcgcctgtaatcccagctaatcaggggagtgaggcaggagaatcgtttgaacccaggaggtggaggctgcagtgagccgagatcgtgcctctccactccagcctgggagacagagtgaggctccatatcaaaaataaaaataaaaataaaaaataaagaattatcctttgtggggttttttttgtttgtttattttgctttgtttttgagattctgagaaaacgtgggtggatttttttaaacacactcactattttaaaactgtctataaactaacaagtacctgaagatgtatgggaaagaaggaactggaactctcccttttcttagagaccccttaccctcaccagaggcccttggtaaagtccaccttcccctgtgcgtctctgcccggtccccatagtcatcccccccgccccccccatccctgtgaccatcctcccacccctgtccctgcggctatccacctcccgcccagtccccccagccatcccccccatccccgcggccgtcccccccttccccacagtcgtccccccccatccccgcagtcgtccccccccagtccccggggtcatccccccccgtccccgcagtcatcctcccagtccccgcggtcatcctccttgtccccagctgctctcacaggggctgcaggctcctggagagtgggggccgcagggccccttcccacagcacctgtatctcgctatgagtccgaagcagagagcccgggagcatgaattgctcatcccagagagccaggtggagggaaatgttttctagatggtgtggtgccggtgggcttggcagacatctttaaagccaaggaagccggcagcccggggtgaagggagaatggacacaaggaagccggcaccccggggtgaagggagaagggacacatggagtgtttcctgagctttggcgattgccttggggagtgcaaggcctttgacgcacacggctgtggggagcgagtgggtggcttggcctcccccggacaccaccaaaatgaaaccaaggcagcagcagcccacgaggttccccggagcctttctttttctcacgaatgcattttcacctcttctgttgagctccagttctcttataaactttttctgggtatcatttcattttgcagactcagggtacaggtatattttcatcaggcaataggacgggctatcctaacacagtggttagaacactttcaaaacgagattgttggtcagacgtcaggggggcacccaggctgcaccctgaaggtgagcggcagcagcggggtcccggcgtgttctgagcacctgaggctgcgtggccgtgtcctgcctgcaggcgggtcccatacggccgggcaggtgctcgggatgcccaccgcgtgtgtggttgagctttgcctggggaaggagggtcgaagaccctgcagtgatccctcagaagctgtcttggggtgtaatgttgagagtttcctttaaatacgggaacttctgctttggtgtctactcagcagcacaggcctttctccctcccctgtgccttctgtctcccgcacggctccatttgccttctcttgcatgggctcttggacattgctttggaaagagaaagaaacgtcagaatgaggttcttcttttttctgcagactctttgattgtggtaccagtttctgtatctcagtccacagtgcaaaccgcccccggcctcccctgtggcttatattctgatagaatgagaagccacccaacgaaggctactgtggcgttatcccagaatattccacgttgatgacagaggaggatccagtggatgctttcttgaatctataggagtgagtgtttgtggcgtgtgcagtgtgtgtgtgtctgtgatgtgtgtatgtgtgtgtggtgtgtgtgtctgtgacgtgtgtgtggtgtgtgtgtgtctgttacatatgtgtgtggtgtgtgtgtgtggtgtgtctgcgatgtgtgtggtgtgtgtgtgtctgtgatgtgtgtggtgtgtgtgtgtggtgtgtgtgtatatgtgtgatgtgtgtggtgtgtgtggtgtatgtgtgtgtatatgtgtgatgtgtgtggtgtgtgtggcgtttgtgtgtgtatatgtgtgatgtgtgtggtgtgtgtggtgtatgtgtgtgtatatgtgtgatgtgtgtggtgtgtgtgtggggtgtatgtgtgtgtatatgtgtgatgtgtgtggtgtgtgtgtggggtgtatgtgtgtgtatatgtgtgatgtgtgtggtgtgtgtgtgtatatgtgtgatgtgtgtggtgtgtgtgtggtgtatgtgtgtgtatatgtgtgatgtgtgtggtgtgtgtgtggtgtgtgtgtatatgtgtgatgtgtgtggtttgtgtggtgtatgtgtgtgtatatgtgatgtgtgtggtgtgtgtggtgtatgtgtgtgtatatgtgtgatgtgtgtggtgtgtgtgtgtggcgtatgtgtgtgtatatgtgtgatgtgtgtggtgtgtgtgtggcgtttgtgtgtgtatatgtgtgatgtgtgtggtgtgtgtggtgtatgtgtgtgtatatgtgtgatgtgtgtggtgtgtgtgtgtatatgtgtgatgtgtgtggtgtgtgtgtggtgtatgtgtgtgtatatgtgtgatgtgtgtggtgtgtgtgtgtggcgtatgtgtgtgtatatgtgtgatgtgtgtggtgtgtgtgtggcatatgtgtgtgtatatgtgatgtgtgtggtgtgtgtgtgtggcgtatgtgtgtgtatatgtgtgatgtgtgtggtgtgtgtgtgtggcgtatgtgtgtgtatatgtgtgacgtgtgtggtgtgtgtggtgtatgtgtgtgtatatgtgtgatgtgtgtggtgtgtgtgtggcgtatgtgtgtgtatatgtgtgatgtgtgtggtgtgtgtggtgtatgtgtgtgtatatgtgtgatgtgtgtggtgtgtgtgtgtggcgtgtgtgtgtgtatatgtgtgatgtgtgtggtgtgtgtggtgtatgtgtgtatatatgtgtgatgtgtgtgtgtgtgtggtgtgtgtgtgtatatgtgtgtgtgtatgtgtgtttgtattctcagattctgagagcaaggcctctcttttcctgcacaagcctgaagtcttctcgggtcaccgtgctgggcgcgtgctttggggtgcgttgaccgtcatgttgcgctggcctgccctggggtaaactctcgcctgcctgaaccttggatcttagcaggagaaggggttgtgccacgtgggtgccgtggccctcgtcctgctgggtgtccccaatgccactaaccccctgctcttcctccccctgtcctgcaggagctgtgccgccagcgtatgccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctggtaagcccagtctttgcactccctgccacacaaacaccagggccctccttcctcggcccctgcaacacccagcatctgcgcccgctgaccctcggggactgggcgatgatggctgcaccctgcccgctgcagaggctgacaggcagggctctttctgcagggagtcttcttaatttagataaacaagaatatttacttcctgagatctttgccgtgcttctgcctggaacgtgcagcccccacacacagtccctggtgtgtaagagtgagcaccggccgggcgccgctgacgcctgtaatcccagcactttgggaggccgaggcgggcggatcacgaggtcagaagatcgagaccatcccggctaaaacgctatttagttttcagtggaatacacgtctgttagtgcctaccatgtgcgctgccgttttgggcctctgactcggaagcagctgctgtctccttggcactcaaggccagcaagcgtcatttgggtaaataaatgtcactgctgtgacagcaannnnnnnnnnnnnnnnnnnncagctacttgggaggctgaggcaggagaatggcgtgaacccgggtaggcggagcttgcagtgagccgagatcgcgccactgcactccagcctgggcgacagagcgagactccgtctcaaaaaaaaaaaaaaaaaaaacaaagagtgagcacccgctatttagttttcagtggaatacacgtctgttagtgcctaccatgtgcgctgccgttttgggcctctgactcggaagcagctgctgtctccttggcactcaaggccagcaagcgtcatttgggtaaataaatgtcactgctgtgacagcaaggcaggaggaggtgtgggctgggtgctcggctcttcacaggagccttcctggtggcgccggccagaggctcacggcgacgcggcttcagcggccttttccagggtcctcgctggagtgatcacgcgtgtgtggccgtgcattgccactccatacataatgaatgtccgggtgttattaggacagctgtcaatagcgcagcacgtcctgctggctgcctcctggatctccaggccgtaggcgtcgtcctggtgggtgaccgtgcctggctgtgctgtttcccgcactggagacggagcctctggggtgaaagggcagagcctgttacgctgcttggccgaagcagcggctgcacttacgggtcagggaaacattcttcgccgtacca[450 bp omitted]acccgggagcaggcagctcgtggagttcactcggcagacctgtcatcgactttggcagaacctcctcccttgatggactgtggttttgttactttagatctgacttttctgaggctgttttgacatttgtcccttttagaaaaggagcagagaccaggagttcatatttgtgatgagatttggtattagggccaaacccatcagccaaagacattcatctgacaggtcagccaagaggagagccgcttagcgagctctcattgtgttctgatatttccacatttcaaggtgcttgagtaacaatttgatgatatctcaagctctattggtacctggaaatactgtatttctcagagaattgtgtttggcattcacatatgtaatggcagctctgacagcaagcaccacttctgctggaatgcctaaaccgcaaggacagactcagcctccacctggcggaaaccctgcaaagcctgactccagacaccctgttggggggtcatcgagggccacacaccgtgacggggtcctgtttcggaacgcgtctcaccaccgcccacaactgcagggccgaaacgagaaacacactcaggccaagtatgagtccggctgacttagactctgtgcgtacagattgtaaactcagggaaactggatcttcctcatcaaccaatgctgttttgaaaatgaatgttactgagatatttccctgactccacgatgccagcaggtgctggtgggagtcagggtgggtgtggggagcggcgggcacagtgtggagttggggagggtgtggggagcggcgggcatggtgtggaattggggtgggtgtggggagtggtgggcatcgtgcggagtcggggtgggagtgggaagcggcaggcgtcgtgtggagttggggtgggtgtggggagaggtgggcatcgtgcggagtcggggtgggtgtggggagtggcgggcagtgtggagttggggtgggtgtggggagcggcgggcatggtgtggagtcggggtgggtgtggggagcggcgggcatcgtgtggagttggggtgggtgtggggagaggcgggcgtcgtgtggagtcggggtgggtgtggggagcggcgggcatggtgtggagtcggggtgggtgtggggagcagcgggcatcgtgtgcagttggggtgggtgtggggagagacgggcgtcatgtggagttggggtgggtgtggggatcagcgggcatcgtgtggagtcggggtgggtgtggggagtggcgggcgtcgtgtgcagttggggtgggtgtggggagcagcgggcatcgtgtggagtccagcaaccaagtgggccaggcgtgggccttggaccctggcgtctcctctcactcagcagttctgattttccttcctctgagctcactttacaagtgcattcccgtgccctctcagccatgcggggtctcctggtgggcatgtccctggtacaggagcagagaggcacagactcacgccacaggtgagctccaggtagacctcttcccaggactcacacaggtagccttttaggctcggaagctacagccaatctcggggcactgaccgccaccctccctggcacacacaggctgtagaaagcacatgcaggttggtgccgcaggaacgcatcagagtcgccgaccttccgactcatcacagctacaaggcagccaattccgtggtgatccagcagcccagccctctgtgcgcaaagcctcgtttccgccagacacccaaccggccacctcactgcccctcacctgaggatggcaggacggtcagataagccacagagattcccagcgacatgttcctgacatgcagccactcctggggcacgttggacaaaacgtggcatctgaaccccacgatccgatgaaataaacagcagaggttggtgatgtctggaggccaagctagatgtgaggagccccagcaggtgggagaggccggctgcaccgtctggggggcaggctcagcaccaagagcggagactttctgtgacaaaggacacatgtgggagggtggaggctgcacactgccccggagcccagaccttcaggcggggctggcctggctgtggccccacaggaagggcctcctggccccgagagccccctcccgccctgggacactctacccactggagctcacgctgctgctttctgcacagaggctgggattccgtgctggagacccggagtaacagaactctagaaatgagcactccatctagagaggggagcatacaacactcttataaaggagacaggccagggtgtgagagaaggaggcttccctgggagacaggaggcggcaggtgcctgccccgatggggggatccatggggctgtgcagccactgggtgtcaccaggaagaggctggtgtctcaggactgcagggagggacttagttacctggtcaaggtgtcccagcaggtggaacaagagggagagcacacgtctcagggacccccggggaaggggccacatgaaagcctgatgggaaggggcaggggtgggcaggtcattggggcagccgctgggtcccccgctctgccatgacagcaggtggtcaggtctagatgtggagcacagattctgggctccatcagcaaggtgtcagagctgagacgctttgctgttgcaggtgctgtgtcccaggacagacctccaaccttcttctcccctgtgagacgggcttgatggcagtgcctttcccctggggttcctgtgagggtaaaaccgggtgagcatctgagatgccgcccatcctgaggcctcacctgtgccgcaggtgcgtcgggctggagaggaaggggttgtgctgaaggaacagagcccggcggggcctttgcttggtagggtttgggcctctgggcctgcattctctacactctgcctgatccctgtctctgggctttgattctggtttttgtgttgctttgccttcattttcttagaaaggtcctttaaaaattccagttttcttctgggatgaactaaggagaaagggctttatttgcagggaaaacccagcccagaatgtcacttgttcctggaaaatgggcctcccaggcgcagggaaggtgcagtccgtgcccctgccttggactgtctggaagaagctgagtcgaggctcacctgcgggtgaatggagcactcagaggagggagaggcaggaaggaaacacttccatcaagaaaccggtacatttctctggaaacggccgaaaggcaacacggagatgctcactcagagcaaggctcgggactctgaaaagcaaggacgtgatgaaggcgacttcgcaggacggttatcaaagcggctgcgtgttaatcatctgcggggacgtggcttctcaagaaatcctgtcacatccttttgtaagataaagaatcatcgagttttttcaagatctgtttccctatcactttgctttcagaagggtgacatttctgcctggctggctctgagtgaggaggtggagaagagtgtcaccgtcccgatgtgactaattacgcctgagtcggccgggagccaccgcgtccacctttaaaggctagagaacgttttttggagagtggggatgttaagaaaaaagttggcttcatacttctccattcgacttaaataatatagaacttaacttgggaaagccgtgctgagtaagtgcttttcagaatccatcctcttgagtgttgaagatgaggatatggacagtgatctttgagttcgctcatccttggagagtcctgaggcactgagggcacaggagctgtgagtaggcccatttcacagatgacgacattaaaaccaagcgcagtgacagagacgtgaaaaacgaaaagttaggcattgcaggaagtgaccaaagatttcccatgatcacagaaaacaggaaagttcatgaattttgctgaggagggagggggtgctgccagcctgtggagtcgcgccgcaccttccgcagatttgcctgtggggtttctgaactcccagcgtgagacgcgtgatgcgtgtctgtgctggcgaccaacagatgccggcacaagctgtgacctcctcagacccacacggctcacggcctctgaacttcggccctcctgcctgcctggagtcttccctgggcccgtcgtgtctctgcctgtgcaccttgagagatctctgtctctcattgtttgatcttgtcaggctccaggcttcttagttcttagcgataagtcaccgaaccaggagggcctcgcgaaaccatgccagatgtccctgcccaaggctgcaagtcaccagctgcagcagaaaggggctggggtcccctgcaccccacgccaccagtgccggggccttggcaggcgctcccctggccccagtccctccaccttcagacccagtgccctgtatttctggaagattccattccatcgttcccacgtggttgacgggcacagatggctgctctcccaggatgaggggcactgggccaccgagaatttcactctggggccacgcggctgggctggccgttctcgctctggctcgggtgctggcgcggaggcctgatgagtaaaccaggccgcagggcgaactctccagctttgtggggcctgcgttcacagacacggcaggccgttgctgctgtctggacgatgccggctttgtggcgcacatttggaggagcctatttttgcaggaaagctgtttctcaccattgaggactgcgtggcataggcaaggcctgcacatggaggggtacatagtccccccttcccagcacggcgggtgggggtgtgccctgccctgatggggagcccctgcgggggatgtctctctccggcgggcaggtttgggaagccttcacgccacacaggaccaggcacggagccccatgaccagagacggcattaaaccagcagggaaggggaaagctggggcaagaggcagagccaggagaggaggagcgtccaggtgccatagtagccggctctggagaccccgagacttcccagcctcactcctgcgggcctggggagctcctttgagagccatttacgcgtccaccgagttcagtgcacagtgaatgggtccgacccaccgagttcagtgcacgctggatgggtccaacccaccgagttcagtgcacactggatgggtccgacccaccgagttcagtgcacgctggatgggtccgacccaccgagttcagtgcaccctgggtgggtccaacccaccgagttcagtgcacagtgaatgggtccgacccaccgagttcagtgcacgctggatgggtccgacccaccaagttcagtgcacactggatgggtctgacccaccgagttcagtgcacagtgaatgggtccgacccaccgagttcagtgcacagtgaatgggtccgacccaccgagttcagtgcacgctggatgggtccgacccaccgagttcagtgcacagtgaatggatcggacccaccgagttcagtgcacagtgaatgggtccgacccaccgagttcagtgcacgctggatgggtccgacccaccgagttcagtgcacagtgaatgggtccgacccaccgagttcagtgcacagtggatgggtccgacccaccgagttcagtgcacgctagatgggtctgacccaccgagttcagtgcacagtgaaagggtctgacccaccgagttcagtgcacgctggatgggtccgacccaccgagttcagtgcacgctggatgggtctgacccactgagttcagtgcacagtgaatgggtccgacccaccaagttcagtgcacgctggatgggtccgacccaccgagttcagtgcacagtgaatgggtccaacccaccgagttcagtgcacgctggatgggtctgacccaccgagttcagtgcacagcgaatgggtccgacccaccgagttcagtgcacgctggatgggtccgacccaccgagttcagtgcacagtgaatgggtccgacccaccgagttcagtgcacagtgaatgggtctgacccaccgagttcagtgcacgctggatgggtccaacccaccgagttcagtgcacagtgaatggatccgacccaccgagttcagtgcacagtggatgggtccgacccaccgagttcagtgcacactggatgggtctgacccaccaagttcagtgcacagtgaaagggtccaacccaccgagttcagtgcacgctggatgggtccgacccaccgagttcagtgcacgctggatgggtccgacccaccgagttcagtgcacgctggatgggtctgacccaccgagttcagtgcacagtgaatgggtccgacccaccgagttcagtgcacactggatgggtccgacccaccgagttcagtgcacagtgaatgggtctgacccaccgagttcagtgcacagtgaaagggtctgacccaccgagttcagtgcatgctggatgggtccaacccaccgagttcagtgcacgctggatgggtccgacccaccgagttcagtgcatgctggatgggtctgacccaccgagttcagtgcacagtgaaagggtctgacccaccgagttcagtgcacgctggatgggtccgacccaccgagttcagtgcatgctggatgggtccgacccaccgagttcagtgcacagtgaatgggtccgacccaccgagttcagtgcacagtgaatgggtccgacccaccgagttcagtgcacactggatgggtctgacccactgagttcagtgcacagtgaatgggtccgacccaccgagttcagtgcacgctggatgggtccgacccaccgagttcagtgcatgctggatgggtccgacccaccgagttcagtgcacgctggatgggtccgacccaccgcgttcagtgcacagtgaatgggtccgacccaccgagttcagtgcatgctggatgggtctgacccaccgagttcagtgcacagtgaatgggtccgacccaccgagttcagtgcacgctggatgggtccgacccaccgagttcagtgcacagtgaatgggtccgacccaccgagttcagtgcacagtgaatgggtccaacccaccgagttcagtgcaccccggatgggtctgacccaccgagttcagtgcacactggatgggtctgacccaccgagttcggtgcacagtgaatgggtccgacccaccgagttcggtgcacgctggatgggtctgacctcccagtggctgccatggcctttgggcccggtgcagacccaagtatccgtcctcacaccctaacttgcttgaggggacgttctagagcctcccgtgtccatgcagccacccaagccacagctcctgcttgacgctcctgggactctgttctgtacctgagactctcacagggcccggtaccagtgggacccagcctcccctgtgcaagggcctcccctgggtgggaggacatgggctgttaattagacccgggttcattagacaggtgtgttaggctgttgtcacactgctatacagaaatacctgaggctgggtaattcataaagaaaagaggttgaattggctcagggttctgtaggctgtacaggaagcatggtggcctctgctcctggggaggcctcaggaagtatccagtcatggcggaaggcaaaggggagccaagacctcacatggcaggtgcaggagggagagaacagatggggagtgccgcacacttttaacaacaccatctcaggaaagcctgctcactatcctgaggacagcgccaaggggatggtctaaaccacccatgagaaaccaccctgtgacccagccacttcccaccaggccccacctccagccctggggctacatttcaacatgagactggccaggacacagatccaaaccacatcacaaggccatgcggaggcagcgcctactgtgtgcctggcaaacagttggcattcagtcagtgatcagcaggatccctggttctgctactttggggttttggggtacaggctccactctcttccctgaaaggaggcccttcatctgctaatctctaaactgaaagattttagcccttacgtcttgcacctttttcaaaagcagctttacagtgacctaagctctaaactcgtggttttctttgtcatattgtaccaaggggtgggactgtgtcccagcaagcaagtcccgggctggtttggtctgggacgtgcttcatgaagacattacagccactcggcatcattgtggggaaggtaaccacggcaggggtgcccacccacaccgggactctggggcccagccccctccccagggccagccggtgctgctgtggtcatgtggtgcgtaaacagcagctcctcacatgacgccgctctcaggagagggccctgcatgagtgtgtacagcccggccccaccctcctaacagccatatgttctcctgttattggacgcacagaaatttactgtctcctagtaagggcaatgtaggcaatttcaaacttttgccactccagactacacggaccatgtgaaatgtgagtttttagaagccagatcctgagtcatcgcggatgcttattgtttattttgatagatactgccacattccctgccataatctttgccaagatggcgtccccctagtgccatagacatggtacctctgtcccaggtctcccagcctcaggtatcagcgaacctttgagctttgccgctggtaggtgggaagggctgcatccaagtggttttcacttctgtttctctggcttgcgtgagactgagcatactttctcatgtttgggagccgtttatggttccttccaagagtggttttggacacagtcctcatggcagcaaggccagcagcctcgaaagcctgccaagtgcaagtgtggcacgtccacgcaacaccaatcacaggtgctgtcacggaaatggacgtggcagtgaaactgttctgctcctgttcgtctcctccgtgtccgtcatcacagccacagtcacctctgagagaggcagtgatatcgattaattagggcaaagtttaggaagaccaaggagaaagagaaagccctctgagagttcttgtcctgtccagatgtatgtgaccaggtgagaaaggagccggctgggtagctcgggcccgtgtggttcccacgggtggaaatcgtgcataggattgtagctcagagcagacagtgctgctgcttttgttttgttttcttttgttttttggtttttttttttttgttttttgagatggagtttcactcttgttgcccaggctggagtgcaatggtgtgatctcggctcactgcaacctctgcctctcgggttcaagtgattctcctgcctcagccttccgagtaactggaattataggcgttagccaccacgcctggctaattttgtatttttagtagagtcggggtttctccatgttggtcaggctgatctcaaactcctgacctcgtgatccgcctgcctcagcctcccaaagtgctgggattacaggcatgagccaccgcacccagccagagtgctgctttaattgatgaagcaagaatggggctcctgggagaggcgtatgctggctatgtgaggtctgtggacctccaggggcctgccctggcctgctggggctgccgtgacgacatccctcaggctgggcagctgaaaccacagcagtgtcttcctcacagtttcggaggccagaagtctacaatgcaggcagggcttgttcctcctgaggtctctctccgtggctggcagatgacatctttttcctgtgtcctcccagaacctttcgtctgtgggagcacatcctgctctgtcttctcaggacctcactcagattggtctggggccaaccccagtggcctcattttaactccatcatctctgtaaaggccccacctgcaaatgaggttatgtgcagggtaacctggaggggattagggaggcagcacatggattctagggaatggttcagcccgtaacagggaccgacgcctgatgcacaccagtgttttctggtagcttgtagcgcatgagaggcccctggtcttccagccacagtcccacgggggaagctccagtctccccgcactggtgagctgagcgtgcggcgagcactatgaggctggccggtgtctgggccctgggctgtcacctgccacagcccggactgccgtctatctgctgcacgagttggtgacgaaccttcgaggcctgacggagaggctggtgagccactttagacaccaccactttctagagctcagctcacacttcctggctggagcctggccgcctgctcccacctcctttactgtgggtgcgggtgtctgcagggggtccttgggaagggcgcagacagaggctggaggcagcagcggctgtgcaaggaacaggggctccgtcgggggagcagtcacagccactggttctggatttccctgggatgcccgggccgtgggtgtgcccgtcctgcagcagctgtgccttggtcagcggccatcacggccttcccctgcagcccccacacctccgccacagtgccccttgcagcgctctgtggatagttgggttgtgacacaggcagagagtgtcccttccatgatccgcctttattgagggtgtggaactctatttttttgtgggagggggagtgatttgactttttattttttaaaaatctgatttgctgcttaaaatgctagagccatgctagtgctttatttttcagtctctccaagttttcaatatgttgtcttttctgccttgagcacttaatgtttaaaggaaaaattctctgaccccaatctgaccagtccctgctgccatgctggccccagcgagacaagtggctgagtctataggaagagtttgtaccatctttagtatgacagatggtgggttatgtcccaacaaacccatcgtaagttgaaagtgcatttttgacttaatgatattttcaactccaaagaggtttatcctgccatagccccatcataagcggggactacctgtatatttacgacctggtttgattggatgtttgggctccagagaaggtgggtgatggtccagagagtctgcgggagaaagaggtaagctgctgtgatgcagcttggcctttggctgccggggcgattggcttaggtaaatggcacccactgtcccgcagccctgcgttttagctgcttttttttttttttttttttttttttttttgctgtttcttgacttggtagacccttcttatagtgtgtgaatggggcatgatagaagaagtggaatcaagcatccaactcatacttgttgaattaaattgggtaaccaaacattaaacttggtaaaagttaacaggtccacgaattaacggttgtgggaggaaacacttgaagctggtgcataaagtcaggtctggaaagtgctcattcgtgcagcgttttctgagcacccagtgacggacggagacgtccacaggctgctcgggaactcatggaaacttcctggagaaacccgaggcgaggaggcgagaccagaggccgcctccatctggtctgtccagtgactcctgcatctgcaggtttatagacagcatcagaggaattgaatcacagcagttcagggcctggatggagttatctgattctttgtgtaaatgtgtaaacctaacacgagtttaataaaatgcagcttttgaaattccacaagcagttcagaaatgagctggcgtcaggtgggctctgcttaccttcatgtcctcagcacggctcctgggcagaggaccatggggatgctgggtgtgaaggaggccagcagtctggctcctaagaggcttacagccaatttggggcaaaagggggtgaagggctggagaaacactagacattgccacacaccaagctgcattcttttgctagaagacgtctctgtccttgacgggagtgtcgggcgtggcaggggggctacagaggagacttgaggtggacatttgagaccaggttttggtcggtgaagacagctgtgttgggcaggtggcatgcagaggagggaacagcacagctccatcaggaagcagagggcagttcacagaattggagttcacggtggaaggagcagaagatgagctcagcctggactcgagtgaacaccttgagccagacgtcaggtagctttgtgcgtccacatgtggagtggtgcttgactccacatgtaattgttgtgacttcttgaacccgaaaagtcgacattattcacttatttgtgtacgtttgcagaaggtgggagcacttaggatgcatgagccagggactgagtgggtcctgacttgtcactagtgttttctcttctggagcaagaggacagtgatcttggaaagacaggaagatttggtgctgcagtgaaaagatggtgccacgtccagagtctggcttcccagtgtgacatctgggccagcattacatcctgtgaactctggcttccccttccacaaaatatggctggttacaaaactcatgcaaccatactgccgtaaagaaaaataatgacgcccactgtgggaaaatctcctaacatactgcagagtattgcagtgacgtttctaaaattatagaaaccatgttgccaagtaagtttttctttaaaaaagctaatctctcactcactcagtgtttggcctgtgtacatctcattctttgccttacatatgccctgcattttctgagttgtattttgttgcagcatcctctcctgccttctgtgggaatgaatgggttttctttattccctctctcccccttggctagttcagcagttatactttagtaattatcctgatacttttaataaccatgcttggcttaacaatatctggagttcacatttctgccctcctcacaaataaacccaggacctgagacacagacctcagctacctccctctgacacatacagtattgttcagtatttcagttgtgccttgtctttgtatcctgaaatcaaccgtttgttttactagctttcatagtcagcatttgttcagaccgactctcattttatgaggttcccctctccccccatcaccattccttttactgctcaattcttcattttgggtaaaactaccttttttctgaaagatatccttctttcagtcttttattgggaaagtttccttctctttgtctgaaaatgtctttgatcctcacacttgcataacagattagccaagggtcaagttctatttctttttcttttattaccttgaaaccctgttctcttgtctctggtgcccctgcacttgagaagactgtctgttgctggtcggatggtggttcctttgtgtgccagctctagctccttcctgatcgctatgtctgatggtggttcctttgtgggccgctccttcctgattaacctttactgttttggagtttccttgtgtcctgtcttggtaaggacttattttatttttaatttttgctccaaacttactgtgattcctgaatctgagaattcctttctccagctaatcctaaaaaattataaaccatatataatttacatttgactctcttccattctcccctctaatggaaataagttgtaccttcttattcccatgtcccttaaatccctttcctattttctctatctttctgtcctgcattccagggaatttcctcagatctgtcttccaacatacagtgtttctcttcagcagtgtctaacctgtaatccatgcattgtagttataatgttaaagagtatggttttcacttgaagttctattttgttctttttcagatcaacctgctgggttgttcttttcttaaattgttggttcctactttaacaccttcaatcatgatcaatgcattatccgatggtttctaacacgtttattaaggtctcatgggtctaagcctgctctttgatgtttgctgatttgctcatggtagtttgttgtctggtgggttctataattccagattataagctcctcattggtggggctttagttctagttttgtatggccctgttctgagagtattaacctcaagagagcttttgccagacacactaggctgtcattaaactgagactatcttcatgtcaattcctcacccagatcactcatgtgtttgagcctcaattctggatgaggcccatgtttcaagcgtcttcccattttgagtccatatggtgacagacgagattcctgtggtgtgagcacacccatttgctaagggtgtggttgttgagggtcctgtgttatgtggggggctcgggtccagctctctacctccagcaaggcagggttttccctgctggccccacatgggcagcaaagtccaagaccctgattttagatgtagggaatcctgtcgcctgccttccacccagggcttgagcggcttcaggccgcacatcccccattccagtttcactttctccttcagcttggattcctggggatttcccttaattctgtgaaaggctgactgtgccatttgtccagcattctacgtgtctgtggaggaagacacttcaggttatctccttcttcatatcactggaaacacacatgccatgcaaattacacaaaggaaaacagtgcagaggccgcactgtgcttcatctcacatcacattgacaattgcctccaagaaccaactgtgtgttctccctaataaagaaagatagctgggcacagtggcttacacctgtaaccccaacactttgggaggccaaggcgggcagatcacttgaggtcaggagttcaagaccagcctggccaacaggcgaaaccccatctctaccagaaatacaaaacttagctagatttggtggcgcatgcctataatcccagctactcaggaggctgaggcaggagaatcacttgaacccaggaggcagaggttgcagtgagccgagatcacaccactgcactccagcatgggccacagagcaagactctgtcaaaaaaaaaaaaagaaagaaagaaggaaagaaagacatcctaccgatggctgtctagagtcaaagatgagcaggtaatgatcacattccgccgggtttccacactcacctttctgtaagcagtcaaagggatcgctgtgtccagaatgctctgcctctgggagtgctgatgggccaaggtctgcagcaggtgagcagcgagtgggccctgacggctaatgctgatggccttagggaagtccaggtggtccacgtggctgagtgacgacaaggcagctgcagggagggacagatgagaagtcccagcaagaagagtgaccccgatcatccactcccacctcaccctccaaaccctgggaatgccagcgggcatgtcatttggtccccatgccgtgtgactggcactgagctgggaaaagatgtaaaatatctctgatagtctcacctctaactcttcaccctgaaaagtgaaaacactgtttgacatatcagctctctgttctcttctcctccaaactcctcgtttcaaagcaattggaagaggagtggtgaccagtcaacacttggtaattgtggttgactatggaagcctgaatgttctcttcccttcaccaacattttagaaatttcactgctcacaggaaggtctggaaggtggaggaggtagactgagccctccaggctcagttccttgtgagcacgtttggttggtgaagagctggatattaactttgtctcgcacatagactgacccctccaagctccgttccttgtgagcacgtttggttggtgaagagctggacaataactttgtctcgcacatagactgaccccttcaagatccattccttgtgatcacgtttggttggtgaagagctggatattaactttgtctcagacaagcaagtctttctggtatttttggtgccatcaccttgtcagttgttttgttccccttttcttgtattattgctcatgtgcatatagcctgtgggttttaggaagtgaagcatcaaaacattctactttcagtgagcacctttagaacttcggcattttcaaataaggtgctatagaattcagtgtttctcctctgcttatggaagaagacatgcatgtctccatcactgtcctaagtaacctttacagcacttgctggaactctttattcttcctaaaaacttcatcagaaaatcgtaatgagtacatcgttggcacagaatagagaatgctgctgctaagaaaagacctgctacttgggagcgggagaagctgtctatgcgttgcctggcaaccgcccctcctcatccttcttctgaaaggtctccctgttagaaccactgtcgtcatcagtggagtaaaaatggtcccctctgggctgcttctcctgggtcgggtgccagcaaaggagtctggtctctgagagaatctgatcataccgttttggccatatgggctttgtaggtgaccatcagggtggggagaggtgggtgcatgaccacttaaacaaatgggtctgctgccacacaaagcatagaaatcgtgatacgaaacggcttttgaagggatcttacggaaaccgccactccccaggctgctggaggctggtgtggatgttgctgctgagccaccccgattcccccacccagggctgcttgtcacagagctgggatgacaggggctgctgttcactttagagattctgctcttctcctagaatatgttagtgtggtaggagacctcttcagggcttagttacgtaaaggttgcatttcatgaactgttttctttctcttgcaccctcttttcctatgatctgtttggaatccaaggttggttttcagctgaattttgcacactaatggaatttttaagtaactcattgcttaaactatatttcatatgtcaaagggatatgttcgaagctagagtcaaattcttttctcattgaataaagaatgtgtattgatttatattaataaaaaaatgttgtagaacaaatatttgcaaatacatttgttcatattgttcaaataagttataaaaagtaaacagaaatatagttttttccaacttcctttttctggttataatattccgatttctcttcctcatcaaaggcttagaagatatttactttctttgtaaaggttagcattggtttctgtgttaaactatctatagttaaactttgattatccaaatggaatgagaggatttaattattgctaagcagagaggtttaaaatggacgggaaaagaattgggggagtttaatctgtttagaatgattgagcattatctcttcatcttccacgccatttctccaaagttctccagtgttttccattcatctataaaggtgatgaccgcagatcctggtataaagaagacacctgaatagtaaactttgtgtttgataaatagccatttcaggaatttgaaataccatgggtaaatatttgaaacttctaaaaggcagaaatcagtagaaatatatgggtagacattttaaacttctaaaaggcagaaatcagtagaaatattataagactgaattaatttttcattagacttgttttaatcgaagtagctgcagtctggtattaaaatcatcacactgtcaattgttgttgttgttttttttaactgtctgtagaccaaaattacaagaagaagagaaacacacaaaggatatttggtaaaggcaggtggtcttgatgaataatgttcctttcattaacatatttcccttattaactgtgtaattaattgtacatagccaagggaagctatggaaattgcattttgagatgtatcaaagctgacttatgcttcagacttccatgcaatttaccattaatgaagccagagatggaagcctcaaatctataattattacttactgtttgaatgacaagcaaagaattttatcagcagagttttaaatgaaaggggattagcagctaatgttgaaattgttaatctttcttatgaaaataattttgaagaaaatgttttagtggaaagagagggttggggaagtatttgccattaaaatagcgatttcctgatacttcatgtgactttgtctacatttgacagcagggtgcaaatatttttgaaagtgaatgaatattttatagggtccagagctgctcatgcattctgggaatggattatgcaatagttccaaatgtcctggctggggtgagagactgtaagctagccagaggaaagagctgaggctaagaaaataaaatataggagaaaattatagaaaatccaaatatcctggctggggtgagagtctgtaagctagccagagaaaacagctaaggctaagaaaataaaatataggagaaaattctagaaaatccagatatcctggctggggtgagagtctgtaagctagccagagaaaagagctgaggcgaagacaataaaatataggagaaaattctagaaaaatgaaaattggtttattgtcccagatctgtacccttctccccctctgattgttcacttgattttagatggtgaatgacaaatattggtgaagaaaatcattccatgaaacactggtaaccatttgtccgaaacgccttcatggcagcactgccgtggctcagtacattgcacctgcacttccaaagtgaaggtgactgttacctgaaacccatgtgcctggcacacatgaccagccttggacacaagaggcctttgatcagaaactgggaggcactcccacattcccacaatgaaattccgtgggtgcctgtaccctgagttcatccaacacatggttactgatcatgtagggtgtaccaggctatgtcagacgttagagacaccatgaagagcaaacagttagcttatggggagtgcctaacgcacacctgccatttacatctttgtcctcatgattcttcccactgaaccaatggcactgactcaatatacgtggcgttggctggttagagcccgtgtcgctgtggacaggagaaaggacgtccagggagatggaccagtgtgccgtccttcacgtgtgttctggacttaacgtcacactcgagacatgctggctggtcagaacatctgggacctggaggcctgttaggttctttagaaagttctgggctcctcccacacgcggtgtccaaggacaacaggcaggtgaccacgtccactgcagatgtgcagttttcatctcttaaaaattctggttttctcaaacttgctgtctccctggtttcagtttgaaatggatttaatgggctagaacccctgtcagcctacgtcagcctgtgaatctttcacagaattgttttgtgttctttggaaagcagttcatgattgcaggagtcatttaataactggagcccggggggtctggaagaggtcgtacggcccctctgacctgtgggggataattcactcccaggaccatgcccggtcgcgatgcattgacaacgcagccctgtgtgcacacaggcacccggatgccttggtctgtgtttcaggagttgcctcatctgtggacaagcacatcacggcgtcccaggttaggttagtgattcggttgtctttacattttaaatttggggtttagctatgggcagttaattttctatggtactttgagcaaacttactttgacgaaagctgaatagtgccattcaatatctgaatgtcttgcccatgtaacaaaagcatgaaggctattggaaatatcagagttgtggatagaatttttcaggtttttatccagactgttaacttcaggtaacttaagggtaggtatgaccttgcttctcagatcaaatcattagggtctttccttgctgtggttctgtgaggggtgaagagtttaaacaatgacaaaatattttgcaagctaaagagctgaagacaacttaggtgtgtgaggaagggcaggtcagatgagcagacgggaatcctaggacgtgttgcctgcaggacgcggtgcaccctgcccagttctctcattcgcccgcctccactgctgttccccacgcgctgttccccatgccacagccactgcctgctcttccatggtgggctgcagcagtcctgacttgcatcctgcactgccacctgggaaccagggtggtcttccaaaagcgccaccatcaaccaccatcacaagcatctttggcttaaaactcatgaaagcttcccgtggctcttaaaataaactgctgagtccttgcaggccaacagctcctggtctgccggacaccgttgccctcacatccattccttctctgcagccccgaccttccctcctcccggagtggccacgccctcctgccctgggctccagccttcactgcccttccctgtaggaccccacccccactcaggccctgcccaggtccttagcatcggggactcggcccatggctctgagagtttacccttcagaggggccccctcagtgccatcccaggtgcaccccgtccccacacccaggctctgcgtcgtgactcttgtccgcatcttcttactactcactgttgtctgaaatcactttttaaagctgtgtttatctacttgcagatggtctgccctccagctaaagaaattaatgaggccaggcgttgtagctcatgcctataatcccagtactgtgggaggccaaggcaggcagatcacccgaggtcaggagtttgagcccagcctggccaacatggtaaaaccctgtctctactaaaaatacaaaaatttcgttttcgtatgatggtttgcacctgtagtcctagctacttgggaggctgaggcaggaggattgcttgaacccaggaggtggaggttacagtgagctgagatcataccactgcactccagcctgggcaacagagtgagactctgtctcaaaaaaaaaaaaaagaaaagaaaagaaactaaagaaatgagccacatgaggacagggtctttggccagctaactactgtgctcccgaacctaggtcatccctggcttataggacgtgcttaatcaaactggatgactgaagggacagatgactagaccaccacaacatcggcaggaatccgacagaaatgacagcagctcttagccctctgtcccaaaaccagatgaggcattcacatttcacttagaatgccaagcagacctcttttgccctaaatttaaatattaatagctgtacatttatggaaaacatagtataattctctgaattattttccattgcttataagcattcatctctgtattttacctatgttcacataaccttaatttttaagatgttaaataagataataagattcataaaattgttcatttaaaattctttgcgcttctctgagaatgacagcctgaaatacaaagtgatgcctctgtcatcatccccattattaaacagcttctttcttagtctttctgcaggtgacccctgtcaccccctcctacgcacactccctaatatgatatcttgctaaaaaatgcccaacgtaaaacaatccatcaatcgtatgaaagaacaagactttcccctacttagtaagagtaggtggtaaggaaaaaattacttatctttttaagtttattaattagaacatttctagaacacaatgtgttcactattaacatcttccattggggtttttgttgttaagtctttatcaaattgtcatatttttctgtaaatgtgtaacagaagtttagtggaagtcataaactgaaatcgaggatcaccaggcgttggtgcaccaggccacctttccacgcatcgcaggtcttcatgcagtccttctagaggtgaggcagagactgggccggctgtggactccaggaagtaccctgcaggtcacctgggcattgtgtaagaactcctttgtcagtgtgatttcttacaactctggactttgttatcgatttggaacatcaaaagccaaattataataaaaatacactaattaaagtttctactcaatcaagatagagccagttttcatgtcctcttaacacaccactttgcaaagagttaaccttcctttccctttgctcttcggaaagtacgtaaggtctgtgatcatgtcccagtgcctctattagaggcaaggaatctgtcctcttacagtgtttttctaacaggactttgaaaaaagcatgtcattttcttgacagccttatctgaagggcattcttaattctctctttttttttttttttttgagacggagtctcgctctgtcgcccaggctggagtgcagtggcacaatctcggctcactgcaagctccgcctcccgggttcacgccgttctcctgcctcagcctcctgtgtagctgggactacaggtgcccaccaccacgcctggctaattttttgtatttttagcagagacggggtttcaccgtgttagccaggatggactcgatctcctgacctcgtgatccacccgcctcggcctcccaaagtgctgggattacaggcgcccgccaccacgcctggctaattttttgtatttttagtagagacagggtttcaccgtgttagccaggatggtctcgatctcctgacctcgtgatccgcccgcctcagcctcccaaagtgctgggattcttaattctcagtgagtgaatttatttttcaatgatgaaaaagttttaaataaagcagatagttcagtagcgttcccggtctcaaaaccaacacgcaccacacgttgtttccccttctacgctttgttcctgccgctgctacttcaccttctccacccgaactgcataccaactggggactttctccggaagattccattttgaagtatttgaacttttctccactaccttaatggtttataattttctgttactccacagtttgattggtaacaaggcaaagaatggaaatggatttctaagtcacattaagacgcagggagaacagttttcaagggtctctgggcttgccagagattctaggtggtcctcagaataggtcagctggagacaaaactctcagagaaagagcttggaataaatggcattaattcacatccatcagggaagccagttgtggtgcccacaggaggaggcttttgccagtttcatctgtgttgaccacttcccagttccctgcggtaagggaagcatatgacttactgcagatacgtgtgggaatgcctcctccttacaaacaagttgtcaggaaagcagtttttaaaatgtgatcaaaagcgagaagaccccatgaatggtctttcacacactcttgttaattccttgggtcccatttctacttctttttggctttgtacggatgacccagaggctgaattccaaaaccgtgtgtttgcttctcccgagcaaactccaccctggcatgcaggcacacttcgagttggctgccatgggcctgtgccttttggtaatgtgtgcatatctgccctgcatctcaagttgcttgtttggagagccggaacaatgcctgtttcagctgttgagtaagacccgtaattccatggcaagtcaaaggtgctgccgtgacgggcacacggtgtgttagaggagcgggatggtgaagaagccggttcactccctgccgcctcacgttgtgggcattgctttctgagagtgagatggcaagttgaatatggtcgtatgggtcgggattcctgtttcaggaagagctttcttaaactaagaaatagtgaaactatcttctgatcctttaaccattatctgttcttctttgtgttcacatgtactactttgaatttctaattttaaatattttaacattcctgctgcataatattaacaaataatatttaaaatatgccagatgcagcaatctacagacaataaaataccttctcatcaagggtttgctgctcccgaagcccccatagctgtgtgtgctgagccaggacaatcaacctcatcgaacttctcctttcatcttttcacagttttgcttggaattcaattgtcctacttttggaattcaaaaatttaacatgaatatttcccgttcatgtattaatgaagacaggtgactgtgtttatttttaaagaaagaaaaggtcatcatttccccaagtggcagtggaagcagcttagtccttgcttttaaaagcattactctaacttgtgacttcaacacacaaacctgtggtctcgtcacaagaaggaaaatgtaaagggattctattattcgttttaacaaaaggtttgattgtaatgttcagtaaattaaagggcattgtgctgcaataggcgccattgtagaaaagagaagtatagccttcccagtaatgactgggttccccaaagcccagctttctttaacacgccttgttctacagtgggaagaagtctccactgctggcagcatcgttgtaggaacgaagtttcaccaggacagtttccactcgtcccatatccgaagacccacggagtgatgatgggcgcctccagtcatccgtggggactcactttccactgcacgagtggtttgattgatgagaaataatgccagatggaccggcttttgctcatttttaaatagtccactgagttttaggagtccttaggactccttaggagttttagtattgcatggtgggagtttattctcattattatttttaataataataataaatcatcttgcacctctcagtatctcacttcttcattgttacagccaacagatagatgccaaaataacctaatttctgtgactctgaatggagctgaaatagcactgacctgctccagcctttcttctgcctccccatgggttctgcggtgtctttggcagcagggtctgcaggaacaggtgaatcagcattggctgacccaggatcccagtgcctgtggacgggattcacatggaaccacatctggaccctttacaagtctccagatgcactaccccagtactcagaggtggcagctgcacttcctcctggtgccaacaggaaggcgagcatgtttcgtgtgagcgggtcctgcatcagatgcacacgggatgctggtgtgctcttcccaccggagaaattgtccttgttaactagcagtttagtgtcacatagtctcttaaacaggcatttcctaggatttcctctcctgaagacaggccatgaaatatttccctcttcaaaaaagaagtgaacagaagagagtggacgtgttgtatttccttaaacaagaggataagagtctccccagaaccgcagtgcagccacagagcgtgggagggaactcaggagtctttccagtaccctcttcctctactgaaacactgagaccgtcccgcaccccatccccgggcacacaccttctactgtgtctcccatattcacgcatcacccctcaaaacctccttgggaacatagactctggctctcccctgtgagctgtgatgaccaggttacgaaggggtgcacccgtggggctcagtcagatggcctgacttgccggaaggctccacgccaaaaagtagctgtgggagggacccacaccgttctgtgtaagactgttaagaactctatcaacacaaagtccagtgccttcccagtgtgttcatgtgcgttcctgttccacagaagctcctttccatgttcatctctgcgagtgacggggtggttcctctcctgaagagaaggtgctcttgcaatcgttaacagacactgttgtgttctggactgtctgtgctccgtgttcctagaaatcagccccttgacctcaaggtgttgaccatttgaccggaagacggtgctgacgacatttgtgctatgtaatacattgtgaacacattctccctcaaagtgttcatggcaatcacacttttgttacacaaattttggggttctgtgtataatgattccattaaatgtggaagccagttggtttgcctgacacatggaggctgtttcctccaaaacccgtctagcagcacccagtcttgtgacccagtgactgtccttaatgctccaaccctaaatggtctcataggatgagctagaaaacaccatgagacagggactggcaggatggattcagaaacgggagaaggatgacaggggaaaccttagattgagttcatatctctaacaaagtagattatgtgagcgctgatggtgtcattctcaaagggtgagaacgcgaaaaagaatgcagccacatcttcagctgctgtggtgtggatgtcgtgtgctctgggatctacgtcagatagtgaatgttggcaacacccttgggaaacccacttcctgagtccccgtagctttctccatgaatggtttgatctaggaattcactcttccacaagcacatcatgtctaggccctcaggaagtatgagaatttgagaaggttggagacaccttttcactcagggcttatctagaaacagcttaagtaaaattcccttaatggagtttaaaaatatgaaaatgtcagactgagttctcccagccaagagcccttcaaaacccaaaattatagagcaagcagctctaaaagacgaaagacacacctccaaacgcttcctaaggatcagggaacagacagcaactccaacttccctaagcacttcagcctgcatcgactgagattcaccaccaattcttcgctccctgttttcactcttcatggatttcctgatgtgagcacgcattgtggtgcaatcccgccttcactggctcactccctctggtattgtcagcctcagtcagctcattctagagctttcttcataaagcttcaactcagaggcactgacggagagcccagagcaaggagctgtgtgaagtgggacacggtgtgagaaggggtccctgaccaccaggagctcacgccccggaggagacccagctgcaggtgcggtgcacactggtgcctggaggccactgagaaggctccaggggagatggagcaccccacctgggacctggactgtggagaatgagggagatgtgaaaaaaggagaagagttgtggaggagacttgtagagaagagctctctgaactgttgcccttccaaatttatacaactgctgttaggttcaggttgttacaggaacactcaatgagctgacacctgtctgtcatgagttacagtgatgtttgctgggcaaccccagaaaggaagatggcagcaaggtcatgtatagtaaaacattccaagttccttatgctcctttttggagaagttcttccaagtttcagaagattcaaaggcagtgttttggatgcccatcatcaaaatgaaatgtttacctataatataaatcacttgtagagatttccagattatgcattattattccacagatattggctgagtgcttgctgcctgtgctgagcagctgaaacacagtccctgccctaaaaaaattaatctcatgagaagaatcagagcttgaaacccacagttaaagcaacaggaagaatgtgacgaatgccacagagacgtatgtttgaagtagtaactgtttgatgtggggggtgggttatagggaagaaagatcatggggtggggtaggtaatgggcatgtcctgaccggactcctggaggaggaagtgttgtctgaactgcaccttgaagtctgggtcggttcattacagaaaaatcagcacaaaatgtagagaaggatggcggtggggacggggcaaaggctgagaagcagtcttatgggatagaaagtatcagattagtaaaaggaaattcagaaaaaggacaatgctagtctaggcacccttggtaatttttttaaataggttatattttgcaccagaaacgccaacctggtcgttcagtgaaaaagcaactggaaaggggaagcgatggtaagaagatcagcgagaaggctgcagtgacgggccaggagaaaacccacagggcatttcagaggccaggctcaggctttggtgctgccactggctgctgggggctgtggaccaattgcttaccttctctaggccttggtttccttatctgtaagatgtgagcctcatctctgcattttttcactttaaagcagtaaattgtattctgttgaggatgtccaaagctgaaatgaaggtactcagcactgggggaaaaggttgccttacagtttgctgtgggccctggggttattcgttgccattctgcttatcttcattttcttttcttttctacatatgctatttatgtaacaaaagttgcagtgccttaagaaactaagccgtcccaccaccacactctctcacacatgcactcatctataaaataaaagaatttaaatgtcaaggttttttttctgagctaacttttttatgatttttttccatttattggggtacaggtggtatttagttacatgaataagttctttagtggtgatttgtgagattttggtgacatatcacctgagcagtatacactgcaccatatttgttaatcttttatccctcgcccccctccttctcctcccctcaagtccccaaagtccattgtatctttcttatgcctctgcatcctcatagcttagctcccacatattagtgagaacatatggttgggttttccattcctgagttacttaacttggaagaatagtctccagtctcatccgggtcactgcaaatgctgttaattcattcctttttatggctgtgtagtattccatcatatgtatgtaccacagtttccttatcctctcattgattgataagcatttgggtttgttccacaattttatagctgtgaattgtgctgctataaacatgcatgtgcaagtatatttttcgtataatgacatcttttcctctaggtaaatacccagtagtgggattgccggatcatatggtatttctacttttagttctttaacaaatctccacactgttttctatagtggctgtactagtttacattcccatcagcagcgaagaagtgttccctgttcactgcatccacaccaacatctactgtttattgattttttggttatggccattcttgcaggaggaaggtggtattgcattgtggttttgatatgcatttccctgatcattagtgatgttgagcattttttcatatgtctgttggtcatttgtatatcttcttttgagaattgtctattcatgtccttagcccactttttgataggattgtgtttttttttcttactgatttgtttgcttaaatgtcagttttaaaaacacctatagctaaatgcccactaccagggaaaagccacaaatactgtttaaattacatgttaatttcctaataattccagaagacgtctgagtagagttgctatacttgtccaagttcacatgcaggatgaccacagtatagacggcccccaacttatgatggtttgactttacagtgcagaagcaacacgcattaaatagaaactgaacttcaagtacccatgcaaccattctgttactcactttcagttcagtgttcaatgaatcatgtaagatattcaacactttatcctcagtaggctttgtgtgagatgggtttgcccagcagcagaggaaggtaggtattctgagcatgtgtaaggcaggctaggctcagctgtgacactcagtaggttacctgtgttcaatgcactttttttttttttgagacggagtttcactctggtcacccagactggagtgcaatgatgcgatctcggttcactgcaacatccgcttcccaggttcaagcgattctcctgcctcagtctcccgagtagttgggcttagaggcgcccgccaccatgcccgactaatttttgtatttttagtagagacaaggtttcaccatgttggccaggctggtctcgaactcctggcctcaggtgatccacccgcctcagccttccaaagtgctaggattataggcgtgagccaccgagcccggcctcaatgcactttcaacttaagaagttcttgggccataacccatcataagtaggggagcatctgtactaagctcccgtggtaccttttggttttgctttcattgtttaaaacattactttgctatgaaggcctagcttccccacagactcacagatgaaaagcatcttatctacaagccatgaaagagaaaaaagactcctaagatgtagttgggggatatttcatcagtttaatatcacaaaggatgtttcataaaaaatattgatagaagaatacagaacagatcaaattgaaatgagcagaacgggacaaacacagcccactggagtggcgtgtgcagagagatgtcagctctatctcagttttaatagagtcacgtgcctctgcagatgacttcattctccgtgaaaaaacatcgcgtcagtatctacctcttcctccctcctaccacccaaccttgggccacacaggctcagtttatatttttgccataaatttagaaattcaagagaacttagagtgtaattttgcttcctatagttaagataaatgtgagaatttaaatagctgtagtttatacaaattaagataatatccagtgcctcttttgcagataatattttcgattggattaaacctgctagggttcatcattttagaacccatcatgttttactgaaggaagcccatttgtttgtgatggattttatgaaaagagcatttttcaaagaaaagctaggacccagaatgattttgccaggaaccattttcgacctacctatttgtagaactctacgtaagcccaacttgagaaaagtagccacagaaacagactgggactatcctttcaccataactatcaacctcccagcttccctcacacaccagatttgggctagatgagctggtcagtattttcacaaaacttaaatattatatcatccaaaaatgtttttcctattagggtaactttggtacaaaaatatgaatttgatgttccataatgattgtctcaaaagaaagaatgtgtagcatttcctagattgagccatttgaattttgcctaatttcacaactcgagacatctctgtggggtgcttcttccatgcacaaggaaaccacgaggcttcctgggtgtcggggctggtgacgggagtagatgaactcgttcgctttggctcagagcagccctgatgtttctgttcctggcgcaggtgtgctcccaaggctcaaggtgtggtgggggaaaagcgttcgctgcgtggagcaggcagtcggtgcggcttctcaacggcactggagtccctctgctttccccaactagctcaagcagggccatggtgggggtgacagtgacaacctgggacctcccaacagacggccttagagtgcccaccctgagccaggcgattgtccctcaccaccacacccacccagatgcgggggtgtcgcgcaaacagcacaggtgcccgatgcacctgctcccgtgtgagctgggccagcacagcagggtgtgtgtttgctgcatgggttcaggttggctgtggtcaaaacttccactagacggcacgatgacctgagattcccgcctcgccgtgtccagccctccctccctctgtgtctctttctctacctgtctcctggaacgggccccagtgggcagggagggaccatcccagctcctcggatcaatcgaaggggatgtcagggggtgggcagaaggtgagaagggcttggaccccgggcctgacattggaatgcgtggccgctttgcagcaaaggaccatgtgtacacatgcatgctttattttctcgtgtggacacacttggaacctgtgtctacacatgacacacagtaccttgcaaatccacaagcagagtgacagcagacgaggccgtcacttcctgtggtgccatagtgcagctgggtttggtcctttgaaatgttctttcttaaaatcagggcttgttctcaacggtacagatgaataagaaccgagtgggctgtgctggcggcatgggggtttttgtggaagggaattttcaggaggcctttgtttccttgtctactcatagtaatgctcaacgacaagcaccagaaaaattaagatcgaaacagccaagggttaaaatatttgcttccatccatttgtgtttgtttcatgctagaagctgtcccgcattttgcacagatcagagcagcccagtctctcaactgcatcacacccagtgggttcagaaacgtgcgccggttttaagaaaaatgacttccatgcaagcagaaatgggcacgcggagcagccccaccgagagcttggtctgagctccctggccctgtcgttaaagcatgtgataattgttgtcatctcagcggtaaactgattcccaaacaccggagtttatatttacatatgtaaaatgtgtgttaacaatgcacatatttcacttaacggttgcatggtatgatatgcattgtgcaccgtagcacaacgtcgcaccatggcccaggctcgtgagcaaggtgggcatggcccacgcggcgagtgcaaaggcctccgctgccttttgtgcatctgccggtctgggctcaccacctaggtgcgctcctgaccctgtgtttccctttcagtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctgtacgtaccagccccgggggcaggaagcctgggttacgggcggtggaaactggccgtgctgacctgtacataccaggcccgagggcaggaggccagggttccgggcggaggaaactggccgtgctgacctgtgtgtaccagccctaggggcaggaggccagggtgacaggagtgggaacctggccgtgctgacctgtgtgtaccagccccggggacgggaggcctgggttacaggcagtggaaactagccgtgctgacctgtacataccagcaccgggggcgggaggactgggttacaggagggggaaactggccgtgctgacctgtacataccagccccgggggcaggtggccagggtgacaggagggggaaactggccatgctgacctgtacataccagtcccgggggcaggaggcctgggttacaggcgggggaaactggccatgctgacctgtacataccagtcccgggggcaggaggcctgggttacaggcgggggaaactggccatgctgacctgtgtgtaccagtccccggggagggaggcctgggttacaggcgggggaaacagccccatcctgagggtctgcaaagccctccgcttctccttcccggcaccccccgcctgcagcagacttgccccctctgggaaggccctcctgggaatctcccctctgcgatgccatccccagcccaaccaacaaggaaccagtgtcttcctttcctccagcacgggcctggggacatctgcaccccagtgagcatcagctctattgttctctgtcaccgagtgacttgagacatgttcctgaacctcttggagcctccacgtcacatctgtaattggggtcacgctgtcgtccttgaagtattactgctgtaagggttagacgaggtcattagcatagcaccggtacgtcgcaggcacacaatcaacagtggttgcttttacagcatctttaactttacaattatttccacaaactgagcacctactacctagctagggatcactgccagaaaatggaaatataagccagcagttctccgagtgactctcgtggactggaagagacaccgcctcgtgttcccacagcacgggaggcactaagctgcttacaagatgaggagggcaaggactgcccggcgctggcgtccacctcactcatcctctatgtgtatagcaggttccaatgaaggttccacactttgattggttataaacccacccgccaggaggaagggggtcctagatatgttcctgaccagagtttcagggggaagtagatactcacaacgttgagtgatgaatgataaatgacagtgtgggtagagtttcttagttactctcctgaggaccctaagacaaggcccttgcgcatgtctctgatgcaacagagggagcttcgtcagctcacacttcgagagcaccactcggccacactcactttcagctcagcatcaggcgggaccagtgtcccctgtggccgaggccgtctctccgtcactgtgtccctgcctcaacccttcggagccggtcaagggatcagactggtgtccctgagacaccgcctgtccccgtaccagcagcacagccccccacgccagggagaggcactgcccttgccctccttccagccctcaggaagtgttacaggtcagaacagtgagaagctggaatcttgttttgcttcagaaactaacctggggcactgcagacctgtgtaaaatcccattcacccagctgggtgcacgcttcttgctacccatttagtgttcagaccagtttctatgaggtctgagggttttaaccctaaagagatctaaaaacagaagctgtgtgatttataaattttatatttagaagaaaagcaaaatacaatacatcccattagccaactaacagatatttactaagcaccggccctgtgtcgggggctactaacaggctctgggggcctggccactgtcctcagagaggagcagcctgggggaggagagggcggggagtgaagccggtgtggtaggacaagtgagggtggtggtgagcgggtatcctgctgagtcctgagtggagaatggttcgtggtaaatagccatgcagtaagcgtgcattatatgtctctgtgtgtctggtcatttacttagattgtgaggtgtttcatggtaaatattcatctgacagcacgccctccccaaagacagcccggagcgtggcagaaacgacctgccgatggggttttcctcccgtgtgccctgcagccttctgggctctgtctgtacagtgtggatgggggggttgggggcgagggacctagtgatggtgaagtggtccgtgctcagatgggacacaggcagcctccccaggtagcagccggtgccaacagggtggccacatgtggatgggcgcctgatgttctcatggggatcaggacagccctgcccattctgagccaggtgacgggtgagggggaaagcacctccctcccgagactcgcactggagccagaaagaagctgcctgcacctcctcccagggttctcccgacccatgtgccagggtgtgaagacacagcactgcccttcagggttgagaggccaccagggaagacagagaacggcaagttcacctcctgggagaaccctagatagaaatattttcatgaacacataggtttattctgagcaaacttgtattacctactttcttctccatactcttggccatcttgcttttgggaaggagatcttgtcctccgggagacagtggcttggcaaaagctctcgctgttgccaggccccagagagatggccgcctcctccatcttcactcctgcctcacctgcggccgctgcgctcttcacaggacacaactggctccaaaacagccacacacggtccaggaggactggcttccctgtggctctgtggcttggaaggcccatgctgcgctgtcatggtggggggacggcactcgagctgggctccatgctgtcctctgtgtcgcgatggaagcgagtctgcatgctgggcatgcactatcctctgtgcagggttggaagcatgagtactcggccacgctgtcctctgttagggatggaaccttcaagtcctccctctgcacctgccgctcccaccgcgtcctttccgcgtgctcaccgggaactcccaggtctatggaaagggtcctcgggaccacccctcccttctctcatgccccgccttccccatggagcacttccctgggtcattcttccacccaggagatggacacagtcgcccgacttcccagatgcaccctgatcggaatgagcccccaaaggagaaggaaacacacattatgcaatgcttggctggcaccatgctaggtctagttgtattatctcagaagtttaaagaacttaacatgcattttctgttttttgaatgtttaaaaaagaattatgcagcatttcgcttgtctgcatttcagatgaagaacagggatatgatactattttggtgccatatcctaaacaaaaaagtatttttggctctatgttgtaataacgagagagagagagagaaccaggacaaacaatgcagagagacaagacagagacaacgaagagctgaaggctcagggacaggaagacagcaaggaggagagtcatgtggggttcacatctcccagcttctgagggcattgctgctggaggaccacagctgcctcacagccagaggcgcggctgtgggcatctcccaggcccttgccttgcagcgtggtccagtgaggcagaggcccagctgatcaccgttcccaggagtcagggtcaccacactggccctgcgctgcagctgcttgagcagcatcctaaccatggcatcactggggcatcgtgagccagcatcccccgtgctctgcgctgcagctgcgtgaacagcgtcctaaccacagcatcactggggcatcgtgagccagcgtcgcccgtgctctgcgctgcagctgcgtgaacggcgtcctaaccacggcatcactggggcatcgtgagccagcgtcgcccgtgctctgcgctgcagctgcgtgaacggcgtcctaaccacggcatcactggggcatcgtgagccagcgtcccccgtgctctgcgctgcagctgcgtgagcagtgtcctaaccacggcatcactggggcatcgtgagccagcgtcccccatgcccgtggatgtgccacctctggtcctcacaagaaacccccccacttggccgacaagaactttggggtttagagcccgcccgtcagagctgaaatccagactccccagtgccatcctcataggctgtcttgggctcacctgagattgtgcgtgtgtgttgggaaaatccatgtccatttcaaacttctacagaagtatttgaaacatgtacaagggctgaagcactttggctaagcatagctttccttagaatactcagaaaacaatttatttctaaataaacctttggtttagtttttttttttttctctcccaaaactctaaacagagtcccctaagaggaatattttgccttggttacttctgagtgaccaaaagttatcatgatttgcttttaaagatgaatacgtgggtgattctcctaactctgatgattaagccagggttttctttttccttccatagaaaaaggttctgggcatatatgtcacctcgccaagaaagttgctggagagagactcccagcctggctgccttcccttcaccccttttgatctcagtgccagccgactctgccctaggatttgggaaggctgtcggtttgttggtgttggaaagaaaatatcccagcaaattctgtgtgggcctttttctttgctacctcacaggcagaagctgttctgggcagctgttctgccagagactgaggattcttttttaggaagagatctacagagtccttctcattaggctacttctcgaagggaaagattgtctaaaagcatcatctctgaactacaactgcaagtgcaccttccgtgagctcttcaggacctccagtgcaaagaaacagtgccggtggggttgtcaggagccacgttgatactccacacagttcagctgctcaaagttcagattttagatcctctttgctctctttcttaaaactgaaccgataggttggtaagatgtctggcctggtgtggcatggctacccgtccttctcacatcctccttccgattccgcttacagaatcttcgtgtggggagggtctcacagtgtggggcgagcctggccttcggggtggcagcagccgggctcaccgtctcctgggcgccctgtttcccgtgacttggaagacctaccctccagaggggccccaggccacggtgtgcttcttcctggatcaggcctcccactttatccaccagaagttacgttcatcctgccaggtgcacatctcagcgccggctgattctgaggccgaacccactaacatccagagtcttttccttaaggtcttcggtggagcccagggcctcgcgcaccccccaccccccgttggtgacagtcaagtttaacaggagaatcgagccttgtgttcatctcctgtaaccgattctcgttcagcctccagagcttgtggttcctgagtcactgcgtcacctccctctcagctcggcaccatctgctcgttttataaacatgtttttcacgtcgtcaagtcattgataaaaacacattccgcaggaccagtgctgagccaatcctcccccgtgacgcggatccaccgcgggacttcccaggcgctggttccagggctgagattgtttccacggcccggccttgcgatggggtcaccccagccgtccccaggtcccgagcatattggcaaaggctcatcagatgtttccacgtgaggctcggggctaaacacctccttttcatcctcgaaacagccctgagattcacacagggacagagctggggctgaaggaggttagggagcccaaggtcagcggctccccggagagtgcagcctacactaccccagcgcagacccagccgcaacccacgcacaccgctcttgcagggccctctctggagcagaagtgtggctggcttagcatgacttcctcccccactttttattacaagagttttaaacactcaagtggaaggggtagcgtggcatcgcctgcacacccaccacccacgctggccagccgcccagtgttggccgtattagcgtgacctgcgagcacttcatttattttctggctggacgacttcaagtaagtatcaggcgtcatgacgtccaaatactttagcctgcctgcaggtcctaaatacaagggccttctcctaggtagctgcagccccgttataactaagaaaattaacaacaatccctcagtgccctctaacacccagctgtgcccatctgcccaggctttggagacagcagatgagcaggtgaaaccacagaattgcatttccccatagtcctggaggccggaggctgcggtccaggatgtggcagggctggccgtgtccgaggccctccctggggcttgcaggtgctgtctgtaactaagggtcccctttgtttaaggacagcagacccactgcactaggccccccctcaggacctcaccttcacttactggcctctctagaggccctgtctccaaacatggccacactccgcagtcctgggggttggggtcgtcacacaggggcatcagggcacagctcagcccacagcgccattgctatcacacactcccagggactcccgccgctttctctacaacacggtctgttatctgttgtctgttttgttttttccaccaggatgcagtcaagattcatcattgcattttgggttttgtgtctctttcgtctttttaattttgaaacagctgtccctgactttttttcctgatatgaatggtacctaataaagctgttcttttagtgaccactttcccattccaaacaatcacagactctccatgtggaagtctgtagggaactctgcaagcccacgagaagctcacctgcccccttccagaacccccgtttcccaagaacccggagtgtacaggtctccacgatgctgtaggaacatgaccagcctgctctgcgaccttgccacgggccacagacttcaaaccctgccttggccctgagctccaccctggccctcccctgtcctcccccttcctcccctgtcttccccctcctctccgtcctcctttttcctcctcccacctctttcatggttccctgtgttctgattggccggttgagcagtcctgctgcagaacgatgctttccaaggcatcccgttgcttgtggtcttccaccagcaagaatgtggaggccagccctgtgagctcacagagtcacagttgtgacgggagggtcgcccctggccatgtggcctgtaaggggctcgaggagtccggatagcagcgccgaggtctgctcgtggtgagagaccccgagtcccggcacactgtgggggggccgcaggacggcggcccggggtgccctcgggacccctgcgctccgagactcgaggactacgcgacaaacggcagttcaggctgccgcgggtgcaggtttgctcatccacggccgccgggttagggagacgattctggcacgttccaggcaggccggtgtcgggagagggtccctgcgtgtgggagacggaggcggcggggtcggctggagaaccggggaaggaacgcggcggcctcctcccgcgggaagaggcccaagccgggctcgccctgcggctcagcgaggagcccgccctgccggcttctgaggacgcgccccggaccctgctctcctgggcctgaggtgacacgttctgtcgattgaggccccgaggtttgcggaagtctctggccgcagccgcgggaggcgcaacacgctgaggctgcgcgacgtggggcccgcccggacccgcctccgcccgtgtctccccgcagccgtctctgccagaactatcggaagagaccggaactgttggttttgtgtctgtgagaagagcagcactgggaataagtcacctgctgagctgacagcggaaacgaaggacaagcggagtcgcctagcgccgtcgctgcttagcccagaaaacggcctcgtcagcgccctcgacctgtttgcggaccgcttcaggagctgaaggaaccaccgaggttctgcggctgaggcgggaggcgggactggagacggggccgggcctgtccctccggatgcggggggcgctgccctgttcagccgcagggctctccctgcctcctcctccggccacccaggccggaagcaccccggcccctcctcagggactctccctgtcagtgagatcaaccctccggagctgctgtgtcttcacggagccgcagacccgggcggggaggcggggccttcggctgccgtggggtgtggggggccctgccctggccggggtgtgccgccggagctgctcccacccgcttccccgcttcaccccagcgcctctgtggatgccctttgaccgcgacccctcccgtgcggcggaagtgagttgctcccgcgagctgtttgggcgttttccacacctgcccatcagttacgcctctagggagctaatgtgtaggttcccgccgaatttcctcccttacttttccagacgcgcctgcttggcacagtctgccctgcgccccgtgctgtggggtcagaggtcactgccttctgcggctcccctggcagccccaagaccgtcggtcacaggtgcagcttctgcccccgatccacaaaacgggcgttaatctcaggcagcacagccacaagccagagctgttcttctggtgataccctgtgtcctggtgataaggcgtgtgagctgccccctgctcctagtttcagctccttggaggcgccccccagccgtttgtgtctctgtcttgccgccgccacactcatctgcgctgctcgcacagacgagattcgtcatcagtgtcgatggacggcctctcggtggagccgtgcagacagcgtggccctgcctgtctgatatctgtgctcctgttacagcaaactgttctagttcctgcgagaaagtcgccaccagcgcacacagccacgcctcgctgtgtgtctggagctggtctctgggttgcccacactccacaactgcaggctggctccaggcggcgctttctccgtgcaggcaccaggtgctgctcagggcatgggaagccaaacccaggtcgctccaggtgctctgggcctggagggctgcagggacagagcgccagggatgggcagtgtatgtggccaaagcaggctgtctcccattccggaggccagaaatggaggtcagggtgtcagcagggctggcttctctggaggcctcgctcctcagcacgaccacggctgtcttcgtcttcacacgggcgctctccctccgcgtgtccccagcatgactgcggctgtcttcgtcttcacacgggcgctctccctccgcgtgtccccagcatgactgcggctgtcttcgtcttcacacgggcgctctccctccgcgtgtccccagcatgactgcggctgtcttcgtcttcacacgggcgcgctccctccgcgtgtccccagcatgaccgcggctgtcttcgtcttcacacgggcgctctccctcccgtgtgggtgtgcagagtccttcttcctaacagcacgccagtcatattgcattagggccgcccaaatgccctccgctcgcttacctctgtaaagaccctatttccaaataaggtcatgttcccagggctgggactccagtgtgtctttttgggggagggtacgcagctcaaccctgggacctggtgcctccaagtcagctcagtgactgggcgggcgctgcctggccacggcaacccccacacacctttggcgtctgttccccctgcattctgcccccgcatagccctgcctggggagttccttctacacagatgcctgagatgagactagtgtgggttaaaatcgcttcaggtatgggaatcccccagggcttgaggctccttctagtccacctgccccaggtcacctgcccaacatgcttccgatcccattggggggcgactttctgagagatctgtctgtgggggatgccagtgaaaccatttaagacatgagacactaaaccagccttgtgaccatgccatttggggccactgttgctcctctgggacctgcttttgacgcgtccagtgtggaagccggacaccagcctcgcgctcggttattcagctcagcggtgggcagcgtgcctcctgagtggtgggtggggcaggtctcattttcatgaccatctctggatgtagcagggctttctggatatgagccccagcctgtcccagtctgcccagatgcagcattgtatgctgagctgcggaggccctgaatgacactcagctgactttcctaaatgttcgatgagctttatagcttgagctgagcatttcccaaaggcatagttggaagcagaatgtctgcctgctgactaaggacaggagcgtgtgggaggaagaggacctgccccttcagaatgcgttctgtcatcacgctgttgctggtcttcaagtgcccaggtctgcaaagaatcaagcccatgtagcttctcagagtattgaaacaaacgtggtccgatcatttattcctttgcctcaactatgacaagttcaaaggcctttctgtgtgtgagccgctgggatccctaagcagcactgacggcccttgctgacggccagcagccccgggatgtgcctttgcagccctcagacctcgatggacaccataaactcggagcaggagcttgtgggtgctggtgccaactgtggagcacatcccggaacatgttctctgctggagtcaggactccctctaggagcaagacaccggctccacctctccacaggccacaccatcaacatgaagaagagggcctcctgccagcataaatgactgagcctaaaccttcacagaaagcagaggcagttggagagcccgagagaacacctgagacccctgagtggaaggaaccccattgccgagttccgtgaggcccctgggaggagggaaccccattgccaagttccgtgaggcccctggactcagcagtggcttcacagatggcctcacgcatcctccaaacagcagcaccgtggagcccatgtgctggtgggaggcagattcttggccctgcagagcagcttcctgagtgtggacagcaagccaggaggcctgggggaatgccgtcctcagggatctgtgtagcaagacgatgttccgggcagaggagtcttccacacgctttcctcagatgcagtggggtgggcacgggaggttctagatcatgattaatgactataccgccgcgtcctctagcatgcttagctgggccatctcccaaggctctttgccatagtaataatcaacaagaaattgtgggatgtgtctcttctgttggcatctatgaaaaatcgctccatatgttctgccaccacggggcagcaagaacacgctttgccagcttggctgacctgcgcagttgggtgcgtgtccaccgtcatctcagccttgctcctcattgcttgctgcgtgccatttaccacaacagtgctgtgagttgtatgttatcatcctgcattctccgaacactgaacagtttacccaggatcgcccgctggcaagcagtggggctgggagtcaaaccctgtgctcccctgtggaccacgaggccgtggccacgtgaatcgttccatccttatgagtcttagtttcttcagcctaaaacgggaaagtagtccctgttctgtccgtggtccaggatggccactgggtccaggatgagagaagaggatctaatccgtgaaaatatggaacatctgagaaatttgaaatactctttttttttatatttaaaaaaaaatttttttgagacagagtttcactcttgttgtccaggctggagtgcaatggcacagtctcagctcactgcaacctctgcctcccgggttcaagcaattctcctgcctcagcctcccaagtagctgggattacagccgcccaccaccacgcctggctaatttttgtatttttagtagagacgtggttttgccactttggccagactggtctcgaactcctgacctcaggtgatccacccacctcagcctcccaaagtactgggattataggtgtgagccaccgcggccggcctgaaatattgttgaacaaggcactaacgcatgataaacacagtaaagggtcagaaaaggaacgtgcacagtgggttaatttaacccaatgacattaactcagttatagggccaggtgaaggaagactctacgtgagttcccacattttcctggcctctcagtaaattctcagactacggttttgatagagcacacccgttcttaatggaaacatgagccccaggctgttatgaattctcaccctgtggttcccgccattgctctgtgttgcctccccagggaggtctgatatttcatttgacaacagaagggagcagccttcagttccccgagcacaggccagggctgattgcgcgtgggcctgccctggcttcatctccagcctggggttggccttgagaggccccaggccacctgcttcccttcacttcatagaacacgaagacccctccacaggcctcgcacgtcaaggaaactgccctttaggggactcgggaactggatggcatcatcctatttgctctcaaaacatctcataaaaagtaagagaatcacaaaatagagattcgccaggcacatgaactctccgcacgaggaacggttgccgccccctgcaggaatcagagtccgccctcctccacagcctgcagcgtcccttggccctcccaggatggctccaagcatttcccggaggttccaaatgaccccatattacaaacacaatgattttgctggccaggcacagtggctcatgcctgtaatcccagcactttgggaggccgaggcaggtggatcatctgaggtcaggagtttgagaccaccctggccaacatggtgaagccctgtctctactaaaaatacaaaaattagccatgtgcagtggtgcgtgcctgtagtcccagctactcgggaggctgaggcaggagaatcacttgaacccgagaggtggaggttgcagtgatccaatattgtgccactgcacttgagcttgggtgacggagcaagaccctgtctctttaaaaaaaagacttcgctggtaatttcaaaagcaatatgttgacacaaaatcaaatatgcgatcaggaagtaggagctctccgaagtcatggaagccgggtccttgactcagtgccatctttaaagggtgacctcgggggaaatgaattcggctaaaacaattttccaccaagaagcccatggattgtccacttgccagcagggctcaggtgcccatggcagattccccctctgccatcgagaggagagggccgggctcgtagaatgcatgtctaactccccaggactcccgagctagggaagcattttcttaattttccaatgagaaaatccagctggcacttgtctgctgagtccaatggcagtggccactttccccgtggcctgttgctcacagggcctggcagcagggacccctcagctgaggaggagctcccagcacgctgccctgatgcctcctctgccctccgtagaggccaggccactggtctcagggtgccgtgggcaccatcaaagcacgagaccaagccaggtcaaaagcctgagggctccaggctgcgctgcctgttccctgccctgctccctcctgaccctgctcttggtaatgccttctcagacacgtaagaacggtccgcagttgctggtctcacaagtgcctaaaggtggctgtgctgaaaatgaggcagggccctagaggcccctggaagcagccagaagcccctgcttttattcccacgctctgtgtgggctgcagcaccgggcccagcccagcacctctgaccacagcctcatctctggctgcggtgtctgtgtggccccactgtgaaactgggtttctggaatcaatgtttggagtagtgtgtgtggggtgttcagatgtcagagtcaaccagtttttttctgatgatttgtattacaatttcctgccactgccaattttcactctccaagaactaatttgtgcaggagctaaaagccattgagtccctgggatttttgcatcattcacaccttcgttcagagctgatgggatgacttgcagcttcatgacattcctgaggcattcagctgcatagagcatgtgcgtatgtacacatgcattcttctcctctctctagatgttttatcttatcccatcttgtcacccctgaaagaggctgacattcctacctgaaggaaggtgtcaggacagcatccaacctggagtgtattgatctctagtgcacagtactttcctagttcaatcagttaaaacactcactaagttttccaagccctaggatttgttgttttaaaaactgtaagtaaaatctccaagaaaaatgaaagaattgcgtagagaagcagagtccgtgcagcttcaccaccaccacactgctccatgattggggccacttccttctggtgccagcgcccacaggaggtgcgcagcgagtttggagtttggccacaggtccagaggggacccacggccaccaagcactggcctccgagggctccagcgagggtgcttttgttttctcagaaaagatggaaattggtgttgtgtgcagcaccaagaggttttccctgggacaaacggcagcagagccgagatgttgttgcttccagatttcagccagggatggcagtgacaggccctctggagtggccactaccatcacaccagctgcagcagggaggcgtaacctgggcatcctgttccacgcggcaggcaggaccccacccccacccccacgctggggaggagctacagctgcccaaaccgtagctgcagacccaggcagccctgcacacttaggcacccaggaagaagatccttgcccctgcaggaagtgcctgttcctgctacctggattctccctgctgttggcacccatgctgatcttggagcaaagtcagggctgagcccgggcgctgtcacagcccagcaggtgtgacactctgggcagtgctgacacaccagccccctgccacctcagccccctctggactttgggcaccaacaagcatgggagggaagccgaaggagggctgagggcagctcagctctggcctgcaggtgccccttggcacaaacagcctgggtgccatgaatggcagcaggagacagagattcctgggcaaaagggggcaggtcctccatgaagcaccaccttcaggccagggagggtttgaaggctgggggctgggctgcaagtcctgtggatcagagtgggaactcatggtgccttttccaggcctgcccacggccactcgtgggccaatcagcatgtacttcctcccctctgaggcccataaatgccccaggcatagccagagctgggcagacatggggatgaccagctgcagagaggagctacccactccagagcctcccctttgctaggagctgaacactcatcgggaccccctggctgcagaaaggagctgccccctgtgggagactgagctgttctattgctcgataaacccctcttcatcttgctcatcctccacttgtctccatacctcattcttcctggtcgcagaacaagaactcaggacctgtcgaatggtggggctagaagagctgtagcacaaacagggctgagacatgccccctgctcgccacactgtgggtgaagagaaggagagaacagctgtagcccttcagggagcccagacctgggagctcccggagctaggcctgtgactccatctttgggaccctgtggttcctggtatctccaaacttccaggagctaccatgttcctcagtgtcaaccatggaagctgcttgcagtgtgtctggtctggccgcagcctcacagagagcccgcacccatgctggcacctggagctgcccaccctgctgcagcacccagcgtgcctgactggtgtggccagaccccgtgctcctcacacacccctcgccactccatgcctgactcgcccttggcaggcatgggacccaggctggtagtgtgagccaaacgtggcctgccaggcccagcctgagcaaaacttgggcaaaggcgccaccggccacagagatttctggccagaaaaacaccaccccaaagatcctgtaacacaaagcgcaccttgcagagagaaggaagcggccacacaccagggagttgggaggtgcaggaggggctcttgcggcttccactcctctgtgagctctgcttgtcgaagtttctaaaaacagagcaaagaggagggcggccacagcaagcaggatgggggttatcccagaaccaaagccaagacagctctcatatcacacacgtcacaagtgcctactgtccccccgctgcgcccggcttcagcagccgtcaggttactctgtctgtccgagcgagtttttatgccagtctccaccagtacatttttcctccatttcctctttatctgcattttatttgtctcttactctccttttaaaactaaattccagtaatcttgaggacttaactgttcattgactatgaaactttctattttgaaacgcgggcgattgcttaacgttcatatttctgtttacctgctgtgtgttgccaagtgtgtctgtgatttaaaggccagcatggtataaaattctgcagaggaacccctgaccttggtgtgtgaactccacgtgggggaaaacaccaggatatctccattctgctgagcgggagctttgtgccagttccccacatgccgttcgtctgcctcccacctggaggatcacaaacggaggggaggatgggagcaggaacattggaaaccacattcagaagggtgtgagcagagtcctgggagaggatgcgggtgggccctggagcccgggcaggggtcccacactgctgggctataggccctggaggctgtttgggagtcccacactgctgtgtgatggaccctggaggctgggcaggggtcctgtgctgctgggtggggggccctggaggccaagtgggggtctcacactgctgggtgggccaatgttcctctgacccctgcactgtgtccttgcagatgaccactcccgggtcctgctgaaggcggagaacagccacagccactcagactacatcaacgctagccccatcgtaagtgcactgccgggacaggggccccaggctttcccttgggtggcacggacgcggcaaatcacgtgggaaggttctcgggggaaatcacgtccccacccagctcagcgtctctgcggtggacagggccgactctgcccattgggctcccgccactcccctgttccttcaccagcggggctgtttatgagccgtgtgggtcccggctcacgctgggcggtgggttccgtgacttgtagaacatccagcaatggtgactggacagtttcctgactagaagacatggcttttaggagaggttcgtagtgggtgccgttcctctttcctggagctacacattccctgtatattcatggggcatggggacatgaggcctcagtctacgctttttgtaacaatcagtggcttggaggcaggtccagaatttcaggttcgttttcctgaagtatttccagtgaatgggaccctgtttcttatgaaagagaccgtttgctggctgttcctccccctgggatagacgcaggtgcagtggagatcgggctgtcctgtgtttctggggacgagtgtggtggcagctcctgtgccgtgagttatgagtccctgtggcctgtggtccctcacttcccaggggctcctctcagcccatgctagacgcggctctcaccctatttaactctgggcatcccccttccctgtcatgacctgtcgggggagcagggctgaatggggaggtttgcagccctcccagagtgagcagaggagggagagatatgagcatggagagggctgaagccacaggctggggacactcggactgggtgttcagatgagcagtgatggtggcaggtggcgggggcgggatgggacactgtccagggccggggctttggagacctggcggatggcactttaaaccagtggtggagaggctggggctccatgcagatttatggcggacactggttgtcatgtttccccctttaaacagctcttctcaattctggtcttcagggaaggatgaggacatctcactaaaattccaaatttgcctttaatcaaacatggtgcctgcaggatgcaatgctgttctagggctgagtgagacggggcaggtgatcgaggcacaaatcgcaccctacggtgtcccaaagtttctttgctcgtccatagggagctttggatgaaagtattggcccaactgcctgcaggccacggccactgatggcggacagtgctcagctctcggctctgctgatctcagcagccactgatggtggagggtgctcagctctcggctctgctggtctcagcggccactgatgacggacggtgctcagctctcagctctgctggtctcagtggccactgatggcagatggcgctcagctctcagctctgctggtctcagcggtcactgatggtggagggtgctcagctctcagctctgctggtctcagtggccactgatggcagacagtgctcagctctcggctctgctggtctcggcggccactgatggcagacggtgctcagctctcggctctgctggtctcagcggccactgatggcggacggtgctcagctctcggctctgctggtctcagcggccactgatggtggagggtgctcagctctcggctctgctggtctcagcacacctgtgggataaagcacgctgggaagatgtccacatgcctgagccagtcccgttttcccgcaattcgtggcccacacagtgagcatgttcagctttgagagactgaattcaaagtgaagaactggcctagtgtacttggtctacaccacctgaacccaggtttctgtttatgtgttcattcttaagaaggaatcacttccttccttccagcagaggttgactcccaagcttggttccgtgtgggtttcaaagatcctcattcatcttccttaataagatgtgatgcacatagtatttttctgtcatcaattctaattcaaaaacatcaaaccaaagcctcgctgatgtgccagcctctcacttgatgaacagaacgtgcgttctggtaaagccaggtgtgcgcgcctggattccgttcctgtactatgtgcagcagagttggcaacacgaaaccgtccgaaggaaaagaaaagccatgttgaggtcccttttccctgagatgaaccatttgatgaagccagaatgaggaataaagccgtgattcacaagcctaaaagacgagagttcagcgttgcagctgggcccactctcccccactcgatgggttccaacttgcagatgtctgcgctattccaggccacagccaagccccagcgtgggcagcagtgcccagtgcagcaactgtgtcgagctggaaacggtggacagctttcatcccatgtgggaaccagagggggtgtgtgtttgggggatgaattcctgcacattcatgcaactccctctccaggccttactgggcaggagcttgggtgagaaggcaaggccaggagggagaagtaattttatggtacattttgtgtctttcctttatttcataccacaattcttttttttttccaaatttgggttgtaagaatgaagcagaagaaatcgatggtgcctcttctttatgaaatagctgaaggtacaatgataattaccttcctagcagcagctgaatgaaaagctcacaattacagcaaaggaaggccctggctgtgcaggataaaactatgataattacatctgtcatatttgtacttagtcctcattacatttcagggaaggcatccagtggtaaataatgtgcaatctttgcttttaaatcagaggtcatgaaagtcaatgggaattctgttttccctcgtaggttgtctgagagagaaacccatgagctacatttaaaacagcctgattattactgaggacaccaagttgaggaatggtgttcacgcaacagcccactcaaacacagcacacaagctttattaccaggacaactctgaaactcccagtgacatgtaaaaactagcttaattcttcatttcactgtctattaagggagaaaaaaacatcatttaaagttttaattcagaatgcatttaactatgtagggacagagtggcttttcagaaaaagaagagaggttggatgttctgactagcataagaaattggccaaatatgggaatcacttcagttatttacaaccaaaattctgtgtataataatggtttatattcagtattttacttaagtaaatctcaactcctaagaatacgatataaaaatatttcaagttcaaaagtcaatctgctgactgggtgcagtggctcatgcctgtaatcccagcactttgggaggccaaggcaggcgaatcacttgagttcagaagtttaagaccagcctggccaatatggtgaaaccccatctctactaaaaacacagaaactagccaggcatggtggtgcatacctgtaatcccagctgaggcagaagaaacatttgaacccaggagggagaggttgcagtgagccgagatcatgccaccacactccagcctggggtaaagaacaagaccctgtctcaaaaaaaacaagtcaatctcccattgattactgaagctacaatttcccaataaattcccatattaagccttagtatttggaaaagagacttgagaagtcaaatggtggttttcaagaaagcgtttcatgcaatttgctttaaatgttaggaaaggcaggtggagatgtgggcaggtggagatgtgggcaggtggagaggtaggcaggtggagaggtgggcaggtggagaggtgggcaggtggagaggtgggcaggtggagaggtgggcaggtggagaggtaggcaggtggagatgtgggcaggtggagaggtgggcaggtggagaggtgggcaggtggagaggggcaggtggagatgtgggcaggtggagaggtaggcaggtggagaggtgggcaggtggagaggtgggcaggtggagaggtgggcaggtggagaggtgggcaggtggagaggtgggcaggtggagaggtaggcaggtggagatgtgggcaggtggagaggtgggcaggtggagaggtgggcaggtggagaggggcaggtggagaggtgggcaggtggagaggtgggcaggtggagaggtgggcaggtggagaggtgggcaggtagaaatacctacagatgaggtgtgtgcttattctctgtgcaagatttcagagtaaagacgtgacacccatgcccttccccaaagctggccagatcctcttaagatgttaaggtcacagctgccagaggccggggctggtttgggagcagaaactggcgttcccttcacctgccccgcagtgggtgcctctgccaccatggaggctgttgaggactgcaggacacagtccagtggtcctgacatgctgagtgcttcatttctaaaatgagctttgtttggaatattggggaaattgtggctaagtttttcatgcagattagggtttctaaagatacttgtttagtaattatcctctgatagcataaggcacatcactaggccatctttacactgtgtattcagagagacagaggaacacacctcactagcatcctagttcatatgacatcttcataagaatcagtcaaccaagggataacagagtcaacacagacaaatgggctttatttttattttaaaaaagtaagccaggcgcagtggcttatgcctgtaatcccagcactttgggaggccaaagcaggcagattgcctgaggtcaggagttcgagaccagcctggccaatatggtgaaaccccatctctactaaaaatacaaaaagtagctgggtgtggtggcacacgcctgtaatcccagccactctggaggctgaggcaggagaatcgcttgaacccaggaggcagaggttgcagtgagccaagattgcaccactgcactccagcatggatgacagggtgaggctccatctcaaaaaaaaaaaaaagtaaaaacagaattatactgttaattgtacttgccttctggctgttgattttcatgaagtcacttggagtgagtcacactggattctctgtggtaccggcctctctaggcgggatgtgttgctgcagaagcccctgtctggggagaaagcgctcagaaatgaccgcacctcgccattcagatgcttggccccgcacaccactggaggacacagcagctctgtgcttgaggaagcagcatccttccttccttctgtggttcactgaggacagcatggacgcgtgttcacgggccgcagaccgcctgacagcttggcgttcacctaataaatttacaggttttcacggacagtttcgggatgaccaacaccaggacacacacatacacacagacgagtctgcacatgcacgtgcactggaatccagagctaaaggacacttagaaaccgcatcatccaagctcctcactccctgagctcacccaccatacagatatggagactgaggcccggagacgccgacgtccaagctcctcactccctgagctcacccaccatacagatatggagactgaggcccggagacgccgacgtccaagctcctcactccctgagctcacccaccatacagatacggagactgaggcctggagatatgacaggccttttcccacagccgggcagtttgtgtcgggaacataacagtcatacaaataaaaagtatgttgcaatgaaatggaaagtcatgagtaggaggcgaagggtaagaatgaagaccggaggaagccagagtaggtgccgtgtgatcgctgggtggggaagacagagggacacacacccaccatgtccggttgtcacgcagatgccctcattggaaaaagcaatgttagtagaaactcacttgatttcctccacagccacttatcctgcccgaaaaccttaaatgtagtaaaatctctgtgtggccagttaagtatttgcttgacttttcctcgaagcctgcgtgagaccacaaggaggctgcctgtggcctttgcagttgctgcttccacaaaatccttctgcccagaataattttctgttcaacagaatgtgcctggaattaaatgaatgtaattgtctcctgaattattgtgaaaccgatgacacatgtcaccactcggatcatcatgctgttcccgccttcccagtggcccccacaggacggcaggtgggcgggagggaggtgaggccggtccccactcagtctgcacagcccacacttcctgttcagccatccccctcccagcaccctgactgtatttgctcctgtcttaggcattggagcaggtgatgggtgtgtggactttaggacaccttaacaactcagacctaaatcaacagtcaccttatcgaccctcctgcaaccctgtccagcattttactttcaatcacctatttctcattttgaaagcaactaaatgtgctagtttgaacatgcttacaattttaaaatgtgttgctgtagaaattgctctgggcaaaaaaaaaaacacacacacacacatttcagaaggaggcggggctttccttttcatgcattactatttgcaaggaagagacaggggtctctgtaaatagctgtcacccccaacaaatgcatatttcaaaaaatcaaaacttatttctgctaagcatttttctactgaaacattctaattggggctttcagcgacggtaacataattttacctgtattgtgtgtgttgtggcgaatttcaaaacgaggtccagttttaattacgaatcactaaatcagatgcacaaaaagcttttctccctgcttccccccagcccccggctagcgtcaccgtgttgttctgtgagaataacttacatctgttcctttatgctcgcccctcttttatggtgaacataattataaggtgcatttggtgccttcttttgtgctgacagccatcatctctggggctggtgacggctgcacggggactcactggctcgctgttaaagaaaacgtgccccacgtcagcttcccaaatgcagcagcacttaaggtagcaccggggccaccactgatgtcctcgtgcgttggcttaaaattgcatagggttaaaatttgctcatttttcactgtgttgagaaatgttttcttaataattaccttgaaatctgaacattgtaaatctcgaatcaaaccctgatagcaaaagagtccattttagtcctagacacaatagaagaaaggactgtgcgtcagatgcacaagcggctgcctccccaaggtgaggttcccccagcgcagcatccggctctccgggggtcggtctctgcagatgcttctgggaggtgtggggaggagctggtgagccctggggatgatagtgatgtcctggtatcttcgtgtcctttgcagggtggcctgggcttgccctctggaagacagaaccacctccatctgacgcccctcagcaatgtgctcaaatctcgcttgcctctcaaggctttgtcctcaagttcttttttctgtgcttaatcttcgaaataaatgtaataattatggtcttctaagccaaccttctcccattggagctagcaagatgcgttcggacaaactggggagccggagagcccacacctgccctctttgtttctggtccctgcctggtggggaaacagaacaggaggccactcccagcaaggcccttccgccccggctctgccacagacccaggcccaggctgaccggctgtgcctgtgccccctttccaggatacacaaaaacaagcccccacacacaacgagttaactccagcagggaagcagcaggtagcgctagttcgttctcccaggacgctggcaagtttgtccatgaggcctggaggaaccctgttcacactctccattgagagcttggagctcagcctcaccccagccagccctgtggctctagcaagaggctcgttctcctgaacacagggcagcctgggtgggctccgtggccaggaagctctggggtcacttgcaggctggaaagctcatccatgtcatggggtcgcacctgctgagtgggctaacaacggctgcctgccctccttgggctactggtcttcatttctgttgatgctgctcttagaacctcaacctcaggtataaggaaagcatttcagacgcagtggttcaggctcaaggctcgggacagctgggtccctacctgtgccgggtgctcgtttgaatcaacaaagggcaagttgtgtgttgctcagttcaggagatgccacctttccctcttcctgaacccaggctctgcttcctggcttcctaacctccaggctccctaacctctgggctccctaacttccgggcttcctaaccaccaggcttcctaacctcctggcttcctaacctccgggcttcctaaacaccaggcttcctaacctcctggcttcctaacctccaggcttcctaacctcctggcttcctaaccttctggcttcctaacctccgggcttcctaaacaccaggcttcctaacctcctggcttcctaacccccaggtttcctaacctccgggtttcttaacgtcctggcttcctaacctccgggtttcctaaccttctggcttcctaacctccaggcttcctaacctccaggcttcctaatctcctggctaaccgctgtggtgtggtcttgtctctgcagatggatcacgacccgaggaaccccgcgtacatcgccacccagggaccgctgcccgccaccgtggctgacttttggcaggtgaacatttttaaattaaaatctctctttctgaaaagaagatctcaataactgggtcacgaatcatgtcttgaatctgattaggccaatcaaacttcttacaaatgctcatcaaatgttacttatatcagaatttcagtctgttcatattttttattatcaatcttttgttttccaaaacttgagtatgaaaaaattccctttgagagatttaatgctttcaagatcattacttttaagccactttacatttgcattttataaaacagcgaggataaagttagtaagtcattccatgttattgaaatgtgcctgttgtccatggcgttgttatgatggcggtcacagcaggacccaagtacatcctctgtcatcctctcctggagtcctgtagggcatctgaaggccaggccgtgcttctctactcgacgcaagcccaggtcacacagatgaaggcacagacgtgagggctgacgtgaatgtcaaacatcagcaaatagagcaacatgcagagggcaggtggggtcttccttctccagctgcccccgggtctcccctcaccagccacgtgacaaagctgaataggaatgggttctggaacctggaacgtggccgtgagttaccgcaggagcacaggcaccggccgcgtgtcgggcacaccagccaaccccgagcctggcagagaggagctcctaaggagagtcgagctggggacgaaggtgggaagcgacgcgtcacccatgcggcagaatccaggcagggaggtgcctgtcgcagcagtgacgctgggatcaggctgcagcctcctggcgatccacagcccgggcctcctggtgatccaaagcccgggcctcctggcgatccacagcccgggcgcctgtgcagcactggggtgagacatttcctgatgtcgctgtgcaccggagttggtaaattcacttctgccccaggctcttcctattccctttacttccctttcctggctttcccgtcagcctcgcgtgactccgattacaggaaggggagcctcctctctctgcccttgagaacagtctctgcagggctttccagaaaagtctggaacagatccgggtttccgagggcctccgagcacccttgcatggtgagcatttgaatcctcaggtgccatcatcccattttatgggcaaggcacatgggtattggagagatggcatcacttacccaggacagctcggatgacgccaggatctgaaacacatcggtatgacctcctgccctttgtgtctgcctgtgtcttcacactattgaaaataaataaataaaactaaactgcatctctgtgtgacgttgttgaagcttgtaatcccggcatggcacggcgaacctgtggcacttggatggttttgggggcacttgggctccctacttgtcacagctggggagtcgcccagcccggtgagaacatgcctttcccagagaagatggcaccctggggcccatcgtctcgggagtttcgtggtaggaaggtctttgcatggcacacacctgccttcctgaaacatggacccatccgtcccagcgctgcccttagaatggagccccagggcccttccagggatgccccctgctgtgcacgctcaccccggcttctcagggaaaaggacagagtgttcagaattggagggcgggcagagaatacccacggagtcctaataccactggagttttcatccacctcaacccattacccaaaatgtgcttatttgtgtggcatggggtgcccccaaatatgtgttctttcatttttatgagcccttgggcccccacagcccaacatcaacttcatctcctcacctgtgcaagacttctctgtccagcaaagccacagggtctggagggcatccacactcaatgaccacgatgatgcccacatccaccctctgttcagcaggtgccacatccacccaccatcctgtgtgaaggctctcggtgtccacgcgcaacaaccatgatgatgcccacatccaccctcggttcagtaggtgccacatccaccctccgtcctgtgtgaaggctctcggtgtccatgctcaacgaccacgatgatgcccacatccactctcagttcagcaggtgccacatccaccctccatcctgcgtgaagcctctcggcatccacactcaacgaccacgatgatgcccacatccaccctccattcagcaggtgccacatccaccctccgtcctgcgtgaagcctctcggcatccacactcaatgaccacgatgatgcccacatccaccctccattcagcaggtgccacatccaccctccgtcctgcgtgaagcctcttggcatccacactcaacgaccacgatgatgcccacatccaccctccattcagcaggtgccacatccaccctccgtcctgtgtgaaggctctcggcatccacgctcaacgaccacaatgatgcccacatccaccctcggttcagtaggtgccacgtccaccctccgtcatgtgtgaagcctctcggcatccatgctcaacgaccacgatgatgcccacatccaccctcggttcagcaggtgccacatccaccctctgtcctgtgtgaaggctcttggcgtccatgctcaacgaccacgatgatgcccacatccacccttggttcagcaggtgccacatccaccctccgtcctgtgtgaagcctctcggcgtccacactcaacgaccacgatgatgcccacatccaacctccgttcagcaggtgccacatccaccctccatcctgtgtgaaggctctcggtgtccacactcaacgaccacgatgatgcccacatccaacctccgttcagcaggtgctgggtcctacatgaagctctcacatgctgacctgtagtctctgtggtccgtgagactcagaggctcatagcgtgcccagattcctgtggctagtgaatagaaggcgtgaaccatttttcttactgtttattatggatagttgcaattgttggaggcaattcatttgatcagtgtttacatcttatgggctattttagagtgataatcaaggagcatatattcttgaaattgaaatgatgcatctctgtatgaaataagtagagacaaattttaaagcaaggtgaaatgcaagataattttgagacacatctcggacagcaggtatcaggtggttccaggaaaccccagcgtccctcaacctggtcacagcttttctaagacaagagctcatggccagtagcctcagccctcccaggatgttctcgagcatgccagccgagcagagcctctgagaaattgtgaactaaagaaactcgcttcattttgctccctgcagacgtccctgaccacgacgtcattgcttccacgtcatccttcaacctggggatccctctgtgcagaacacaggagctgcccaccatcgatgccataaatccacacagagcaggatggaggagagttgcttcctagcacagtcacatttgcctgggaggcctctaaaccgtgtgttttagaatgtcagcatctctcaggcgttgttcttcattgaatacttaccagtaagccccaagattgacattcttaaaaattcaaagttagggttctctttgccctctctggcttagcagaacgcaggcagaggaagaacacctgtctttaaaacctcccacggaaggcagaacttttccaaacccacggtaacgtgtatttttaaggacaaaggtggatttgaaatgcgaagttggtgatgacgaagtcaacaggctgagttggagtgaccgtctcctcctgcatccccattctggaccattctcagatgctgaccaaggatcgggacacagactgaaggttatggatcatcccaaagcaccttccttttatctccggctgttgatgctgatctgaagctcctccttggggcaggtccacaggtgtttcttctctgtcggtaatcagcaaattccaggaagaaagtgtgagcgtgagaaaggccgtgatgggaaagatggccgtgtctgccccaggcccgtgcactccttgggggattcgaagtgtccccctcatctctgcctccctgtcacacagcttttccccaccgtggatttatgtcagggtccaaatttccctcctcttctaaggatgtcagtcattggactgagagctcatcctagcctgtgtgacctcaccttaacttgaccacatatgcaaagaccctatttccaaataagaccacattcatgggttccaggtggacatggatttgggggtacatgattctacccagtacaatggctaagaagaaaaaagaccttttccaagcagctaattggcacccacatgacatggtgatgggtcaggagtccgtttggaggtcactgggctgctgggaggcagaggagccaggagggccccaagttcctcagcaagaaatgctgtacaggggcccatgggtccagaaggggggagcctggaagacgggttcaggggaagtcccctcggtgagcatggggcatcgaggtcactccatgctcaccagcctctcccccagcatggcaccgcgaggccccatcagctccccgtcccgcagggcccacagcacctctgtccgtgctgcgtccctgagcagagcccagaacgtgcacgaaaatccacggagggtcaccactcactgcacacatggtgctttcctgcagtgaaccagctctatatggacactggatgcatttcaagaatttgatttccaaaatttgacttacatcaagaaattcctaaaaataaattcattacctaaaggaagatgtaccccaaattaattccttgtctgtgagtgctctccaaatcattcggctgaattcctggtccttactccagctcagaggggtctgtggaagtctgagttacagttcagaaatcagtgttactagtaagtagtaaactggcctagaaataaaacatccctcaaggaaagaatacccattttggggtgagggtgtcattttgtcatataaactttttttttaaagtgtggaacaattttaaaggaagaatggaaagaaaacttaagtatgggccaatcttgtgctacattatttgaagtcatatcaagatcttaggaagaaacatgtccaccgtcctctctgctggtcattctgggatgatatctggaatatgatgttccttctgcaatcataaattcaaaaagggtgctgacattcaaaacacaacagaaaaagaagccagagagtttggtggaaacagccggggtggtgagagttttgaaaatcactgcaggaggcagaaaaagccgtcctcggcatagagcaccacccacaagctccctcttcatccacgccgccgctgtcagcccagacgtcacaaggaaacttggcctcggctggcgtctggacttggtggtgcgtaaaactttctttttaaaatcctaattttctttttaaatcctaaactttctttttaaaatcctaatttaaatctgaagaagggttaagaatattctaataaattttaaattaggaacacgagtttggctgtgaggttttactgttttgttcaatgcttctaaataaggagtcttaacacctcatacccatccgttgacacccccaggcgttgagctctggttgctgtcaacaagccgcttagggaggaggctgaatatcaggaaggaagacgagaggaggaggcaggtctccatggtccactcctggatccctgcggctttgggtacctgtcagatagcctttctctagaaagcctttctctagaaagtgtattttaatctgcaaagacgcctcccacctgccaaatggggccaccttgagtgaaagacacgcacccattggaggggacattcgagtccagtgggcataaggaaagggggctgggggaagaaaggaagtcccatttactgagctcttcaatgccaggccctgggcaggcacttcccatatgggatctcatttggccgagccattgaccctgcgatgaagccatcgtgagcctcccatcattccacctcatggggtccccggaggcgtcagattcatagaagcctagtatgaatctagggggtagtagccaggggctcagggaggggacagtgcagaggggcttgatggtgacagggcttccatttgggaagatgagaatgctctgaagagcgtggtgacggtgacggttgtagaacggtgggaaggcccttactgccgctgcactgtgcacttacaaacggtaaattatatgttaggtatcttttactacaattaaaatagagatatacagagtgagcccaattctacccaggatgaagctgtggcccagagagccataaggacccacccagatccacacagctggtgggaggcaaagcccattctagacccagacatgtgtagtgccagggtgtctcttcagcatacacactcctcacagataaagaaggcacagtgacatgaagacgtctctataaacagaaaagagagatccggcagcagtgacctcggcatttccagagtaggtgttgtttacaaaaatacacgtgtgcagagtctcaaggcgcagaatatgtgaaagtcaaagtcctcagagacaggagataaagtgacgctttctccaggtgccgagacttccccacggggaagcaaggtctgcaccttcccggggacgtggccccacagtgcgtccccagcccagtcatgtcctggtgcacagggcagctgtcgcagagaagcccccgcaggcaggactgtagctggatcacagagaagcccctgcgggcaggactgtagctgtaagattaggactgccggggaggcaggggaggggccgcgggcatcgatattccatcacggaccacctccctactgcctgcacctgctgcgccaccttctaccacaccctgtgctacgcggctcgagtcaaccgaagggagttggccacccgccatcccccctttcctatttttagaaagagctgcagaattatgtgctcttcttccagagagagcttctgtgtgtcaccaccaaacactggctgtgcccaggagatacacaacagctgtttctaaaccagaaatgtaggcagcatagtctgtcaccatcaggtgcggagtggatgtctgcagatgtgacatggaaagccagggccctggagcccaggcacagggacagccaccacgggagcccaggcacggggacagccaccgcgggagcccaggcacggggacagccaccgcgggagcccaggcacggggacagccaccgcgggagcccaggcacggggacagccaccgcgggagcccaggcacggggacagccaccttgggaacccaggcatggggagagccaccacgggagcccaggcatggggacagccaccgtgggaactggctccctgtatgggaggctcagccaagaggacaactccaaagttcagccttgcctctcctgtctgatgaacaggctgcctttcaggacagagtcagacacgaaacagctctcctggcccccagagagagcacaaagcgctcgctgaagtcagcaggtgtcccactggcatcggatgtgtgttgactcttattgcacatcaacattttaccaagaaaaaggtgcactttcaatttctagtttctgctttctaaaagtattctgtgatgaagcctcagctggggggatatgttttctcatttccaaattgataggcttgatgtaaatacagctttttattatttggcatctgtagatcatagttcttactatggttaagaaaaaatcctgaacttggaactgtggaagacccaaagaatttaacggtgtttccttccaactgcctgccagccaccggtgacaaggccgaggtgcaggagaatgacagttgacagctgactgtcaccgtgcagggccgcccaccacccggcaccagtggctcgtctgcctgtctgcctgtttgtctgcctgtctgtctgcctgtctcgctgtctgcctgtctgcctgtgtgtcttgtctctgtctgcctgcctgtcttgtctctatctgcctgtcttgtctgtctgcctgcctgtctgcctgtctgcctgcctgtgtatctgcctgtctgctgtgtcagctactgcactagtccaggcaggggtgggtgggaagatggcaggcctggattccacaccatgcactgtctctgggcagcttccttgatcagcccaggatgaccactgcaggcatcaccatcagcaccaccagcaaccaaacctcagagcatccagagatgaccctggcctggccccggtggaggggatggtcctacaccacctaatttttaaaaacatttaaatcctccaaagatggcatccgctcagcccgagctggttcacggcccccagctactcacaactgttttaatgttccctcggcatgtgggaggcagggccctgagtgtcccggacagaccgagtgtccaacagcggggaccctgagcatccaggacagacccagcatccagcagcggggcccctgagtctccaggacaggcccagtgtccagtagcagggggccctgagtctccaggacagacgtggcgtccagcagcgggggccctgagtctccaggacatacccagcatccagcagcaggggccctgagtctccaggacagacccggtgtctggcagcctctcctttctcgtcagatgtgtccagcctgggaccacggtgtctgctctgggtccttggttaccttaagtggtctggctccaaaagcatgagaatgtcccccagtccctgcagctccctagtgtgggtgaagactcagcttgctcatcatcctgttccaccccctggacagtgactggtgcgagagggaaccgtctgtggatctcactgactctggagtgaagggagagtcaggaggttagcggggggaaatgacttcagaggctgctacgtcacagatgggttgattttaaggcacgttacttgattaaagggaagcatgagagttgtgttaattcttaggaattaacatgagagttgtgttcattcttaatttcttaggaaaaacttgatttttcatttccatgattgataagtactttaaccacatgcctgagactttccaggacattgttatatttcaaaggtttggtcttgctggatttttttctattcataaattcacgaacctttaaaggtgaaagaaactgtttctcacgttgccttatctaaattttgggtttgaaacctatgacctcaaagcttgtccatggttctgcctgggacagtgcaaagatggtcggtcagtctctcgccgcacacatgcggaatttaaaatgggactcaagtagaaaggacaggtccggctttcctttctgactgattcttactgctccagctgagaacagcaggctctgctgctcctgtgtgtgattggttcccagcctccggccagctcctcccatccccactcctcctcccctcttcctcttcctcttcctctcttgcttcacaactggatctgatgcatttatgtcaggtcctgatcttgaaaaggaaaggccgcccagtgcagcagctccccgcaaggagaccaggcgcatatttaaccgggaacgtgagcacaggcagaggccacagggagtctcagtgacgcctgtgccaggtgacttcctgtgcgggtccaatgcctgatcacaaaggcacccacggtggtcacacaaaggccgggtggagaggaagtccagtgtgtgagtgcattcccaccgtgggaacccctatgcggcaggatggccacaccaagccacacggggtctgcttgcacacaagcaggctgagtccttcccggagaacacagacccgactttggtggagtggcaagtcctcattctgaggcttccccttcctcctgggcagcaatactgctggtgttctgaggcttccccttcctcctgggcggcaatactgctggtggaaaagtcccagaggttgctgcagctgctcctcagccctgggatggggctacaaggcagcacaggcgtcgatctgatagcggcacaggggggttcctcccgctgccccctcatcagcctttccatcagcactgctgacgtgtgtgtgggctacgtcacctcatcgtgtcatccctaaatgaatcccacactgagatatttgtttactaaaaaaaagccaggtaggtgcaccatgagctggtcatggacggcatcacgaaggttttgtcaccctgcgttgggttatattaccgtgtccaaatgtgcgtgctgtggcctggagcctgtgactctctcggaaccagagccgcaaagcctgaagcttcatttcttaggactgtcctctgggcagggtgagagcagagctgaaggtttcccctgcaaaagatgtcacacacactatttcttcctctttaatctgtctcagaccacacagtttaacttccaggcatcggtgagctcctaaggagtgaaatacgagtgttttcccattaactgactcctcatccttttaaatttagctgcatcttctttataagtctaaacctctgttcagcccacgagaggacgctcacaacagaaatgagcagaaatgagctgtgcagcagaattgcgtgggccccgcacctgctctggaggaaatgcatcttcatggcaaccgcttcagcgggatgcagttaccatgcttgtttttttaaaaactgaacacttgtctgtacatttaagcaagtcctggaggacttctgccatgcaagcctttgataacattttctttcggttatctttttttttacataaatatccaaacggcctcttagaaatgtgaattgttttcaatgaagcatctgttagatgccatggagggtagaaaaggtaactggactaggatggagtctttaaagagatgatagtctggtagaggaaagacatacgggctaaagacaagactaacacaggcaggaagggactcatcacaaaagatctaagtagaaggaggagaagctttcctcctgaaggggcccagggatgttttgtagagaaaatggcctggcgtttcactatttcagttttttgttttgtttttcagagatgggatctcactatgttgcccaggctggtcctgaactcctgggctcaaatgatcctcccacccacctcagcctcccaactagctgggactacaggttcacaccaccacatccagctccagtgtttcactatttcagattgatcatcttcccttaaatcaggtctctgtggggcttcaggagagcttattttaagagtgtgtgtgtgtgtgtgtgtgtgtgtgtgtgtgtgtgtgtgtgtgtgtgtgtttgagacagagtctcgctctgtcacccaggctggcgtgcagtggcatgatctcagctcactgcaacctctgccttccaggcacaagcagttctcctgcctcagcctcctgagtagctgggattacagcacccaccaacacacctggctaattttctatttttagtaaagacagggttttgccatgttggcgaggctagtctcgaactcctgacctcaagtgattcgcctgccttggcctcccaaagtgctgggattagaggtgcgagcccctgtgcccggtcgagttgtttttaattgtaaatgtttaaggtgtacagcctgatgttctgacacacgcagacatcgtgaatgatgaccacagtcaagctaatgaatacacgtctcctcgcgtagttaccgtttctttgtgtgtggtgaagcacctgaagcctactctcctggcaaatctctgtgcccaacactcttattaactacagtcaccatgctgaatgccaggtctccagaattcagctgtcctctactggaagttactacctttggatcaattgctccccattccaccctcagccccaggccctggcagccccccttctactctgtccctgagttcgtcctttttaggtgccacatgtgagtgagatcatggggtgcctgtccttctgtgtccggcttatttcaatttaacgtcgtgtcctccaggttcatccatgttgtcaaaaatgacaggagttcattctttcttaaggctgaataatatttcattgtgtatataccacattttctttagccattatccattgacagacatgtgggttgttccaaatcttgtttattgtgaatagttctgcaataaacaaaggggtgctgatgtcccttccacacactgattttatttcctttgggtctatacccagaagtgggattgctggatcacacagtggttctgtgtaattgtttgaggctctccatactggttttattgttttttttgttttgttttttttttttgaggtggagttttgctcttgttacccaggctggagtgcaatgacacggtctcggctcactgcaacctccgcctcctaggttcaagaggttctcctgcctcagcctcctgagtagctgggattacaggtgcatgccacgatacccggctaatttttgtatttttagtagagatggtgtttcaccatgttggtcaggctggtctcgaactcctgacctcgtgatccacctgcctcggcctcccaaagtgctgggattacaggtgtgagccaccgtgcctggccctccatactgttttctgtaaaggctgccctcactcacattgctaccgtatagtgtgtaaggttccgtctcttccacatcctctccaacacttgccatccccctcttttcggtggcagccatcccaacaggcacgaggtgccagtgcgctgtggttttgatttgcatttccctgatggctgatgacattcagccccttttcacatacgtgcgggccatttgtctgtcttctttggagaaatgtgtgctcagatcccttgcccatttttagttgggtcatttgtttttttgtttgtttgctaattaaatacttagcactcaaaaaggacctagagtgaagaggccctgtgttcctctccatcggtgttgataggaagcgtaggcggggtggccattgttccacgcctgtgggtgatttgatgggtgaagaagagagtgaggttgcagcggatgcatctcttgctagggctgacatcacaaggtgctgcaaactcgttgttttaaaacaacaggagggcatcccctcgcagttctggagcctggtagtctgagatccaggtgtgagcagggccacgctctccgaagcctgtgggggaagatcctcacggcctctgcagtgtcccgtggccgcctgccatgaggggtgtggcgtgggtggccacaacactccatctctgcctgtctgcgcgtggccgctctccgtgtctgtgccttctcgaggtgtctccctcttcttctaaagacacagtcacgttggattgggacccaccctcagctcagttgcatctgcaaagatcctgtttccaaataaggccacattcatagataccagggattaggacgtcaatataagctgtggggaggacagcgttgaacctgtaacaaacaacaatatggtttttaaatctacagtcagtaaacttactcagttgggtcaaataacagccgaagtctgcacttcttgttccttgggtcactgtccgaatcactgaatttctccacttgctgctgctgaacagctgtcaggagacctcacagcaagctgctgtgtccctgccgggcgcgtcgagatggctcaggttcacagagcctggcagcaggctttaacccctgtgtttggtggtctctgagaaccactgggctgaccacttccattccttctggaatcataaacagcaaagcgcaacattgctcccctccccaccccaggcccacagagctggcacagctagagccttcaagggggatgctgaggcctggggacgctgcactggagaagaagtatgtaaaactggggagtatcagttttcctccaaagcgtggtgccagccgttcacactcgggatccagcacttgcggctcattttcagtccatgttggtgactttggttcgatccagggatggtggtgcaagtgctgggatgtgcaggggctcaggtgtgcaggtgctggtgtgtgcaggtgctggtgtgtccaggtgctcgggtgtgcaggtgctggagtgtgcaggggctcgggtgtgcaggtgctggggtgtgcagggggtgtgcaggtgctggggtgtgcaggtgctggggtgtgcaggggctcgggtgtgcaggtgctggggtgtgcaggggctgcggtgtgcaggtgctggggtgtgcaggggctggggtgtgcaggggctcgggtgtgcaggtgccacggtgtggaggtgctggggtgtgcaggtgctggggtgtgcaggggctggggtgtgcaggggctcgggtgtgcaggtgctggggtgtgcaggtgctggggtgtgcaggtgctggggtgtgcaggggctcgggtgtgcaggtgctggggtgtgcaggtgctggggtgtgcaggtgctggtgtgtccaggtgctggagtgtggaggggctcgggtgtccaggtgctggggtgtgcaggggctcgggtgttcaggggctcgggtgtgcaggtgctggggtgtgcaggggctggggtgtgcaggggctggggtgtgcaggtgctggggtgtgcaggggctcggatgtgcaggtgctcagatgtgcaggggctcggctcgggtgtgcaggtgctggggtgtgcaggtgccacggtgtgcaggtgctgtggtgtgcaggtgctgcggtgtgcaggtgctggggtgtgcaggtgctggggtgtgcaggtactcggctgtgcaggtggccatgggggccgtgttctcttacccttcaccaaacaggaagtgccagtaatggtcatttctggaattcaggcatacagttttgtaaactgcgcattccaatgaactgcattaagattaaataaggatcctgggtcattatttacttcctgaaagagacagttttagatttctcaaagatttgtgacacaaaccaatgttaacttgattaagtctgaaaaatcctgtatccaaatgaggtcacattcacaggtgccaggggttagcacttccgtatttcacctgtcagcaaagaccaagtcaatgagaaagaaaatagtgaaacttctccccgattagaaattgaaccttactcgactgggatttttactgattctgcattcataccaaaatccaaattaactttttgcgatgtattctgaggttatctggtcaggcgcgctgttgaaggctggaaacagatggagaaatgccatagttttcctcctcgattgagttgctttgtaccgattcaaaggaacacaagataatgtaatcagttccatgaacagcttgtaatattggtacccaattgggctgcctatttgtttgatttagtaaattcccctctctgcttttatacacagtgacctaaaaagaaatattattccccagagcgcctttgggattgcttgtttaaattaagtttcatttggatttaatcttaaccaaatcttcagagagccgggaaggcgccccataatgaagggcggacgcgagagccaatgagtgcggcttccaggccgtccgggtccccccagtcgacggggctctgtaatgtcacacttgggtggcacggagccgagtgccggatgattagtttatggtctagatcattgtatttttattacactcataaaatctgtgtttctcctcattttcgtaatggcttccatgagcttctccaccttctgaaggcacattaaattgttatgtgatggaagaaccgatttggaggagcaggtttgaaagcctgaaaagcctggcgtaagaaacatgttttgaattctcatcttgttgtcggatgggcactaaggaaagagaaagtgcacaaatttgagcataattcttatttatttgtgggcgttttgtaaatacttcagttggttccattggcttccgatgtaaatgttacacagtgaggtgccttgaggatattgactatttcagccccgtgagaacataaatcaatattaaaaaaggaaaatgtcgtgtttgtgtctgatttttaaaatataaatgtggaattcagtaacatgcgctacgatgacagcattttatatttgggatatgagggtttttaaaataacaaggtcttaattggatttttgtgtctgtttttaaaagaaatagaaactgtcttggataccaaatttacatctaaatgcagttgcttataaacatttctgccaagttaatgtaacccattgcagaaaaagcagacccctcttcactctataatttcatatgctaataaaaatctacaaatgccacatcagtgtgccccacaggattagtggttttgggtagttaggctgtaaatgttaagatgtaggtttacagccacaagtagccagttgtgtttgcaaagaaacgaggtcagaggactttgtgtctttgtaatttctgtgggtttaaatgtgcttttgtttattgtgtttcaatgtggctaataggaattagtaaatcaatttggtatttgctttaatctgaatagtgttgccatatttcggtataaacaaatgaaattgcagcagtgcagtactgctttccgtgaagtactttgaaaagaagcctttcggaggctgcttctgacaggacagcagcttcacgaagcaaaacgtttctctaggtgagcaaaatgatgctagccaccagcaagtgagggtgtcggcaccgcctcgagaagtgctggctgttatgtgtggcgttgtagaaagtttcctttacagatcagaagttggaaaaccacacagctgaacctacacctgaggaagctctaaatggcatgggataaatttgcggggttttttaatatttcgtggaacatgcaaactatgggccagtgcattcagagatgctcaggcagctgcggagtaaacatgtctgatgaaaatgaaataaatgtcctgtgaatggaataaatttggactgtgcttccgagtgcagtaattacacatgtcacgcggtgatgagacagtcacaccgcggccacgggccttctttgtccgcagatggtgtgggagagcggctgcgtggtgatcgtcatgctgacacccctcgcggagaacggcgtccggcagtgctaccactactggccggatgaaggctccaatctctaccacatctatgaggtactccgaccagagccacccaggccaggacccaccagccggacgaggacgggccctgctcctcctccgaatgggattcgttagggccccccagggccgcatgcagggaggctcagcgcaccccatgttcaggggatggaggctgagccacccccgagggccgcatgcagggaggctcagcgcaccccatgttcaggggacggaggctgagtcacccccgagggctgcatgcccgtgtggatggttcacacggctgtgtgctcatgaaccagaccctgggagtgtggtgtggtttttatcttttagatttttctaaatccaaatgataacagagtagaaaaaacattcgcctcacagcgtggtcccggtcccatataacaagcctttaagtggggtccgtttttaagaaaacctggcgcccatccttgatgccagtgcctgagccgtgtggcctccccgtggctctgcttggagtttcgtggctggatcatgtgacctttttatttgaggataacctgctcaccagtttatttatctggctggattttctgcccccatcaagaatgaagtaaataaacgtgggtgattaagccagcactagaatgcatgctttgattctgtttggcattaaatgagtgagaatgccaaagctccacagtaggaagcgagttagaggctcaagtgtgaaccttaaaccacacagctgtggccttggggttcctgcagaaatgcttaggcccggaagtgcctgcgctggggttcacatcagcgcgactccgtgagccttttgcttttcctgctctagacccgggtgtgcgcagctgcgatggagtctcacttagagtggaaccactgagcagaacatgtagtcgtgtcgctgcttttgttgaaaagtgtaatttttctctggttcctttttttgagggtttatgtaacatggacatgcaaaagacagaaagtaggatagttttggattgtaaccttttaaaaaattatttgacgctcaagcccctaaataacactaagcacacacacccgcacggagctaacttcagtgcgttaacactgggaaggtgggagggggccgcgaagccgagggaacccacctgcgctgtaaaatgtgccctcttcgcagcgcccccttctctcgtcagacgtggccctgggttcctcagtgcctgaggttcggttcacaatgtccacacctgtctctgtcccctccctccgctcctccctgccaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcaggtatgacgcgcggcccgccggcagggcagtgcgcgctgagcgcgcggcacaggggagcgaggcttcggtgctcctgagacgcccctggcgccgagggccgcgtctgtgtcggcgccgcaggggggaggggaagggaagcgagaggcgggaagactccgttaacggcacgtgttaatcgtgagcgattttctagcttcagaggtattaaaatgtgagggggaataggcatcttcgaactgtggaaatagggccattatttttgataaggttcttcagttgacaaagagcctaaagtgtatgtgccacaggatattgatgcataaagctcggatgttcagttggattctcatctggctgcatgggatgaaagaggtagcgagcgcaggcccagataccaccctgcgtgatcttgcagggaagcccggagacacttagcccgtggctgtctgtatttttagggctattttgaaactgaccctctttaaaaaattcagttttttgttcattgctccagtcagccagtcacccaatacgttgtctggtttgagagtgtatttactgaactgttgaagtgaatgctagactctgtcttacaggaagaaattgacaatgaaaaaaaagcagcatttaagaccacagctttgattgtggtaaacagtcggtccgcattggctaggtggtggtgcttagtgaataaaccaccacaaggaaaatgaaattgtcaaaagcatcagtgacgaagctctaaattgtatagaatatgtcttacatttaactgatcagaagtctacctattgaggaaaagagacaaatatccaaacaaggagaataagaagaaaaaatgcatttgaatccaatgccatgccccactatcataaagtgacttgattcttaacagttactcattctcgagtctacagttatgtaactggagggaggttaacgagacaaagattgtcataaagaagcgatttttgaattctctgtggaattcttgaatttgtgtattacagattctgaagcttattatgattcaatttattttgccttttagtctacattgaaaagcaaaatgcagttttttgtaatttgaatcaatagaaatcaatcaagagcctctgcaaggagacacttgaatctggtgtcacagccacaacacacactcagtggcccctgcctgccgtcacctcccctggggacgcagagcgtagatccagagtcctgagtacatcctaaaacaactactgtacacggctccttcctcacccacgctaatttcctggccattatgtacattctgtcaatacggatttatttctaaagacatactatgtagaaatcttacataatttcctgaaatagagtcttcaaaaaacagtcattcctggcaaaatggatgtaactacaaagacggcaattcatcttaacaccccgtctttgcgttcatccagtgtgtttgcacgtatatgcatatgggcacgttgctatgtccatatccatatatggacgggaacatgtacatcaccgaccctcagtgtttatgattcatcaccaagaaaaattggattcccaaatttcccttgctccagggtctgaggagatacagcctaagaaggtttttgttaaattcaaaagctaatgaacccccagacacggttttgaaagccacgtcagagtagaaagcttttcttgcctgccttacctggcaccgcccagcgtttcggccaaggccacctttcatgtgttatctggacagtgggtttgagcgaacacattctcaggaagcttcacacttagacaagcattgccggtggctggttttctgtataaaatagccaccccgatttcagcgacaggaaaggtgagaccccttctgaagacaccggccatcttcatgctgcagcgtttcttatctttgaacaatagacgacgcgttctcactctggcctggcgcgttcgccaggcaccgagatgtgtgattaaatatttctggagcccagagggagcgcatttacactttaaagagaaactgctaagagataattagcatcacatgtgagggctttgctttaaaaactctctctctctctctctctctcattattactctctcccttcttgctgtgtgcaatggtgctcactaacgctgctcacggtaaaacggacaaacccttaccttgccagctaattagcggtggccagtgtcatttttgtgatgttgcagctagtaatatgagcccagttgcatagtcacaaaagtgatcattggaaactgtgactgtactgcaggggcgatgtggaaagccccttttctgagcctctaacgacctctgaccttgcttgctggtgctttgcatgacggtgcgctctcgcccggtgacccctgggttggtttgtatcactaatcgttctttctcagtgaattcctgttgtggaagtttctatgatatcaacttttcttactgttggagaccttttgctcactgattctttgttctgatggagtcaaatgagacggctgtgtcaccttcctgaataactcgtggtctacatcttgggtcaaccggatgaactcttgtgttcaatatgtcgtggttttcctctctatttgtgatgctttgcgtgtaataatacaactgcatgatcctttgtaaataaagtcctcagccatgccacaccctgtatctacactgcacatgtccttgactgcccgtgggtttttgtaaataggttgagcacaaggtgggggctggtacggatatgaaaattacagcgaaaccttcccaaggccaccaggcacaacatgtcagagaaaatggtatcttccgtatactgtgagatagagacaggagtttcgggagtggggaagcaggttgaggccatcgtagccacaaattcactggctaggagcatttcccagccaagggggttattactgcattttgccaaagcaggagctgaccagctatccatgagccaccgctgtctactgacttcttatgctggcctttcctcaaaccagcacactttcttaaagggtatctggtttggggtttggggtttggtttgttttactgtcccttttttgggtgtacttggtctcatgaggaaaaaatgagcaacccctggtgactggtgggtgtggacccagaagctgagcttagtctctgcgtagagtggaccacgaggtgtgaaacacagcaggaagctggaggagcagaactgaggtcattcccatttgcaagattcagaggctgagccatggccagtaaactcctctgccaaaggcaaaaggcctttcaaagcaaagccactcaccatttggtctgatagttgagcctgcttgattctacacgtgcacacgtgtgcacatacgtgctcacgtcacacacatgcgtgcagtctcatgcacacacacatggtctttactgagctggagggcttcccacccccatgctggggtgcacccctgaggcctggtatccattctgtcatcaggagccctcgatgctttacagcctgagtcaggaatggaaaattgtagaagtagacataagtgggtctgttttccaacctctttattctccagggaccaagaatgttcaaggcactctggcatacaagtgctgttgcctctaaggagttcaccattgccttccccgcctctccccaaagccttcgcaccactgtgtgccccggaaaaacaacaacaaacacctctaacagaaacggtgacacggccctggaggccgttgctggttgtgcctgtgtctgagcccgcccatttttgggcatcagcctcgtgtttcacagaccagagggcagcacagatcaagtgcgtcctggctaggctgtggccgcggcccatctgcaggtgggcacgccgagtccagtccctgcaactgctccttcagctcccgtggtgccctccagactgggcattcacactcccatcagaagggccttgttctggtaactcctcagggaataggaagagaggaggagaaagctctgtggtttgggctccgccgtattcaagcatccctcccctcatgctcactggacactcacctcccctctccttccacagccaccctgcccctcctggcttcaaaggtttgtagcaaagcaccggttgatggaatgtttactttccacggactctttggtgctggataggcaaggctttgcaaagaaacgtgacattttcccattgatggtccatacttccatttttcttaatttgtttcttgtaggagttcacgcagcacattgtagaacactctccttcacacatgctttattccaataacccgaggttccgcctttaattttacttattcagaaatagttcactgacaactttaatggacttcataaacatgtttcattgtttcactgaattaaaaaaaaacacctggatttacacagtgaattttaaatcagtcctctgttttgatttaggggttggttatgaaatcttaaatatatgctcatttctaatttttacaacttctgatctaaactctgcacaatgaagttgtttgtatactcaaagttataagcatggaagggacttgtcttggacttcatagaggtttctccgtaatttagatatccttaccaaaagctgacgggtcacaaatgcccttgaagatgctgtttttagacagtgtggaaataacagttttcaatatgatgtctggactgtaagaaattttgagcataaattgcaaaactcaaaaattttagtgaagaatcaagatgtagtgtaacaaaaggtcaagtcaacataagcagaaacagaaagaggagagcctgcaggggtgggacgggcaggacaggccgggagtccactggttcaaagcctggcacccctccttggaagaagaaagcagtgtagaggtgtaacattggttttaaagctccgattaataacgtcatgttgagaagaagaataaatgtttgatattatgcgtatgatttttattttctccgtcaaaacaagcgattgcaaaatgatttcaaacacacagaccttgcgctttgttttaatagttgttttggataacgcaaagtcttagtacacaacgataatttttatatctctttttatttcagaaaagtaaacaagtgctacaggggccgttcttgtccaataattgttcattgcaggcaagtacaacttttaatggattaagaagttttggctacctcaaaaactaatctatgcaattaaatacagaagcttaactttctaattgcttaataaatataactaactggcacttctaaaggaaaccaaaaatataaacttacttttctatgccatttgggtaaatacaattgggcgttgcttgtattatgtctgtataaactgcacatggcttgctttttttttttttttttttttaaactctgttgcccacgctgcagtgcaatggcgtggtctcgtcaggctcactgcaacctccacctcccgggatcaagcgattgcgcccgccaccacgcccggctaattttttttgtatttttagtagagacgaggtttcaccatttggtcaggctggtctcgaactcctgacctcaaatgatccaccgacctcggcctcccaacgtgctgggattacaggcgtgagccaccgcgcgaggcctcacatggaatattttctagcagcccacggtgcagtgtcctgccttctactcacccgtgagcatgtcctgccaccttgcttgttcttaaaccctgtggtcccatgacacagaaacatcgagacaatggtttcagcctgttgcattgtctcaaccaccaggacgttcagcagaggctcagaaccctctgcagatggtgagaaatgcttggggccagttatgtacagggacgaaatctgtcattacaggaggtacagccacctccagtttatcatgtgggttcaggcctctgggtaaaaattcagtgactcatatccctaagtacgttaaaaccacaccagtaagaatagattttacgcaaagaaaactcaacctaatagtactgtctctgctggacttcatacccaactccttttggtgaagaactcatattccatttttctagaactgtcttatagaatgttcttcctgcctggaataaaaaggaaacctgtctccaaagaacaaacaccaaatctgtcaaatccaatcaagaagcatgtgtgttttgtgtgtgcattcctgtctatgagagaggaggatgaaaatagattacggtttgttatccttacagagtagagtagaacatcttttttacccacaaatgtatcaagacaagcaacacttagttggaagatttttgaagtatatcttaaaatattcatgtgaatatatgctgtgcataggagacaagtgagaaaggcactcagcaaccagaatgctcaccgtggccctttgaaatgagcagtgagggttacgtggcggcccaggccgaccgcctctcctccttggtgatgcagtgagggtgtgaggatgtgaacgtgccgttttttaaacatttaccatcccaactgcagcttttttcaaccatttgtttgaggaaacatgttaaagccaaaatgcgctgattctttaccatcaaaagatcacctataggattccagtcatttcttgggatcacagacggcatagaaagcagaaccgaaagtgtgatatctgctgggtattcacatctttcttgaagtcttgaaatggaaacatttattcgttttccggaaagtcacaattgattttgctaggattataaatgtaaaaggtcctctgtttaaaagccagtcatgggtgtgaacacgagccctatgtacttttaagaaggtctctcaaactcatgcaacccagtgacagcgtctgcacgggggcaggaaatggcttcacacattcctcataagaaaaggatgatcctgaggctactcttcttccagaaaaaaagggaaattttttttcctttgctactgttgaagtattattcaaaacatttttacaactctagcccagatggtaaatattccaattatagctggtgggatgagaaagagatgaaatgagagtgctttttaaagagtaagatttagtaacgactgttatgtcaatttctccttctgagacggaggacctgcgtttagaaggggtggcaggcagcctagggggatgtgcctgaagtgtccctgcgtgcatgagccagcggggcccagccgcccagcgccctcccctctccgctcgggaggttgcccggcaacactagagaaggcaccttgcagatattttcaatacaaatgccatcaactctgacacagtcaaacgcttagttcattttgttctggcaaaatttaccacatctttggccaaagaggggggaacaagcaagagggagtcacatctgagcacagcagctcatcccacaagctacaagctgctcagaggctcgaagcccccaggggcctcccttctcccctcacttggattctcccagcccgcgtccttcctccccctctcacatccgccatcctttcctctcgccggcccccgtaagcaggaaggaaatggactgtcactagctttgttgtgggtcgggcttccgtgtggacggcagcactttcatttctctccttctgttggcagtgacggtgcaggccggagcggcacctacgtcctgatcgacatggttctcaacaagatggccaaaggtgagacacagacactgccgctttgttgcggctcagagctgggatggcgtcgctatggcaacgtagggtgccgtgttcacgggaggccctggaaaaaattcgctgcttgttgtgcctctgctgggccgtaggaaggtggtttgcagcaagcacatctgcttctgaggctggtcgtttgttacctgcctctgcgtgccgagcctgcagtgggtcctttgttacctgcctctgcgtgccgagcatgcactgggtcctttgttacctgccttggtgtgccgagcacacagtgggtccttgacaggtgtttgctgcatacgctgcagcgttaacctcagagccacggagaagccaccctcgggtccttcagtgttgttgcagtgcagaatgccgctccagtatttggtgtaactccactgttgtcaaaacggtattcacactagaggcacactaaaaatatccgttagtaattgccatcaaatgtcaatcaccccctctcaaatgagcctttcagccctctttgtgaatgtccttcttatctagggaatctctgtgcgtgctgtgggaggcgttcctctcagagacggtgtggggagtcttagacttgaggcctgtggtgggagaaggacaggtttggcagagcggcagcatgcgcagacggcgtggggagtcttagacatgaggcgcagggtgcgaggatgggtccagcagcagcgtggaaaagcagatctgtgcgcgggtctggctctgccagcaatgaggtttatcactttggacagagcttttaacctctctgggatccaattttctcctacaaaagcatggggattgagctctggcatttctcaaaaggtggtctccagaatacccaacctctaaggtcatctctttaaataggggccagagagaaggctccccaggcaggtgagcttgagaggaggcacacactgagtctgctccttgggcatcacagggcaggtgtgcatggagaggtcccaaggagtccagggcagagagatgtgtccagcttcccttcagttggcgcctccgacacttacttgagaagagtctgcattagccttgcgatacccgttagcgtcccatggaaggtgggaggcaccgaggtggtagcatcctacggtctctttcccagctgtgaataaacaattccctttgtctcaacacacacacacgtatatgtgttcatacagagacctccgccttccgtaacatcccattctccatcactggcccagtgacaggagcagccattgattatagaaacaagtttctatacacttccacgaatgccagcaattttaaaataagcattttccttacttcattttcttctggttaaaaaaaaaaagacataaatatgtgaagataaaacaacagccatggctttacgcagaaggactggagagcctgggcaagttctccagcgtcctgcagcagaggggagggctgcagcccagccccacaccccacacctacccaacaccgccagcatcctttgctggctgctggggagaaatgaaatcagtttttgtgccaccaaatgtcattttaaacacccaagattagtttagtggtgggaatgtgcaaacaaaaacaaaatgcaaacactcataatatttttaatcctttttttgtttgttttggacatgacacaatcctaactttttgtcatttaaaagtccatttttccttgtccattaatgctgctgtgtcttgtcaaatatttcttttcctttccaaatttacagctattggagctcagagccatccatggaatttgtatttctccacttatcatgggccctcccttctttccctctctcagacaaagatttttcttctcttaaaccaaaatgtcttcagaacgttacagatcatttgatgtaagtgtttctgaccaagcctatgtttgtgaacgtgtgatgtggtgagttgctgggggcacctgtgattccaatggaacctgcccatccagggaccagaagcacaggcaggcggccggacgcaggtgaccccagcgtgcgtctccacagggatgggatggagcctgggttctgagtggctcaggttcactccacagagaaggaaacatggagaagtatgtcctgggttcgagaccccggtacggggggcagggctggcatattgtccaggcacctgagctgctgttcactggctccattgtggcatgtgatgtcaattctcctttgagagtgggctcagctttggacaatacgcatgcagccatgtggaaatggccaaagagggctggcctggggccttttctgagattggtgaccctcctcctgttcttgacctgctcctctttccctggggtgtgtgcggtgtgaaattccctgacccgggtcccaggccacagtctcaggagagatcaaagggcaggcagcccctctgccggctgaggtgggcctttcccaggcctccacactgagaggcgctggggttttgttctggtgcaggctgggccctgcccgtgtggcggggcgtctttgtctggcctgagaagctggaggcccccactgcagacccagcgtttctcaaatgatcaaaggcccagagtcctggacgtgaaacctttcttcccatttccctttctgtaaaggaatgcattacagaagaccagagaatgcccttcccaagcttcccgggcagtcgggcagtgccaacgctgatgttagggccctccagtcctgcatgcagggcctctgcatgcttttagctccagcagctgcggccgcagacagcagagcagcacttgtccacacagcccatcagggattaaggcctttgggcctagttgaagggcctttaaaaacaaactcagaatagttgaagttctttctctactgtccagtttagcagcaagtagacgatgatgcagtttggaatgaaagtcaacaggctcatgttctgcaatgggttttgtggcaggaaagtaggcaccaatctgggaagcgcttacacgtgtcatttctgtggcagcagatgcgtttctaactcaccgataatagacgattgtgtaggaatctgtttttaggtagcctattcctctctcattgaagggcttggctcacatgtagcaaaacatgtttttttcaagcaagatattttccaaggttgtgccttttacttttttgtcagtgacttcacttactgagggtatttttctacttccccacaattttttaaagggatgaggagcaaccagcactgagggggtactccccagagatgaggtgggctgagccatgctgggtggggtcaggcttcactccccaggggccagcacagaaatgcagtggctgagaagtgtggccaaacttccacggcattcccaccagggtctgcgcctgggccggaagagggtgcctgtgtggccccaggtaccatggaggccatgccaagcagacaccgtatgatcccccagcagctgtggctgttgacaaggtgcagagtgactctggggtgactcatttcttttgtctggcaggagccacagaccgggaattttgtgttccaatatgaatccccacggcttgtgagcccatgctggagcgaccttttaaacttcagctggctaggagtacgttcctaagtagtctcacggcgtgaatgtgagtggacggtggggtgtccacacgggcatagacccagctctcagactcagcgactggacatggtactattttgtgtgtggatacacatctccttgcctacggggatggatcacttccgttcttctttgtttccgcgaatctgaatatactacgcacctcatctaagtggagtgataccgcgtctgcgcttccgtgactgttatatgtcactttgcataatgccttcgaggttggcctgtgtcgtggtgtgtgtcagcactaacttcctttttatgactgactcatattccatggcatggatggaccgcactttgtggattcatttgtgtattaatggacagtgccgttgtttccggctttgggctgttgtgagtaatcctgctgtgaatgtggatgtgagggtgtccacccacatccctggatatgtccctggggcggaatcgccacatcgaccgtaattctcttatctcttggctgtttgattacagccatcccagtggatgtgagtggatctcaatgtggttttagcatgcatctccctaacaactagtgatgttgaacatcttttaatggcttattggccatttgtatatcaacttgagcaaaacagacatttcaagtcccttgcccatttctgaagtgggctgtttgtattttttgttgttgaattctaagagttctttatatattctgaatactactcccttatcagctatgtaatttgcaagtattttctcccattacatcggggttttttactcttttgatagtgtctttgttacacaaaagtgttcaattttgatgaagtccagtttactttttaaaaaatatttttcttgtgactcacacctgtaatcccagcactttgggaggccaaggcgggtggatcacctgaggtcaggagttcgagaccagcctggccaacgtggcaaaacccagtctctactaaaaatacaaacattagccaggtgtggtggcagatgctactcaggaggctgaggcaggagaatcacttgaacccgggaggcggaggttgcagtgacctgagatcgcaccattgcgctccagcctgggcaacaagaaagaaactccatctcaaaaatatattttttttttcttgtgcttttagtatcatacccaagatatattggccaaatccaaggacacaaagaccttctgctatctgttcttagatttcctcctatattctcttaacttttaagggcaggcccaagtagtagatggaaagttgcctgtgggaagcgagaggggccatggagcagagagcctgctgcctcgagcgtgtgcgggagcacgtggtcctgatctgctgtgtgtggtgtggtgatgtgggagcacatggtcctgatctgctgtctgtggtgatgcaggagcacgtggtcttgatctgtggcatgtggtgacatgggagcacgtggtcctgatctgctgtgtgtggtgatgtgggagcacgtggtcctgatctgctgtgtgtggtgatgtgggagcacgtggtcctgatctgtggtgtgtggtgatgtgggagcacgtggtcctgatctgtggtgtgtggtgatgcgggagcacgtggtcctgatctgctgtgtgtggtgacgtgggagcacgtggtcctgatctgctgtgtgtggtgaagcgggagcacgtggtcctgatctgctgtgtggtgatgtgggagcacgtggtcctgatctgctgtgtgtggtgatgcgggagcacgtggtcctgatctgcgtgtggtgacatgggagcacgtggtcctgatctgctgcgtgtggtgacgtggagcacgtggtcctgatctgctgtctgtggtgatgcgggagcacatggtcctgatctgctgtgtgtggtgacgcgggagcacgtggtcctgatctgctgtgtgtggtgacgcgggagcatgtggtcctgatctgctgtgtgtggtgacgcgggagcacatggtcctgatctgctgtgtgtggtgacagcagaacgtctttgtcgaatcgtgttttgtggctccccggactttgaaggtccccggactttgaaggccagcagccctccagagccgccttgttccatacagtagccacatgtggttccttagagtcactaaaattggataaagtttacaagtcagctcttcagttgtactagctgcatgacaaagccacagtggctacaccaggcggtgaagctggaagtcactccttcccccacagcaggtcctgggggccacacggctccaaggtggcactacggtggctcctgacttcaccctcaccctcttctcatctccctgggcccagccccatcacccctcgtgtgctggtctccccgctccattttctcctcctgattaggtgtcacacagcagtcagtaagatgctttagacagaaagaccttgggtgcctgcctcggccctggagctgtccccagagccctgggcgagctgtccccagagccctgggcaacctggccactgccgatcccccttggtgggccactctgcctcctttggctccaggactcagggctttgcaggttcttttctgtggcgtggggggcgcacccttcccctccccagggtgcatcccccaccctctgtcctctctggagtcccactggtccattccttctctggcagatgccagggtaaaccgtgaaagtgtggctccagctgatggcagggcagcgtccactgcatgctggatccacgctgatgctggtttggcacctgctgcctgccaggcgtgggttgtgagagcaaaacagagaagccccatcctcctgctgcatcttcctgctctgccgagagacaggtaaggagtctgtggctgcagggtggtggagagcagaccaggacactcccagatgcagagatggcagcttcactcacgggctgtcctggggctcaggaggacccacagaaagcttttcactgaatggaagggggcccaaggggccctccgttctgaccactctgttgcaagctgaggaagcagttctgggaggttgggtgacttgcctcaaggcctccggtcagccagagtcagatgcagaaccctgctcagtctgcaaaggctcagggccccagagggaggatggtggaaggcacacggccccagggacggcgctcagaggcacagcgtggtgtgttccagggctccagggacagaggggcagcttcgctggggagttcctttggggctctcatggaaactaccggaggaagaggaaactgagggccagtggtgaggcgcctgggccgccgagctcagctctctctgggcacagcctggagtctgcagggaagtgggagaacccaggcaggtgctggaggaccagccaggcagtgcagaaccagagggcggggagaccggccgggcagtacaggacccgggggccgaagggatggcatggctgggcagtgcagaaccagagggcggggagactggccgggcagtacaggacccgggggccgaggggatggcatggctgggcagtgcagaaccagatggctgggggaccagccaggcagtgcgggactaagagggccagggaatggagctggaactgaagaacaggccagctcagccacggggcccaggagagggttgagccagacagagccacacatttgggcgcaggcaccaagagaaggaggtgcaggtgcatgaggctcagccttctgcagatgagacttagggggacgcgagggctgggcagaattgggaaagctgagcaggagacgtctcgcttttatgtttggctgaaacatgaaaacacgaagggccagtgggaaagggacctcacagacacgttgggcccgcagtgtctcttgtctcgctcaggcaagtttcaggctgaaaaagtgcccagaattgggtgaggtgggaggagggaaggggagagggagcctgtctgcacctttctcttcaagggagaagttgccttcggtcgggcaggagcagggcctcctctgctgtgtgttgtttattttctgtgcctttccttcccctgagctattctggtgcaagagaaacagtgagggatgtggggcgtgaggtgtccccaggttcccgggccggtctgcagtgccctgtcccgtgtaaggggctgacgacgaacgctggttggagcagtggtccgggggcgtggctgaccccacccaggcagggcacaggcggaccctggtgtcgatcgcctggtgggagcgtgtggacagcatgagacccgctggtcttggggaacacgctctgggcatccgtgtgggcagcactgcccaccatccttcgatggtctcctcgggggtcttcgtccctgtgcatggagccgtcctcactgagtgtaccagctcacaggtctcccaccttcaaggggtctcccaccttcaaggggtcaggctgaccctgctgagccagggttcacatagcctggctgcaggggctcctcacccactcctgggtctgatgtcctcacctgggctgtcctccgcttctcctcatggtcacgcagacacctcaggcccattggatgccgcaaaatgtcgttcaggtcccacctggccgagggctgtcccttctgcaagctccctccttggtcccgggtgctggcaccagcccatccaggcccatccaggccctcccctccctccaacacaggccttgctggcacacatttaggggtcagaccacgccagcaggagctggatgaggccacagcgagggagctggcagcaggcggcccctgagaatgtgggagagaacacaggagagagacggggcggggggggccacagccctgtcggggcagctgtgtcgctgtcaggatgtgcccgaagcactggtccctgagtccacatgtttctgttcaaactcctgtttggaaattcgggaggggatcaaagtcctgccctccaaggttcccgttgcagacacagctccacggtccaggctggcccggcctgcgcacttgcctgcctgattctgctccctgctgccgggcagtcactccttcatctcagtccctgggtcctctccgtcctctgtgcgcatcttgctcacagcctggttgctccatttcctgcggcacagctgccctccccacacagtctgtggtcccccctccatctcctctgctctcgctcccacccactctgtccttccctcattcctctgctcgtccagcccccgccagtgtgttctgccactccctatcctgggtttccaggggcccatgtggagggctgcaggggtctccctgttgtcctggaggcacctcccagagcatcatccctgcccagcccgcaggcccaacatcctccgtccagaccctgaggggctgtccccagaggcagcaggtcccacgcgtccgttcctagcgcctgaagtccaggcacatgcagcctggccttttggcagtggggctccctcgtagtgttgagtaggatgctgggggtcccccgatggagtcagggtgctgcagggggtcacacgctgtcccgtggaatcagtaatcctcatgcaagattcttccaaatgcacagcaactgcgtgagacagaacgtgcgtgtgggaagggcagcgatcccgtgcagtgtcacgcggcccctcggctccctccttggcctgtgcttccgtttctcctgtttccgaggtcaaatgatgcaaagtgtccttgaccatgagcccacgggcatgggacaaggtctctgtgtttgcactgtaagccacggaactgagtcaatgcgtaactggccctgtccccagcccaggcactttctgaacccaaaatagactcagagggaccgaggcagctgccggccctacaggagcaagggggaggagagcctgggctgtgcacctgcaggagggatcctgccagacccccgtaaaggccaggcccccggaagcagcagtaccagcagtcagtgcggcctgggaggggagctggctgcatgcttcacgcatccccgctggaccagtgcatgagcaccttttgggtaaaaggtgcaagtggtgtgtgcgtgttccaggcagcatgagaaggtttgccctgggtgagcccagctcctgttctcctccacctgttcaatattcacaatttggtgtgattgttactcagctgcagacggcctcctgaacgccattgaccgcacatgcttgttgattctgacataggtgttgaggacctagccacatcgtggaggcccccatgtgggtgtgtgtgctctgcactgatctgggaatgactgcgtgtgccccatcacacggatgctccaggatgtacctcagcagtcccctgccttggggctctcgtgctgctcccaaacctcttctgtcagcacagacgctgcgtttgcatctcggtcctgccccggtgccctggcactggttgtgcagggcaggtaggtgggatggcagcaaactgcggtgggcaccgcgtcgcaccaatgtgcacgtgttcacacacagataggactcggaattgtggagccatcgtattcgtctttcccttttaacaatccccccttgaatcgtgaagctgtgctcgcctgcacaggggtgcagaggtccggtgtctccgcgttgatgctgccagcacctcaacagtactatgggatggtccagcagtcgatagaaacttaccaggatattttgcacaattccctgtcctcctggagtattggggatggtgactttaaaatgacagtactcattcatacacttctacattttctttaacttatatttttaataaggatctggaggcatttcagtttctccaaaagaaggatttagaatttgttcaaaggaaaaaaaaacataagaaatagctagtttgttatgattctgatctacttgattttcaagtgaataagatgcagatttgcctcctttgatcccagcaatatgttacaacatagacaatataatttatctagaaggtcagcaaaaaaaaacctgcttataattttcataagtctttagttaagatcatccaggaaaggtgtgaagtaaaaactcagcactgaaggcccaggagagtgtgtgtgtgtgtgtgtgtgtgtgtgtgggagtgtgtgtgatgggtgtgggtgttgtgtgggcctatgcatgccgtgtgtacctgtgtgtgcatgcacataggtgtgtgcatgtgtgtggtgtatgagtgtgtgatatgggtgtggaatgtttgtgtgcagtgtgagctgtgagtgttctgtgtgtatgcatgtgtatgatgtatgtgtgtgatcctgaatgtaggtataaaggatgtgcatgtgtgatgtggggtgtattgtgtgagagtgtgaagtgtgggtgtttgtgtgcacatgtgatgtaggatgtgagtgttgtgtggtgtgtgcatgcctgtgtgtgtgtgtgcatatgtatgacctatgtaagtggggtgtgtgtgttgtgtggtgtgtgcatgcctgtgtatatatgtgtgcatgcatgtgagtatatatgagtgtgggtgtgcatgttgtgtgagcatgtgcatgcctgtgtgtatatctgtgtgtgtgtgtgtatgtatgatacatgagtgtggggtgtgcatcttgtgtggatgtgtgcatgcctgtatatatgtgtgtgcatgcatgtgcatatgtatgacattgtgtgtgcatgtgtgtgcatatgacatgagcgtagggtgtgcatgtcatgtgggcatgtgcattcctgtgtatatgtgtgtgcatgcatatgtatgacatgtgagcatggatatgtatgttgtgtgagtgtgtgcatggctgtgtgtatatttgtgtgtgtgcatatgtatgacatgagtgtgggatgtgcatgttgtgggcgtgtgcatgtgtgtgtgcatgtgcatatgtatgagtgtggggtgtgagtgtagtgtgggcatgtgcacacatgtgtatatgtgtgtgggcatgtgtgtatgtgacatgtgagtgtggggtgtgcatgtttgtgtgaatgtgtgtgtgtgcatgtgcatatgtatgatgtgtggggtgtgtgtgtttggatgtgtgcatgaatgtgtatgtgtgtgcatgtacatatgtatgacgtgagggtggatgcgagtgttgtgtggtgtgtgcatgcctgtgtgtgtatgtgtgtgcatctgtgtatgtatgacatgagtgtgggtgtgagtgttgtgtgatgtgtgcatgcctgtgtgtgtgtgcatgtgcgtatgtatgatgtgagtgtgggtgagtgttgtgtggtgtgtgcatgcctgtgtgtgtgcacatgtgcatatgtatgacgtgagtgtgagtgtgggtgtgtgtgtttgggtgtgtgcatgcctctgtgtgtgtgcatgtgcatatgtatgatgtgagtgtgggtgagtgttgtgtggtgtgtgcatgcctgtgtacccatgtacatgtatctgcatgcgtgtagtgtgtagtcagtgccaagtggcatccctgagacccaggtctggggagggcttgaaccgtgtggggcacccagagcatccccaaccacagttaccttgagccgagttttgctctgccagacgtgaggggctctagcttgacctctgcacccagtccagttctggggtcacctcggctgacatggagagctagaaagatggggtgtctgtgcccttcagagcccagtcctcccacagcgtgagctccagacaaagcagaaacatcgcagcctgggtgagtgaggagctctgcgctcctggggcacgggaactgttccacttcgttccttatctggattcttaataatcaccattcgtcatgtatttgaatgcatttagttaggaccaagcttttcttcagttcttccagagggtagagttgagaaaattttctcctgcaagtaaaggcctctctctcttgaacacttggcacacattgtcgtttttactttcaagaaaaaaagaatacattgcatccctgcagtttgcaaaacctctgagtaaaattgtaataaaacttacctgcgctcatgcagtcattatccatgaacaggctgccggaagccatgcggaagaatgacggtcaggagacggcgacgatggccctcccggcacaccccatccgtccgtgttcactgtttactgggaggatgtggtctagggccatgagctgaatcacacagctcggtcagccaagagccagagtccaggagaaatcaaacaagccttggaaagagacaccggtggcatatttgcttggttttctttaacttcaaatggattctttcattgtgacagatagttttaatactttaatactaatattcttttaatggcttttgtttaatggttaacattttttatctaaagctaaaaaaaaaccctctgttgtcttacaaatgtatttaaccaatgtataaacttttaacccaatgagccctgagtgaattagaaaataacaatgagagcgatttacatttgctgagcttggcacgggatggtacccagtggccattcgggtgccagcggagcacgcagagcctggtgtctgtggctgcctccctggtccactaacacgagagaggtgggtcttcctgggtgtcccaggcacgagggtgcagcccaacccaaactgacttggccggtgctcaccacactggggcgcccgccacactggggcgcccgccacactggggtgctgagcaagatggcagcctgcgtcacttccctgtagattcccgacatggacaactcgaattaaacctggtcaagtagcagaaagtggctccactgagtccattcatttccctggtgtttgaatcaccatgatgcttcttaggtggaaaacgcctgggacttctccgtggaccccacgctctgtccccggtagacatcgttaaggttcctttctttccttccatctggattttctttgtgtgtgcgctgactcctcgactgtttgcaggcttttcgatgtcagcgtcacaccactgggcctttctgtttccctggaatttaactttcgttagctgctccttcaccttgtcagcaaaattggatttttcaagagagaattctattttaaatgcactagagggagctttctatgcagtggaggctttaaatgaatcctttgacactaagaaaagccttttatcaagtgaagggggacacacgcccaccctatcccaccctacccacccagcaggtgctttatcaatgccaacgttgtgcccctgcccggcctggccacacccatgctcaggagggcacaagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgcgagcgggcaggatccggcgcccggcctggccgcacccatgcccaggagggcacgcgagcgggcaggatccggcgcccggcctggccgtacccatgctcaggagggcaccagagcgggcaggatacggcgcccagcctgagcctggctatccagggtctgtcccttatgaaagatctcatgcatgggctctatgaaagcttctgtctctaccacacttgaagtaaggagttagtcttaatcctggcatgcaagaagcaggagccgtccacagcagacagttgattttcctgctacatcattatggacctaatgctggtgctgcacactttttaagcgttaactccgtttcctccgctcttcagttttggtctagggctcagcgcgactcggaggcacgctcccgtgtcattttgtatttccgcccggttctccccatgttgtctggggatggcccggcaagtctttctccttcccttttttcacttttcctcacaaaccacagcctgagagggagccacgatgtcatgaaataagagagactttatccatcatattttatgtgaggacgacgacgccactctgggagacagccgccagcaacagccatctccagagatcagtgcacgcggagggagagccccttcctcgcccacacctgctacagctcctgacggcttcatggctccggccagaattcgggagggcggttgccagtgagggacagtctcccaggattcccactagcaccatcatacacacagcccttcagatgacattgctgttgacagtcgttttaaaaaagaagtttcagggactgaaagcaagtaccctaaagccacctaacggagagaggctttaactctgtggcccagatgaaccctcaacgtgatgtctcaggagggctgagagctccccgtctcttgagtcagactatttataccacacttgcttctcctgaggttcatgactcctgagacagaaagctgaggggtccccgtagaagccgctgctgtcctcgtgcctggaaggcttcagagaacataactgattggatttcactgtctcccagaagagtttgctcacgagatctgtgaggttgcctgagcatcaaatgtgttttgtaaattacacgtaatcatgcgtcatctcactggaccctcactggaccctggaaacgggaggaaagcccctccagaggtgaggctggcccatccagcttcccggccaggcccagcataggcacgcggagcggaaacccacacctcagcactgtagcccgagcttccccacgtcatgtgacacaactcgacgtctgtcggcaaccccagcactcctgcctttaactcaccttttttggttttgggaaaatttcttaaaagccaatagacatcttacgtttttaattacacaagactggttgtaatacattttgtgtattagaacccggtttccaaacccagcagcgtatggccaaagacaaatagcgtgctctaaacgtgggtgtgaggccccagcacatggagcctccctcatcctgcacctcggcccatcccctccccacgtggtccaggtcagcatctcgctgaggtcagcagtcggggtgtgtgaggagttacgagacccagtgttagatggagcctgtacatttccccgtttctgagctattattcacacggccagccgctttgcacgatgacttcccttctaaatgagagggcaggtttccctgtacatagaaatatgtaaaaatacatagaattatttttatcgggaagctatttagttatgttattgttttttacacgtggtaattaaacagcaaacgtcttgccatttcttctggatgatttctaaagagccaatcaagcagaatgtggtgcgtggtggccgtggggtacacggtggctgtggggtgtgtggtcagtgaccacagggtgtgcagtggccatagagtgcatggctcctgtagggtatgtggtggctgtggagtgtgtggtggtcatggggtgtgtgccagctgtgggttgggtgctggctgtggggtgtgtggtggccgtgggttgtgtggtggctgtggggtgcgtggtggctgtgggttgtgtggtggctgtggggtgcgtggtgcccatggggtgcatgctggctgtggggtgtgtggtggctgtggggtgcgtggtgcccatggggtgcgtgctggctgtggggtgtgtggtggctgtgggatgcgtgctggctgtggggtgcgtggtggctgtggggtgcgtgctggctgtggggtgcatggtggctgtgggttgtgtggtggctgtgggttgtgtggtggctgtggggtgtgtggtggctgtggggtgtgtggtggctgtggggtgtgtggtgcccgtggggtgtgtgatggctgtggggtgtgtggggtgcgtggtggctgtgggatgcgtggtggctgtgggttgtgtggtggctgtggggtgtgtgatggctgtggggtgcgtggggtgtgtggtggctgtggggtgtgtggggtgtgtgatagtggggtgtgtggggtgcatgctggctgtgggctgcacagtgtctgtggggtacatggtggccagcggccttcctttgggtgagccccagctggggtctgtgtttagcttgagcctctataccaacttgagatgcttgaaagatgctgtgaattgcagcttatttatccttctgcctacagttgtggtatttttcacatttaaattgcagcacagttctgggttcaatgtgtccagaagccacagctcctaccaaaggtacagtcacgggtgcaacagacaatatgggcatttctgagttgttttggctcaagcacgaatgtttgtgcagtgacactgagactaacctggcgctctccatgcagggacttgactttcataagacaagcttgtctcagagaggccagttcccctgcgtcgtttctgccatgattctgctgtgtaggcaccaactgcaggagtgtccgtgggaggaggaggaggagaggaagcggcttccttggccgccacagtcatggccgcaggaggggtcctttggcttcctcccttcctctctaccatttcacaaactcacccgtttgtgtcaggctgttttaaatttatggatttcttttaaaacaagattgtatttactgtagccttgtcgactttttaggcctttggagacccaaaaggagcaattaagcaaacccgtgcacctgaccccgccttccacccgcgtgagctgccagctagttccctggtggccgagctcacgggctgccgcaaaagaaagccgccttttatgcctgcagaggctctggcttaaaaggtggtggccctcatggtgttccctgcccaggagaatggggtcctttaaccaggggatgggagctggagggacggccagcttagccccgacagtggctcccatcaccacgagccctgttcctgccaggaaatgccagtgtctccatcttctgtgctcaaaggtggggagacccaccagccaggcagggcaggtggggtggtcatctcgcgcccggcctccctggtggagccgctgtggggctgtcctgacagccagattctccacaccacctgctttgttctcccttcatgcaaacatgacatttggttccaacgtgtgtcctccccaggcctccccgccacccctgccgttccctcctagctgcccgcagttctgacttggaggtgcttcgcaggcacctgctgtgacttggaggtgcttcgcaggcacctgctaccctgctgggatgatcctcctggagcctgagcccccactggcttcacagttgccaccccatgaagccacagaaccacagggaaaggaaattgaggaacctcgggaattttaaagcttctctcctgattcgctgggcgaggaatgtggtgtgcactcaggttgcggccggagagaaaggcctggggaccacctgactctgggccacccgggcctcctcaggtcttcggccagcgctgtcctgcccacggtagttggggttccaatggctgcggcttcttcctgtctgtggcttggacatgccattggccgcgtctctatttcctcatctgcgactcgggtgaccacagttctcagttcaccgtgttcggtagaggtgacatgaagtgcctggcacccatgtgggtttccctgtgggattctgacccgcttcggagctgcctcctgctcctcatcccacacttctctgtgtttctcatcctggcggctgtgtcctgtctgcccctctcaactgcaacacgctggagaggtcgggaccctgtcttgctcattatctgtctactaaagaacctagcaaaatggaaaaataacaatatgtgctgaattaattattagcttaaaatttaaaacttaagtagcatgatttgagtgcagccagcatcacctgccgtgagatcggtgctgtctacaggaggatggagcttttggtgaaccactgagctgggagtagctacgggcacctttacccagtcccaaaatgtggaacatttgagtttaaaaagcagaaaactctacagttaaaagccaatattaaggttgagtccattaatctaaattaatctgattttttatttctttaaataaaaaagtaatcctatgcaatcaaagttaaagttcgtatatggctccctatgaggtactacattccctgaagtgtcacaaaaaaaaaaaaaaagaaaagaaagaaaagaaaaccagtacagctttggtttctgacggtgacggcctgctgttggtaagcatcttataacaatttttcagcccagctttctggaattaatgctaatgaaagctgcccctgccttcgtcttctacatgaacactgaaattgcagccgcctgccagccggctgagggatgagcgtaataattttcaattggcctctcagcccagagggaacgtggctagcaggagattgacagatgtggcatggattatcttgtgctctgaactcagcccaatttgtggtttgttgcaggtgctaaagagattgatatcgcagcgaccctggagcacttgagggaccagagacccggcatggtccagacgaaggtactgtcagtctctcctccgggacgcagacccattcaaggtgcctctctgcggccgtgttcctgagaggagcacggggaggcctggtttaatgtgagccgcacaccgattgctctgctctgaccggcctcgtccatgccggccttgcatgggcggggtcacttctgggcccccaaaggtccactggcgtttcctgcaacacctccagatgcagccacatctcaagtcctaggaactcgatccactggctctttccattcactagatttgggggtggggggagaacgctgcatttttgtagaaagaggttgacgataaatcccagaaccctcaggaggatgttctgagctctctgagcgctgcccggcctctccggggcctgcgctttgtggaggcccccagggcacagcatccttgagcacccaaaatccctcatgcttgctgaagaggcccagtttgcagcaacagaggtcaaaacaaaaaaaattctggtgagctttggctcaacaagaactggacgtgaggttgacgtgtgtctggtctctctggccctgaggctggggttggtgtgcctttggcctctctgctccttggtttcatttcgccctctctgtgcaactggtaggaccatcacgtgattttgtgaaagttctttgtaagtcttgggacactatattttattcggtttttgttgttgttgttgtttgtttgttgttgttgttgctttctgagacagagtctcactctgtcacccaggctggagtgcagtggcacgatctcagctcactgcaacctccacctcccaggttaaagcgattctcctgcctcagcctcccaagcaaaaaatataaataaaatgcagaaataatccaccaaccctccaccaagtttccccaaatgtgaacacctcacataaccacagcgcagtgaccaaacccaggaagtcagcaccgatgcaaaccactgaccaacaggcccagcgatgccctacgcgcccccccagggagcttcccctggagcaggacacgcccagggcggccacgcgaggggcatcatggttcctctgctgtccgggacgcttcacggctgtgaggtcttctagagcgccagcggccttgctctttgtggaacgtctcttgtctaggcgtgtcccacgtcccccatggtcagggcagggggcaggactgtccctcacgagggagcggcacatctacacccactgaggcgtgtgtgtctggaggcttctgcgtggctgcgtgatgatttttccctgtgtggttactcagtgtcccgcggggagaagctgggactgtgcacatgtctgtctttccttctgcttgttcacaacagcattcggcatgtgttgcgaggctgtcgagagaggaggtgacacgggacagctgctgttccagcagcaacagccatcaaaacaaaaaagttctcatgagctttggctcaacaggaactggacgtgaggttgacgtgtgtctggcctctctgtaccaaggagttccaggttttgtgccatggaagggtccaaccttggaagggtccatcttgcctcactgaccatcctcctgtactggctgcctagcagtaaaagaggtggccttgtcaaggctggcacataccaccttctggctggccctgcatcccgtgagcttcaggtggctctgaactggacagaggaggccatggaggctgggagaacggggcacacattaccaggaatggtcagcgagagccacctcaggcaggtgtgttcgtgactccacagtgaggcccactctgggataagccccaggaaatctaaattcaaagtagtttcctccccacacctctgcctgcctctcaggcagcctctccctccagacgggtgagttcacccagaacacctgcctgtcaggcagcctcttccctccagacaggtgagtttgcccagaacacacactggctttaggatgggtctgggcaaaatcatcgcaaggggatatctttgccaaaagtgaaaaaaatcacaaggagcaaaccctccaagcctcccattgtgtgtatcctgttcgccagaacaagcccttcctggcacacagatggctgaggtgcacaacggtggtcccaggacccttcgtgaagtgaggtgctttgggactcatcagagaaagaggaagccacagtcacaatcattacatgccaggtcttccgttctactccatttttaaatggcaagatggcagcaaagacatggaaccaacgcaaatgcccatcaatgatagactggataaagaaaatgtggcacatatacaccatggaagactatgcagccataaaaaggaatgagatcatgtcctttacagcgacatggatggggctggaagccatcatcctcagcaaacaaacacaggaacagaaaaccaaacactgcctgttcccacttataaatgacagctgaacaatgagaacacatggacactgggaggggaatagcacacactggggcctgtcagtggggaagggggatggggagcatcaggatgatagctaatgcatgcggagcttaattcctcggtgatggattcatgggtgcggcaaaccaccatggcatacgtttacctatgtaacaaagctgcccgtcctgcacatgtatcccagaacttaaatataaataaataaataaatagcaagatgataacacatacacaccccagccctgttgcccagatcacttggtgacccgaagctccgttttctgcactccagataacagagtcagcttcctagctgcttccttcttggactgggcgtccggaggagttcaccctcttcctcagggtgtgtgttcaggagctgtcttggagcatgcacataaattcagctcctggaacttcaaggcataaggaaatgggaccatgcgaaagtcaccatcacatcttaatccgtgactgcgctgcccaacatcgccccgagactaaacttcccctagaagttcagtttcacaaagatagaaaaattatttgggcaaaatgctgctgtccaatctgaatgcttgcttctacgaagccaagaggaggcgcctgcagctcctttgaacggaggaagtcacgtcgcctggtttggaactgaagacaaggaaagagcgagccgtcgagggtgagcacccggagaccatgaccaggatgaccgcaggccctgacagcaaaacatcatcgttgtggtaaaaaagatgcccctcaggagagctgtttcctccctggaatttgggtcgaatagaaaatatttcaccagcgcccacctgagcatttggcaactcagtccccgaccacaaactccatcatcttagaagagaagtccaggcacccaggggctgaacggcagtgcgggctttgacaccacacgagccgccagagaggcggcacactcagccacacacactgcgtacacccacacacctgcacactgcgcacacccacatgcagccagggacactgcacacccacacacctgcacacacccatgcatacatccacacacacctacacacccactcacgcagtgcacacccacactcagccacacactgcgcatccccatgcacacacccaggcacaccccccacacacacctacacacccacgcatgtggtacacacccacatacagccgtgcacactgctcacacgcacacacctgcacacagtgcacacctacacacagccacggacactgcgcacacccacacattgcacacacacccacagacacccacaaacaccactcagccacacactgcacacacccacacacctgcacacacccatgcatacaccccacacacacctacacacccacccacggggtgcacacccacacacacacccatgcacactgcacacacccacacacctccacaggtgtacacacggtgcacacccacacacagtcatggaccctgcacacccacacacctgcacagctgtgcacacccccacacacatccacacacccacctgtacacacccatgcacacctgcactgctgcacacacccacacacacctacacacccacacacgatgcacatccacacacagctgcatgcacgcacacacacccgcacacattcccgtgtgcacacaccctcagcagacacaagggatgccagacaaggctgaaatcacccctctctcccgtccatgcctctgtggtagatgatgggttcttcccttccttccctccacacgtctcaagagtttcccatttcaccaaggaccttaacactttcctgcccacaatggtgtttcctcttttacatctgtcagttccagaagtagagccagtgatgagtgtgtcccacacccaagaagccccacgccctcctcactggacgggaggccccgccccctcctcactggacgggaggccccgcgcatgtccacgtgctgcccgtgcgtcactctccccaacctgccgtctcacatctgcattttagtttcttccccattttcttctgcaccagccccttgtcctaaagcctgacctcagcctcctcctcagacgtacccggtgttgtcctccgtcccagaagcagggcgttgcccagacatgctcctatcttcccaacccagcacagcaccggagtgacagacacggattctgtcacgcgtagcgcagtccacgctcacacgtcagctccaggcccgcagcccacttctcccaaggcctcccgtgccattgaaactgttcatttccgtagctctccatctctctccacctctctccgtctctctccacctctctccgtctctctccgcctctctccgcctctctccatctctctccacctctctccgcctctcttcacctctctccgtctctctccacctctctccgtctctctccacctctctccgtctctctccacctctctctgtctctctccaccgctctccatctctctccacctctctctgtctctctccatctgtctcccatctctctccatctccgtctctgtccctccgccctggtgtacacacacacaatgcctagtccctaacttgggcagggctcaactctcacggtgtggcttggagcttgtctacttttgtgaaaagagaagctgaaggtgacagacacaggaaggtgtgtcatcctcacccccttttgagaggtgctgggggaagctgccccgcagttatgtgtgcagcctcctggagggcacaggtggctcagagacacgctcactgaggtcccctttaaggttcctatttgtacatctccacccaggcctttgtttacacctgaaggattacaaatataaacataagcacaaatcgaaatccaagcagcctccacaaagctccacggcttccagccctggctgacccttaccccagcagcgggtgtccgagagccatggcagctcctgcagcctccatccctccaccaactatgtgggcaccccgtggttgtcccaggacagcctgagaaggggcgttcccactcgctgtccagcgtggacccaggggtggtgaccagacagcctgacctggcctgagcctggctcggccgtcccacctcagccacttctccaccgggtgcagttctactggaagaagccgtgggatctttctccaacaggcctcaaattttattgtagtatgtgttcaaaaatgctttcttgcttagaatgtcctgactcggcctctcgaatgtcctgtctttgcaaacccaggaggctttgcacccctcctgttcagactgctggcactcagatgcagtttaggctaagatggtcatctggtcatctgttgctgttgtattttactcctttgaaataaactcctatcataaaagttatccaaatgctggggttttcccagcctacccgggatctagagcatgggtctaggtgatacttgctcagcggattctgctcagaacgtggccacagaccttcgaggacccacagggcttgggtgctacatcccggcgccgcatgcagctgacacttcacgataaaggacaagatgatccacaagcccctgtcccctcaaacgccagctctgaggctcacagcacccctccgggaagcaccccctcctcctgccagccgacgcccacagggcccagtgggctctgagtaaggtgcacggcacacaccagcccacacgcccggtggagcttctcctttgagctaaacagtgcggtaacaattgccaaacatggccagtgagtagagcacctgtctctgtggcccggttcccttcctgctgctctgtccggtgactgtgcagtgttggaaacagttatgatccagaccctggtggagttccccctgcccgtcccctcccccatagcatggatattgggctttcctgttggatgccgcaagtggctgcctgagaggccgctgggcagctctgcaggattagcactggccctgggggtggagcgctttccagcctccactgcatgatggggctgcggggcggcagcgcttctctattcttccctttaaagatcatttctcaggctagatttccagtgtgtcggaagatgtaaatagatagatgacacttgcatttcgcttcccaaaaagccacgcttaatttttggcatctccaagccctcacagagcctcagggcactggcagcccagcactggggaagaaatggtctgaatggctgttgtgtatttagcctggatcccctaaacagcaccttcatcgaacacacttggtgtgggaggggcaggagtcagcatttagacagaacgtttgcggaccttcccggcacagcccgacctgagcccctgcccccacaggggcagctcccacgtaatttcgaggagcagaaaggtgccctctggcagtgcagaggggagagagacggggcgcaggcagacacatctccccgggtcccaccctgaggtggccgccaggctcagttgactcctttaataataggttctaacacgtacactaagaggccgcgtggccacactaccaaaggcaggtagagtccagcagaccattccgtcagcatcagggcggaagaatatgaaaggagaaactgtcttttgtctcagaatgagcatcacgttattttgactttctgatgtctcggttcaagctattttccatcttgctgttatgcactaaacattcaaaactggaaattaatcatcgtttttggcttggggctgccctgttccttaaatgatcaagtattggagctgtcaacagggctttccttccagaagttgttagctgggtaacagtgttgtttccgtccacgcgttctcagctgtagctggagtgctgctggcctgctttggagttttccatagcagtgttttgaggtggaaactgaagagcaagaggaaatgagcatttatccacctcatctgtgggagaggaggcagatacgctctccggcgctaagccctggtctttggaggagcgaatagtcctggcatcgtgaacccgtccctcgtgcccactggatgctctcggcaggctgtccgtggagggaggggtgcccctcaggtgtgcctgcccaagtggctgtggacgcgcatgccctgagccaggaggggtgtggacaaggggaggtttctcagcatgtggaacggagtgggtttggtctgagtaacaggtggatttcaaaagcgatgataacaccacacttccgaggacaggaaacgcccaagcatggccctcattgtgagttttaatggccacgtctttgtagtgtctgcacctgcccctcacaccgtccaccaaggcgggtggctgtgaggaggaatcgtggagtcgtagggtcagaaggacagggcagtacgcaggaaccgttgccttctcgctgcttctgtgggcagcttctccccgcagggggaaagatgaggcttttctagtgcgagagaagctcaaacatgtgtcactgttgtgtctcccaaaccgaagggtacactgtcctttctaaggaaatctgagccttttgcttttttttgctaaacaatttctttctgcgaaatggcccggggagctgatgctgcgttgggaaggggggacgccgctttcatctgcagggagccgacactgtggcaggagtcggggggacgccgctctcattggcacttctctcgtttctcgccctgcaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcacattcaggtggtctttatttggggaggaggaacaattgtttccatccgtctttttgtttcctaagccactggactgtagatgctgaaacaaagcgtgggcgtttcctagaactccaggtcatgttgctactttatctgcagcattagatgtgtactaagggccagggtgtcgctgaggtttcatctttaaaacaggattaaacagtctcagtaaggagccgcagatcgcatccatgccacacacgccctccgtgcccctccgtgcactggcaccacctggatagggcaccctggggtgggagatgcccccttcctccccattctcagtcctagatgctaacaacgggccctgacccagtgaggctcataatgtctctcacctagcactccgattccatctagggactgtccttctgtccttggtgggaagggagacctcgtccccaccagccacacaatcacacccctccacctggcaggaaaatgcagcgggaatatttaaactgtaagcaaagaggcaggcactccggggcgtggtgcagcgaccaaccttccgtcctgccctcggctatctccactggcaacagtgagagaccgaggacagcagagtgggctcgtcccaaaatcaggtaactcctaagcagtgccctccagctagaggagcttggtgtttaagaaacaaatattgaatgatatttgttaatgcacaggaaggaaaacttgattcaggaccagcacaattggtacagggagagtgccgggggattttgcagtgggggagagagactgggctcgtctccgtccatttcacattgctctgaaggaacacctgaggctgggcaatttataaggaaacgaggtttttggctcatagctctgcaggctgtataagaagcatgacgccagtgtctgcatctggggaggccccgtgtgtgtgcagagctcagatggagagagaggaagcaggagatggcatggagggagggccaggctctttttaacaaccagctttcatgggaactgccagagtaagaacttgtcccccaccccagagcattaatctattcatgaggtatccacccccatgacccaaaaacctcccattacgccctacctccagatttcaacatgaggtttgcagagtccaatactcaaaccctagcagggctcagctccaaacaccacatgggcagcggggcttcccagccaaggagtgggctgggatgagtggatggagagttaccaaaaggaagcctcagggtcaggggattctggctaaacccacctaacagggttcttgctgaaggcaagccagggtgaccgccatcacctggggatggtggaggatgagggacccaatccgatatcgagggtgaaaaaatatcaaggtgatcagatatcaagaattgggggggatggctcttgctaaactgactttgcaggattctttgctgaaaatgtcattttacaaggacatgcacagactggcctagaagaaggttccaaagcccgactaaaggttggtcaagcagagaatctttacacctttgttctcttctttcctttgaaaaatataagttcccgttcttgttttgttgccttttgttcagtgaggactggcagagtcaccagctggggcttggtggtggaggagttcagctgggtggtatgaggcatcagggctttagtgaggggaatttagtttctacaaaaagaaaaagaaaaatagttgggacaaactatgaactccgattctgagcccagagggcaggcagtccagaagctttctagatgctgggctggtgcatctccggctggaggggagcgggccgtcctaaaccacaggctccctggttggcagtttggatgccatgaaagttgtccctatgagtgctgaggtttatatcaagtcgtccagctccagcttgcaaggcttcaggaaaaaggcaacaattcccaatttgaagaatggaagaaaatgggaaataatagtttggaa

SEQ ID NO: 12148 - DNA, 22614 bp, Human
acatgaagaagacctatggggacaaagaggaaggccatctgggctcctgagaattcacccacagtaggtgctgctcccgtcttccggtcttattctggaagcaggatagtgtggtagaaaggagcaagtgctttggagtcagagaaccggggctgaaatcctacctccattctgtgatcttaggcaagttgcccaatctctctgagccttgttcttccatcattagtaaaaaagagagggttttgcctacctcttaaggggatacaagaatcaaagtgcgatgctgtgcacacagaacccagcacactgttcaacaaacaagtgtaattattttcccaggccccagccagcgatcttcctcaagggttcatcctcaaggttctcctgcatcccggctccctgagctcagccatgcccacgacttgacgagatcaactccttgacttctctgatgacaaagcccccagggtccagccctgacctcactccagagttcagacacatctccgccagggtgtccttcaggtcccctaaacccagcatcagctcttggctcttccactactctctgggggatttgggtaagtcaccctggccttggtttcttcatctataacatgatgtcatttgtagaagtttgtagccgatcaccacggaggctgtcccagccctaacatcctaggattcaacaccacttactctatcatcccttcgactgagcactacctcctccctacactccctgccttcaaagtcaacaccttccttcttcagcaaaccccaccttgaatatttagggtcagcttggatttgtccctcttgttcatgccacagccccaattctggaagcttctctccaagaggtgctcccctatctgcacactccttcctgttgccaccaccagcaacctagctcaggccccagcaccacacctcaaggaggccccagtcccagcttcccccatgcagcctgccctcggccctttctatccatggagcttccaaacagcctttgcatggagcctgggattcctcgtgtcactgtgaagaactagaccccaccattgacaatcttcgtgccctggagattcttttcaggttagggatgaggagaggaacatttcatggtggtcagattagatattcactacgtatttattgaattcatttggtcattcatgcttctcaaaacacatccctcagctggtcctctccaatccaaaacagacaatgtcagagatctctttgcaaatcatgaagggcttgggcctttgtgcctcaatgtcacacgcatacaatttcagggggtccatcttcccctcgccctagaccatctatagggcacagtttacctctgattgagctcatgttacaggtggaaagactgagaaagagagaggaagggacttgtctgagaatatgcggaacatttccttctaccaggcactagatcctcgcacaaaagtgctgagtccgctcccaaccccaggcccgtggctttgagcagcaggtcacttaacatctaacgtctttatgctgtttcctcatctgtgcgagagcagctatgtctacctggcaaggctgtagtgagagatcatatcagcataggaatggggctcagccccatgcacagaggacagttcttgtttcattcttttccttgctgtttctcttcctttcctggcagaatatggaggaaggaagcatcgctgccatctacagtggtcacggaaggcttcatggaagaggcgagccctgcctgggcctcaattttgggtgctggagggaagcaggggccaagagttattaatagtcttggcctgatgggcccagggaggctgaatgtgatacagacacccagcaccacggttggggagtacctgacaccggaaggggagggggccggggctacggggagtgccacctcccaaaatagccagagcagaagcctatataggtggccatcccacctccaggctcacttcccgacaggacttcccaccagcccagcctttcagtgcaggctccagccctccacccccacccgaggtgagtggcagctaccgaggttggaggatagagggatgcagcaggatgagccagctggaagggagagctacatctcccctgtccgtagtgacccggggaggggggtgcggtgggggtgctggaggcagggcagctgtggaatgtagggctgagagcatgcattcctgcttctccacccagactcctggtgtggcctggggcaaactccccccacccaccgccccccgtggctgggcctcagattccccagccttagaacgagagggctggagtcagacatctgtggactctggtgatgccatcagagaggacccagagggcagaggaggactacccagggctgatgggctgacctaatgacattgatgctctggctgggagggctcagtcccggagggggtgtcaagttgataggagaactcagcagcagggagagatggaggaaggagatggaagaagagtgggcccctgttgaggctgcagcctttgccacagggtagctgcttaggggctcaccaggagccagtgtgtggctgagatgtatgggacctgatagagctgggtcccaggcaccagggaggatcacccagagagtcactgaactccacacgagtgagtccaggggtgtaccctgctctgctattgctttaccatgtgtccttagaccattcacggactctgtgcctccgtttctccactggtatagctgaagcgtccttcagctggggaaatccattctccaactaggctcctggagtgagctgagcctgggagttgaaatgatagcataggagcctggcatatctgagtcagcagcccagctggggacaaggtgcagaggtgacggcagtagcagcagggtccagggcagctgaggggtcctgggaagtcctggagctgagaggcatcaggtcaggagctgcatccttggtgccttggaagccatctggcgggctgtggcttgaaggagctgactcacagggagggggcagctggagccagcagaggtatcctaaggtttccaggaagggcagccatccagggctgagctgcaggagacaatgttgacagcgatgtcagggaacttgagttactgggcagctggacagctgctctccctggtccccaccacccagggccaccacagcccaaggccctgcctacctgccaataccttaagttgcagtccccaggtcccactacatgggaccactgacgtcatcaacacatcagaaggagacagaagcccagagaaggtcacaacccaaggtcacactgggacttagtgcagcccaggatctagaacccaggcctcctgactccctgtccagcgctcacacactctagaagcagctggttgcagcttgaaaccttgggaaccatggggaagaacacaacgggtctctggctgcatacagataggcaccgtgacatttttccagaggtgaagttcagacccctacacctgcttaggttgtctagaaagtgtggtctgaaggtgctacccttcttccaaacacatatggggctttctgggagggagcatagcaattccaagcggactctcccaccctactctgcccaaaaaaggtttataggagtagggggagtctggacccatgatgccaggacccaggagaccaggaaagcaagtagttagtagagatctgagaagtgttcttcgaaaaatcaagccagcaaaaaaataaaaaataaaagtaaaacatcaaatcaggttttagaatatgcatccctggccagatgtgggatggggcacccgaagtgggccccagcagctcctgcctgtccctgtccctgtccctgccacctcctccctgcgtcgggtgggtcaggtttcaggacctcagcgctcagattttgcagcataaatttgcatccaggacagaccagagcagaggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcaggtggactttccagacccagctggtgacgccagtgccccctaaatcccagaggtggccccttccctcgtgccctggccgcagcccctgggatcccgcggacccctggcctggcggtgcaggagtggtagcaggtccgcgcgccttcttgccggcggccggcgctgctcagcggcgcggctggactgagccgctcccgctgcgctcagagtccgggcccctggcgccatgccaggcccggcgggcgtgcgcccggcgcgcagcactgcagcgctggtcatatgagcagaaatgatgagaaaagcactttttaatcttttcgcacttgctctgcccgctcaaacagttgcaggatgtcgatgacagacttgctgaacgctgaggacatcaagaaggcggtgggagcctttagcggtgagcaagcgcgctcccctccccatccctctcccctcgtccaccgcccgcgcccctgcactccgccggccccgcagccggcggatcctccccagcgcgcttctgcccacacttcccgctgggcgccggcgaggtcggggcgggggcgtccttggcagttcccaaactctgtccgggcgaggcttggcgcggggagcgggcggggaagagggcgccccgcctaagttacagaaacttgagggtgctgaaggcccggtggctgggaggactcagggtccgggaccaagggcgaagaccagggtcggaggagagacctccagggtccttgtacgagctctctggacgtcctctttaaggcacttagaggggactgcagggggcatcctcctctccaagagacccctttcctggaccctcattctggacaggacttttcccgccaggcggtagcctttgttggccccctgactgtcctagttcctttactgagattcagcaacggacctgcgggcgaggtgaccttctggagccggcgcacagctctgcctaagcccgcacggggcatcctcagtgcctcaaacctccagcctccttaggcgggcaggggaggggaactggcagtctcacctctcccagctgcccgggacttcagcgctaagctgcccgccttcctcctcccctgtcctccagatggggaaatcagggaactgtcttggagaggacaagacatttgcccaaggtcacctagctgggcagaaggggtattagaactgggttgcccagcctagtgtcggaggtggacagggcaactttccttgtctctagccctgtgctgaggggaagagaacatgacttcaacagccattccctacacacacacacacacacacacacacacaaaatacatgatctaacattgtacccttccccaggtgttctaaaacaggaccccaagatacagaaaattgcaggtagaaaaggacccccatttcctttctgctttgcaccccctcccctgggcacaagaacctctctgggaagccaccctcccagggtcctgggataaccctctcccttcacctcaagcccatgtgggaagaaacttaactgggtgtttctcgggagcctcctaacacccccttcccactgcctccgaagtggatttctgcgcagagccaggacttccgggtttgcccctcctcctcccactgtatgaccttgagggaaacctgtcctttctatgtcaattttctggcaacaaagtctgtggccaagaaagaaggtcaaccctcctccccctaaccccaggaccatgttcatgcccccttcaattccccagcccactcccaaccagctggcactcaaaagtcttcctgggcacaaggttctcagaagaacaaaagcctttggttcttaggtgctgctcccatcatcagcaatgggtgcagtggaggtggggtgtgggggcgggcttgagagccagggaggtctgggtttgagcacacctcttccactcccagccttgtgaccttggacaggttatcctcccttgcccgggctccctcagccctccaatggaggtgggtacctctcattccccatgactggcatgtgggaatccatcaacaaatgccttgatgccccccattctcccaggcttccctaccagcctttctggtccttgtttgaccctgctcttccccccacagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctggggtaagcggaggcctgcaggggctgcccagcccacggctgcacgagagggagtgggggctgggactctagcttccaagtgtccatcagacctgcctttcactctgcctgcttcacagaaagtaaccgtgcgtgaaggcagggctccgacccagggcaccaggggagaaggcttcctggtgctattgcttcggaagagtaaaaccctcagctgaaagtgcaactaactaggttaaatgatagccacttaatattgctaatggaatgttgctacttaataatttaatgcaaatgaagaggcagttttcttgctgcctaacaccataggcagggcagaaagcattcacttgagtatttcattgattttcatttgtctaaaagacactttccaccttcctgcagcccccagccctctggtactagtgtggctggtgcaatttctaggcaagccagggatgcagaaccacctctgagagtccaggggtccttggagaaaagcagagaaggagaaggctgtggctaggaaaatgcatgcctccatctgcaaaagcatctcccaccataattccctcagccacccggccatgtctactgactcaggttgccttatgtcactttctggccaagaaagccttgagttttgtcaaaaagagaagcggggggtgggtgtagggagaggcctttcaagtagggacttccccacccatcctgtctctcccctaaaccatctcacaagggtaccttctgtctagaatcttcacgttctacccacttacatccaacatgcatgcacacttatgcacacacacacacacacacacacacacacacacacactcacagaggctgacttccccctgtcctccaggtatcaccttcaccaggaagcctcccctctcctcccctcaccgcaggtgggcagatacagcttctgagtgccctcctccacggcccatcacactgtgtggtctctctcggagcccgtgacctccttattttttccagtgccttccgaagatcaccactgtgaccccactttccagcatacgccagacacagaaatgacacttagtgaatacttgttggataaattaacgaatgtaggtgccctccctgaagtgaggacaacccttcactgaggacagcctgtcctttcctaaatactcacccacgaaagcacagccaccgagcaggctacctggcccagagcatccgtgtgcgtgactgctgctcgctgcctgtcccagccatccctttccccatacagaaaccagaccaccctccatccagcgtcctgcaaggcgacctcggcctgactccctcaccggctttctcccttttctcctccagattcatcctaaaaggcttctccccagatgccagagacctgtctgctaaagaaaccaagatgctgatggctgctggagacaaagatggggacggcaaaattggggttgacggtgggtagccgtgacctggggtctgggcatattgtggatcttggggtgttggatgcgaaaagtttgaagctatgtctgtcacaaggaagggatgatatgggggtccctcactcccccagattagaagacaaaaagcagtccattaggtctgagagctctgccacatactccagacaaaggaaaactggtgtattttcctaatttgaaaacctaaaaggaatagattctgtttttcctgctgggtaggggatccaggaggatttgggatttttttttcctgaactctgcctgcatttttgcatggatactggcccaacctctgcccaaactggctgtgtgaccttgggcagtgtctctcgatcgctgggcctctgtctcccatctctaatccaaggaaatgaggccgactaatccccaaggatcctctgcctctcacatcctcagattccagggatggaaattcctatctcctgtcctcctcagcatcttgtcctggtgtcctgtaaccccaagtctcaaaacctgtttgggttttactcaaatatactattctagccttgcagcagagccaggaaaaacagtaaaccagaaatcagtggggaattcagacagggaatacctggccctgccttgctttgcaggcttcaatgtcagcacaggtgagagaccagtggcccaccgtccactcctttctccatttggctctgtgtggcattcatggagcacacccacattgccatctctcttagcttatgattttctccggaattatctccattttgcaggtgggcaaatggactttgaaggtgcttagcctagttgaaagagctaggacatagcggtggagtggggatttagaaccaggcctgaatgagtgtttgcagcatactaagctgccatttgctcccataataggcttttctgctggtctcagagaaaactgtgtgtaggtgtttggcctctgggccccaggctatctgggttcaaatcccagccctaccactttcgagctgtgtgaccttgcgtaatttgataactactctgagcctctgttttctcatctctgaactgaatagaatgataattcttacagggtgattacaagggttagatgtgttaatatgtaaagtgcctagaacagtgtctggcacagagtaaatgttatatatgtatttgttagctaatttttttaaaactaggtcccttcgcaagggtaccttctgtctagaatcttcacgttctacccacttacatccaacatataagtggatgtaaaacttaaaactagggattgggttgcattcatccttctagccccagtatctagccaataccccacacagagcaggtgcttcataaacatccgctgcctgagtgtaaagcccagacccccatgctctgctccttctctgccccttgccagctgtgaccttgaacacgtcacctctgcacacctacgttcccttgcccggcaaatggggtgcatcagcttctcctaagacctatttgggcttgttgtgaaaattaagattctgtgaacacaaaattgctttgggaaaggtacaaggattatgaaagtaggtgtatgcctatgagttagagggttttttttgttgttgttgttgttgatttcttttctgtttgtttgtttcctgccagtaacgagaatggagaatccctatccaggtcaaatgcagggggtcccctggccatctgatgccagctgcccttcttgtggctgggaaggagggaggtggttttaaaggagtggagcagagggtattggaaaggcatcattggcttggccgctcctggggcttctggtgcttggcagatcctccctcacacccccatccccaccaatctgcttatcagacagctccaccccaaggcctggctcccatctgaaccctgaccctggcctccagacctgccttccatttttatttgcagccaatatgccatacctcagaagccctgggctgggtcttcatggctgactgctcacagaaaacctacctgatgaagagaaaccagccaaacctggcccagttccctgcctccctccctccctccctgccacactcagatcttaaggcatcaactaaactcttctaacagatccagcagatgttgactgagtagcaactctgtgcccggcaatggaagaggtaaaaataattcaggcccatttcctgactgggtgcccctgagcagctactccttagccctgagccccagcttcctcatctgtaaactaggcattataacatggaaatgtggcctgtagtgcccagcacataacaaatgctcaataaatggccactgcaatgccttatttatttatttatttatttatttatttatttagagacagtctctctctgtcacccaggctggagtgcagtggtgtaatctcagctctctgcaacctctgcctcctgggtttaagcaattcccccctcccccagcctcctgagtagctgggattacaggcacgcaccaccatccccagctaatttttgtatttttagtagagacgaggtttcaccatgttggccaggctggtctcgaactcctgacctcaagtcatccgcccacctcagcctcccaaagtgctggggttacaggcatgagccactgcacccggccatgcaatgtcatttttattgtctgcaaattgcttgcagctctacacatatacacaaacaagcgatagtgccagccagaggcagaggcgcaggcatcaggcattttgtacggacttggaggctaagccacaggctgtaggggacagagggagtggggtccaggcaaggtattggcatcagccaaggctggaaacttttgggtatgttcagaaaggggcaagaagattgttttgccaagaatgggaggaaagaattattagctgggcatgtcatgtgtgtccagcctagtgctgggtttggttacctcatttgaccttgggacaacagaggacataagtgcagatgtagaaagggcagcccagggagtgagtgcaaggtcacaatgccagcaagtgtcagggccaggattcaaacccaacagcatggtccaggcccacctgtgcagcctccattgagctcataggcaagacataaaatagacaatgagcacagaccaccctgaggcactggggccccacacttcatgcttttgaggtgggaagatgcagatgcccccttcctcactcccaaccccctaacgcaggaagggtgggtgcaatgatgcccaataggcagcgagatgggaagcagagcctttttggggcccaggacgttctgtttcagatactctgctttgctgtcactctctctaaaggccagaaggcccgagccccacctatagctggaagatgccttcaactcctggcgggatctggggcatgtcccagagcccctctgaccataaagtgccttgtctttaaaaccatggggcatgccgggcgcagtggctcatgcctgtaatcccagcactttgggagtccaaggcgggcagatcacaaggtcaggagttcgagaccagcctggccaacatggtgaaaccccacctctactaaaaatacaaaaattagccaggcgtggtggcacacacctgtaatcccagctactcaagaggctgaggcaggagaatcacttgaacccaggaggcggaggttgcagtgagccaagatcacaccactgcactccagcctggacagcagagctagactccatctcaaaaacaaaacaaaacaaaacgaaaaaccaaaaaaaaaaaaaaaaaacatgggacatggggcagatcactagccaattactggggtgcgttccagccccgggatttcacagatgtctcagtggataaacctctacacagaagaccacttcactattttggctcagctgcgtgaccttgagtgatgatggcaatagcatctaagttcatagagcgctcaatatgtgccaggcaccgtgcttagcatttcactcatttaatcttcctagctatctctgaagtgtatactattatgattcccattttatagatgagcacactgaggctcagagaggctaagggcttgcataaaccctttaggctaggaagagaaaagatcaaagtctgaaagtcgggtcttttgagctccgaagcacgtgacctgtgctgcctgcttcattcattcattcattcattcatagtttaatttactataagatgattatatttattgacttattgcctatttctttctcctccactaagatgtcaggtccactgagcaggaactttgtttttttcagttctaatcccagcacctagaatagggcctggcccatagtgggagaaaaagaaaagtgtatttggttgaatgaatgaatgaatgaatgaacaagtacccagctctgggcagcactgtgcagtgatgaggatcataactgctgtatgtagtgggagatgatctgcaagccaaggttggggatctgtggagacttgtctgtagcaggtgccagggagcccaaaccagggactgcctctcttccctgctctgtttgtccttctgaaggtgagtgatacttatcagtttcttgaagatcctgtattgaagggagggggtaggaagacaaagttctaataataaccctttgcattcccgtctctggggcaactacttccaggaagctcaaaggcttttatagatgtggttgattcattctcaaaggccaccctaaaaggctggtgcagagctgacatggggagggcttaaggctgaaaaggaaagagaagctagaaaaagaggtgaagggtgccaaaaaaaaatctttgttaaagcacctgcagttgcaaagcccaggcataaaaagcagacaaagcagactatgtggcaggtggcttttcaaacacttcaccttcacaacaggtctccagctgggagcgggtgtcagcatcacctggagggcctatggcaacacagatggctgtgccagaccccaggagtttctgattccttaggtggagcccacacttttgcatttcttacaagttagcagatggtgctaatgatctggcgaaccacacttagaagaccactgccttacaataatcctaggaagtagatgccgtcactatccccattttgcaagtggagaaactgaggcatcgtgagaagtgacatgcccagggtctctctgtagcagagctagaactgaggctcggtggtccagccaggaccctctgccatcctgcctcacacgagcatgtgtccccagcctgggccttccaaactcaatgcctgcccccgcagagtgtgttgaccaacaggaatcgaggttagcattcatccccacttcctgtgtgccaagtacagcacacaggccttacatcttttaactcattcaaacctcccaacagctctacaagatatttttgttactgatacatacaaggaatctgaggcccagggaagcagagcgacttgctgtgaagcctcagggccctcttcaaaccttgactcctaatatcttgctgcagagaagatccgcatgccccgtgtgcacacgtgcctgcacgcagtcctagttacattcttcctgaaacccattcccggcgatggatccactgccctctgctttaagtgtgtctcaactcaagagtttggggtttgcattttgcttctgttgctgaaacatgtagtcatcattattgcctaaccttgcaacccccccaccccttgccactcactcgcatgcctgaaggaatttgccttttctgcttccctctggcaaaatctgttcccttttatccttaagtagcctatttaccgtgagaggcgtgagaggcggagtggtagcgtaaggccttgggctgtggtggagcacctgagtcaggcagaaattagaaagccaaatgctggggatcagccgtgggaatggctgtatcttttcctctctcaggacatccattcccacacctggaaagtggggagaaaaatacacaccttacagggctgttgctcgaatgaagagaatgttctagaaatgattcctttcctcttattttatgggaatgttttgctcgtaagccacccaaaaccttttaaaagtggtggaatctcaatcctcaacagaaaggaaattgagtctaaagcaggagaaaagtgagagagatagaaggagaatttgccgttctccctgtaattctagccctccggcctctatggggatttgatttctaagtaggacaggatgctcagatcaaggctagcccagggttttgagggcagagccctaaggtgcacgatgctttgtcccatctcattgcaccctggtaccagctcaatgaggtttaggggacactgtgatgcccactgagagacttgaaaactgaggccccgtagacagtaagtgccaaagtcacatagaagtccttggcccaacgggacccgggtctcctgactccaccactccctcccctaagctgagctgagacgttttagttataaatggcttctgtgcttagcaatctgctctttttattcccgtgtggactttccctagctctggccttatgctgcactagaaaagatttagcaaggggagaggaagcagccttccttacataactggcctcttgtgaaagggagcagctgcttggtggaaaaagacattcccctccatgcatccctctccttctgcctctgggggttgcagcttgagtcagaaccaggaccatttaactccaacctttgaggaagagacgcaccctggccccagccacgcctgttagaatcttcctagctgagtgacacagtgacactcagcctcagtttctctgtaaacaaaatgaagataagagagccgacgaggatgaaatggaataacacaccgtgcggtgcctggtacagagtgagccccagaactgttgacgcggcctccttgtggctgtctggcttgacccggagtgactctgcctcccagttctccgggatgggaaggtgatccctgtttgagataccaatttataagaaaccgagcccgggagctatttagaggtgaggtgataaaccaggaggccggctccttcatcccggtcatcacgacagagggagggaaagagccttccagccgctgactcaatggccggctcagtttcgctttgggccatcagcgtgtgttgctctcacctgtcaatagcttctaaatttgtccaatccccgcggccttggactgggacagacctaattaggctaatttcagtttcctaagggaaagaaaagaacagaatcctctagtcctctgatcctccctctgctgcctccttcccacccccatccctaccatctacctcctttgtcgctttctggttggacaatgatgacatctgcaagctggccccagagggtcttgggcgaggatttagactgcaaaagtactgctgtcctttcatgtcttagaagagaatgaccattctggatacctccaaaggaagactgtctcttctacctgtcaacattaagagttgatttagtcgcattcccactgtgtgccaggcactgtgctgggcactccttctccattatcttatggagcccttaccataaccctataaggagatagtcccagtatccccattttatagatgaggaaactgaggatcaggaactaagttgccacggatggatgtgccggaggtgggatgctagctctgatgggatagatgggtcggaaacttgtaccaggtcagctggctgctctttaggctttccgtgccctctgtttatatcttccttgtcttgcttagtttcaggactttcgtagttaatgttatgtcaaagctccaacctgtgtctgttgtgctggggagatccacacgggaggcggaactaacacttataaaccagttactgtgtgccaggcgtactaccccatctggtctttctaatagccatccaaacaggcattattatacccactttacaaatgagaaagctgagcctcagagagctaaagtagtgactgatggccacctagccagatagtgatggaacaagattcagatgtaggtccagggttgctggatgattgtaggtaggtgccagggcggaggcaggaaatgctgggatcatggagacaaacaatggcaacaagaacaacgatgatgctaacaaataccagttacaataccatttagagcctcctgcttctgccgggcagcaactaggcgtttataggcttggttttaaagtggcttgaagtacagaaacaccttggttgcaacaccaccagataccgagagcttgctatgcatcaggcctgtgaccgagagctttagtgctggctcctctgaacaacttaaggaagtgggcactatcatgagctccatttgacaggtgaggtgaagcatctagtcgaaggtcacaggaacaagaaatgggagctgggagttacccccagcttgcttgctccaaacaccgtgtgacagctggaaaggcgtcttctagacccaacactcactcataagaaaagcaagaccagggaggatgaggcatcttgtccagggacagcagcagatggcaaagccaagactagaacccgaccattcaaagctacattccccatcctgggatcctacctaccaccaattcagctgacctagagtttacaggatctttgtgtagtctttgtttgtttgtttgtttgttcgtttgtttttgagacagagtcttgctctgtcacccaggctggagtgcagtggtgtgatcttagctcactgcaatctccacctcccgggttcaagctagtctcctgcctcagcctactgagtacctgggattacaggcgcgcgccaccactcccggctgacttttgtatttttagtagagacgaggtttcaccatgttgatcaggctggtctcgaactcctgaccttgtgatctgcccacctcagcctcccaaagtgctgtgattacaggcatgagccactgcacccagccagtcatttgtttttctttaaggagagacctgggcattttagaggaagggtttggctaggagacctgttcgttaattggctggctcctaagagctcagccctgaggcagataggaaaggcacggaaggggtggctcctgccctcaatttatctacaaagtcccctattgaaggttctgaggggataaaattagaattccgtgttctctgccgaaggccagcgcatgtggctactgtgatgtcctggctgcttgagaacagattgcagggtgggcagaggggctgatttaagaggctttcaaaaaccccacagctccaaagtacctcccaaagtctggctccaaaatgtctgactttccgtcaccggagagtccctcattggtgtccctgggtccccgtcacaccagctgcaccaaatcccgtctagtgtgaaggtgaccaacgggctatttaccgatgagcagcctgagagcccataatttccagagtgaggatgaaggggtcagggcaggctggaaaacagagaggaccagcttcccctcttgacaatctctccatgagcaggcggtgatggacaggctcatgcatcctttatcccaggacagagaaactcagtgcccccaaacagggaatgccagtgctggatgaaatgacaggttgaagctgtagagggttcatgcttctgcctgagctgggacactagccctctcaggagtagcctctccacattcatgtagcaggttcctgaggccagaggccaagtcctggctctgcctcttgttttccacatgaccctgacacctcaccttcccagcctccatttccccatctataaaattagaatcctcccagactgtcatgtgaattatataaagtaagtcagaacttgttgacccctaagaaggactcgtgagctatcccatccacccacccaaccacccacccatccatccatccatccatccatccacccacccacccatccatccattcatctttctctccctttatccatccctctatccatccattcctcatccctccatccacccattcctcatccatccatccatccatctaccccccatccatccgtccctctatccctccctccatctgtccatccatccctccatccatccacccagagcttatttatgagcacctactgtgtgccaggaacactgtggctgccaggagaacagtgaacaagagagaggctcccctgccctctagagtttgcattctagtagggggagactgacaaaaataagtgcataaataagatcatttcagagagtgccaaggactatgaagtaaataaaaaaggactaatgcgatgggatggtgatatttgagctgggacatgtgtcactctataccaaggtcaaagtaggtcggaaactacagggatgaagaaggaagcctaagagcatttctagcttgaatcatgtcatggtcaagctacttaatttttgagcctcagtttccccatctgtaaaatgcagacaaaggtgtctctcccatggagtagtcatgaggattcaatgagataatatatgcaaaatgcttcccacattggcattcgataaatgttagttactagctataattaataaaagtactgctaataaaagacatctcaaaataaccacctgccccaccgaggtcctggaagatcacaggctcctggctgagaaagcaagcactttgacgcctgccctatgggagggattctgtacgagtatttgttgttttggtatttatttgagactccatccttggcactgctgttaccactcagccagagagcctggagatttcaaaaccagctggtggaccctcactctctcccaccctgcatcccccatatccaggtcacccacttttcctatcctaggacagcctggggacaggaaaggatgatgtctatttcctaagtcaaacctcaggaaggtgaggcacccaggtacgtgtcccttcatctagccagggccagtgccaggttgtttctttcttttttttttttttttttttttttgtgtgagatggagtctcactctgttaccaggctggagtgcagtggcacgatctcggctcactgcaacctctgcctcctgtgttcaagcaatcctcctgcctctgcttcccaagtagctgggactacaggtgtgcgccaccacgtccagctaatttttgtatttttagtagagacagggtttcaccgtgttggccaggatagtctcgatctcttgacctcgtgatccgcccacctcagcctcccaaagtgctgggattacaggagtgagccaccgtgcccagcccagtgccaggttatttctacaatacagcatgtgttggtttggcttttgtgtgtgtgtgttttcacttttttattttgaaataattgtagatatacagaagaattgcaatgatagtacagagagtcctgtacacccttcacccagctcccccgatgttaatattttacataaccacagtacaatgatgaaaactaagaaactggataggtggggttttacatttgtattccacacaaagtccagggaggacgcagctcacctcaaatgagtctcagatactttttgtggcctttttgaagccatttcacgaccagttttttatttgtctcacccaagcaattattactggcccctctcttcactccactgacagatgagggaaccaaaacccagagagatacattttccagcaaatagggccagactaagcctggaagccctaactttcaatccccagcctgtgctctccccacatcacaacactccattttcttttttcttttcttttttttgtttgttttgagacagagtctgactctattgcccaagctggagtgcggtggcacgatcttggctcactgcaacctctgccttctgggatcaagcaattctcctgcctcagactttggagtagctgggattacaggcgtccgccaccacacccagctaatttttgcattttcagtagatacagggttttaccatgttggccaggctggtctcaaactcctgacctcaagtgattcacctgcctcagcctcccaaagtgctgggattacacgcgtgagccactgtgcccagccaagacaacactgcattttctagggcgatgggcacttgcctgagaccctacactccccagcaggctgagacatggcatctcagagacacgtagtggcacgtggcagcaaactccttgtcctctctcatctcctggggagaaaaacagcagagaagtccagaaatcaggaccctgagcctcagtttcttcatctgtagaacaggaacaatgccaaaatgcaccagacaggattattgtcagagtcaaataagatattgcatataaagtgtttcgaatagtgcctggcatatgataagcattcagaaaactattattattattattgctattgttattagtgtagttattattaatgattttgggtgtggcatggcatgatgaaccaaaagatgtggtaggcccatcatttcccacctcacttcactcatctgctcattcattcatttattcattcattcattttcacacttacgctctggggctgctgcagcagaagcaagaacccagagagagcaccacccagggccccgcagtcaggtgtggacagtctctcttgcatccccgcctctgactcactttccttgtcatttttttctgcagaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtcagactctgcttgctcaggaagacccaggcctggtcaggcattggctttccagatgcatctgggcaggaggtgggggctggatttcaacagttagaaaagttgtgataggagggaatggaagggaacagtctcttttctgttctaagtactaagcatggaactctacagaggttacccacttactccctaaaaccaccccataaggtaggtgatgaaactcccattctctgaaaaactgagtctcagagaggggatgtgatgtgtctaagcccacaaatacaggatttgctagtgttgggatttgaatgcaggtccgtggatgggtaggtggatggatggatggatggatggatggatggatggatggatggatgggtgggtggatgaatgggtgggtggatgggtgggtggatagatggatagatggatgggtgagtagatgggtgggcagatgggtaaatggatggatgggtgggtgaatggacgatggatgaatgggtggatgggtggggggatggatggatggtggatgaatggatggatggatgggtgggtagatgaatgggtgggtggatgggtgggtggatagatggatagatggatgggtgagtagatgggtgggcagatgggtaaatggatggatgggtgggtgaatggacgatggatgaatgggtggatgggtggggggatggatggatggatggatggatggatggatgggtgggtggatggatggacagacacatagatggatggataccattaagaattttttttacaaatgacagaaccccaactcaagtaacttaagctaagaaggaaggaaacaaaggacttgactggcttatgtgcctgaatagttaagggaaggtcttcaggaacagctggatcaagggactcaagtgatatcatcaggactaagtccctcttttcctctctctgagtactgcttttctttgtgctgaatttgttatcaggagggctctcccttcgtgatggcaagattcccccagcaactcaaggtgaacattcagcattaccagcaaaaaaaaaagaacttcttgttcccagccactctatcagaagtccccagatttagtcccattaatactagtaggtaacatttactgagcacttactctgtgctgagtcctttacaggattccatctgcacaacagcactgtgaaatgcatgctattattacatcccttgtatagatgaggaagctaaggcatgtagaatttaaatgttggccaaaagtcacacagccaccacggggaggatccaggaccccaaccccagcatcacctccagagcctgtgtcccttcctgagtcagacacagaggccaggaggagggatcttgattggagacaggtggagttggtcacccacaaggctcacggcctgagagtgggagaggggtgtccctgtggaaatgaaaagtggggacagatgctgggggtgaacatggccacgtccctacagaagggcttctgctgttccccaagacagccctggggaggttattttagatttccctgggtggagagggggcattggagtgttagtctctctctcaccagaccccatgccctgcacctcccctgctctctgaggtgttgcccttaggcagggctgtcaggaaggctctccctgagggcccagcccggggcagacagcccatcaggacgcaggctgaagggcaggaatgggcaggccctcatccagggtggtagccaggctgagagcaagcaggcccaggcctgggagaggactcaaggccaacactggaaactgggtcaacacagcagcaaaccccaaagggctgccctgccgggggctcagc

SEQ ID NO: 12149 - DNA, 36542 bp, Human
cgacagagcgagactccgtctcaaagaaaaaaaaaaaaaaaaggatcataactaagactcgaatgcggagggataacagcctctgctacttgaaacctagtccttctggggaggaaagcccaggtgtgtggcaggtggaagggagggcgagcctaggtggtcctcttgctagggcaagaagcccccaagcacctgcccccagctgagcagctccgcgcctcctggccctggacgaacttgggcccagactggcgctccgtggcaccccctcccccggactcccgcttcgcgccctcatcccgccccccggcgcggcctcaccagctccccctgggcagcccaaagaatgcgaagaggtaggtgggggtagggaggagggcgagccgctgggagagacaaagggcccgagtctgagcgagagacacaaagacgcgaggaggctggggagataggggaagtgggacaaggacgcggggagtgaccaggtccggaggccggactggagcccagccccacccagcccggccgggccagcgcagcgcgggggccggtctctgctgccccctggcgggtggctgcggtgagaaggcggcgcggagcaggtgttgggaggggaggaccagggcgcgcagggaggtagggagggaaggaagcagagaacagagcagggacagagagacagcgagagagactcgcacgcagagacaagagacgccgagagggagacacagagaaagagacagggacagagagacacagatagagacagagagagacacacggagagacagagacagagaagcacagagatagagaggcacagagatagagacagagaaacacagagacagagaggcacacagagacagagaggcacagagacaggccgatagagacagagatacacagaaatagagacagagacagagaggcacacagatagagacagagagacacagagacagagtcaaaggatggaaagagacatggggaccaagtgacccagaaacagtgacagacaggccgggcttggtggctcacgcctgtaatcccagcatcttgggaggccgagccgggaggatcgcttgaggccagcctcagcaacatagtgagaccccgccgcccccccgccccgtctcttttattgaaataaagaaacagtgactgacaaaggaagaccagaaacagagcgacaccgaagcatgaggacggaaagacccagagaggcagaaatacagggacagagaggaagacccaaagagagtgagagagacacaaagacacgtaagagagacagagaaatccagaaagaaacgagtgcagcgacacctagagttcggggcagagattagaaacgcacgagggtacgagaaacaggctcagggcgatgggctcgacctgcggggaggtcgcacaaccgggacgtgctgggggcagaaccgtaaagccccacgtgcctcaggcaactgtgatgagaggacccgggcaggcaggaaagggcaggattcgaactgtgggtgggacagaggccaggacggactgagctaagagaccgagagaactccggctagggcgaggggcggggctggtggaggcggggctggtgggggcggagtcggccggaagggccgaaaggggcgtggcaagaccttggcgaggcggccggtaggcagggggcggggcgtgggaactactcgggagcagagggggcgtggctagaccttagggggcgtggcttaacgccgggagcgaaggagacagaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggtgagacgagcggacggccccctgccctcgcgcggaccccctccaaccttaccttccgagctggggaagccgagcaccttccccgcccacccccggctccccgagccccctctcgcgtgcccccttcctggctggccccacagactccgaccccctacacgtccgattctctcgaggagactctgacccctcctttctgcatctctctcaccaccacccccatccttcttaatccaattgcccatcctacgcctgcttgtctgtccccctccccatttctcggattcccgcgccgaaagggttaaatcccaggaaggcctggtgccccctccccaccccgcgccgagtagttcacccggatctgggtctctgtctcctctacccctctcaggaatgtggggaatgttccccccacctaccgcagtaaggtctcgaggaagaggcgagaccacctccctcccctatttttccttcttcccggcttgggcgtctgaggcccggagagaactgaggacaagcggacctgattcgggtcccttggagggctaaggataagagttctggcgacttagggggaagggcctgagctcggagctccaaccccgaacctcagggagttgggggttctgactccgtggactccagaaaaattaggggccgggggctccgtcttcagggtccctggtagaatggaggctaggcgctaagtctaactgggatctaggtaaaactgggggcgagagaggatcaaacttgtagcttctggatttaattgtgggcagggggcttcgttttcagggttcccggcagaaccgggggacaggagactcgatctcgtgggcttcagacttaattgtaggcagaggaacgtcttctgagatccaaacagaagtgcgagcagcgggccccgtctcttgggctccagatatgatcaagggtcgaaggctctgtcttgaggctggagtctcagtcgcctgagtcccagatagaacgggaggccccgagtcccagaggctgggagactcctccctttccctatgaatggtcgggggcgacggagacgtcgccggggaagttttcctggtttcactctcgccgagccagggaggggcggggcgggcgctcctggctccgggttccggactccccggtttcgggaccttatctatcctctggtagcgcctttgtcctcagagccatagcaggaggtggacgagtggagccgccgcccttatcccccgtccctcccattgctatgccttggaccccctggcgtccttccatccaccccactaggggaggagagcggcccccctggggagggaggggctgggagggaacccttgaaagaggcgctgccccgcccttgcaggtgacccggttgtgtattcccagcgacaaactctgggatgctagagtttcccgagggtttgcgcagaagagagctcagggggatcttgggggaaccccggccacctctctggcctcatttcccccaggatggctctcactggcctcccagctttgacccagagctgggaactccgcttccatcccctgcctctcccttcaggcagaaataggcagatgagatcagaactggcacctctgggtgaattctccgaacccaccagaccctgagcctactgttagcttggtgcatgatctcaccgaaggctccagcttgccctgggaaacaggtcctgtttctgtttccatcttagagatgaggaaacaggctcagcaaaggcaagcagccttctcaaggtctcacagcaggtcccggggaagccgggctccggttcttcagagccccgcaccgggtgggctccaggaagtgcctctgagtttccatttcctccctcgtaaaaaaactgagataacaatcctttccctgcggaccatccggaaggctcccaggccccactgattccctgtgaaacctcttagcccctggagaaggagctgtcggcccctttcttgaccacccccaccccaatccttcgcctctgctgtccgctggctggccggctggcatgtgctcgctctccctctctctctctctcccctccccctccctgttttcctccttccctcactttctttccccctcttcatctctcttcgtttctcaccctttctctctccatccctctccaagctctttctctcttctcctctccccatctctctctctcctctccgtctttctctgtatacctgtctagctccactgcctcccccgcttggcctcctcggggaatgcgggtgcaccacctgggcccccagctgggccggctcccctcccccagctttcttccctgcccatccgtgtgtccatgtccgccaggcagccccacgtagtggagggggaggggagcagagggacggcagcctggctgtctcctctcattagggaagggggactgggcagaggagaagttggggggtgggtatatagagaggctggagctacaaggatgggtacagaggccaatagagggaagcggtcagacacagatttaggaatggggtcagagacacgtgtaggaatggaatcagaggatagaaggggagtgaaatgccggcacagggtcgggggagtgaaataccgacacagggatgaggctgaaagacactggaatgggacggaggagggtgggggaagggagctagacatagataccagatgaaggcagggacaggaaaaggaaaggggtttggtgacaggcagggagccccaaagactccagctgtgggacagcagaggtgccgtgacccacggaggtcagggtacagggggcctcaaggccagcgacatgtgggggccacagggagtgatgaacacagaagggacagggagctgggcacatgggccagctcccccgcccctgcctgggacgctgttacatttttaatgtcccagcagtgctgacaaatggagcaggaaggggaggagaagaggggacccagcaagatgggccaggctgtgagaaggtgtgtcagaaatatggggagacagggcactggagacccaggaggcagggagactccacagtcagagacagaaacagagacgtagaccagaaggcttgtgagaagagaaccccaggaatcaaggcagagagccaggttccagacacagggagacccagacggagaaagagaccggagatgtcagacatacagaggaaagaggaagagagtgactaacggggacagggtatcttctcaggctaatgaaaatgttctataattgctcgggtgatggatggctaactctgaatatacaaaagccactgaactgtacactttaaatgggtagattgtatggtatgggaataatgtctcaataaagctgttacaaagagacagagaatataagaggcacagagcagagaccagagactctgggggacacagataagagtgacagaggccaggcacattggctcataccagtaattccagcactttgggaggctgacgcaggagaatcgtttgaaccgagttcaaggctgcagtgagccctgattgcactactgcactccagcctgggccacagagcaagaccctgtctcaaaagagaaaagagtaacagagaccccaagagagaccctgggaattggagacacagagggacagggaccctaagaactagacacagagagagatagaagaggccccggaagacacagataagagacgctaagagacagcagggataccattaaaagactttcaagaagccaggcatggtgactcatgcctataatcctagcattctgggaggtccaggcaggtgtatcacttgagctcaggagttcgagaccagcctgggcaacacggcgaaaccctgtctctgcaaaaaatttaaaaattagccaaaggtggtggtgtgtgcctatagtcccagctacttggaaggctgaagtgggaggatcacatgagccaggaaggttgaggctgcagtgagctgagatcacaccacagtactccaccctgggcaacaaagcaagatcctatctcaaaaaaacaaaacaaaacacacggattagaggaggccagggggcaggtgcagaaatccaggcacagacagacagccctacatcctggctgctgcagccgctgctcactccctgaaccagctcctggatttccgctgtgggggttgggcactgtgattaatacaattaattaactgacaaggtgactgaggcagcagctgaggccagtactcaaagcctctggccttcaagggccttctctagtcccgacgtgccttgccatgggaggctgggtcgctgtgctttatagatctgcgggggaagccaggccctggggagccagccaggcaggagtccacgagcccagctcctcctcccctagacccaggtgtccagcttcaggccccgcctccctcagacccagaagcccaggccccagcctctcctccctcagacccaggagtccaggccccagccctcttccctcagacccaggagtccaggcccccatccctaatccctcagacctgggagttcaggcccccatccctgctctctcagacccaggagtccaggccaccagtgcttcctccctcagacccaggagtccaggcccccatccttcccctctcagacccaggagtccaggcccttagtccctcctccctcagacccaggggtccagcctcagtcccctgctccctcagacccaggagcccaggccccctgctcttcctccctcaaacctgggagtctaggcctccagctcctcctccctcagacccaggaatccaggcccccagccccctcctttctcagacccaggagtccaagcccccaacctctcctccagggttccataggtcactctgcaccctcctcgctgccttggtctacccatccctggatctcggggtctcaagctgtgtctgtccccattgttctcccatgggctcacactacaccctgggcagcctccactctgccaccacaggaagcctgcaggtgcagtccacagggagaggaagtgtgtctggggacccagctcacacttcatgaagctgtcaccagtctggcttgcccagtgacactgagggaggctggtgttcccatggccacagtcccctggctatggtgctggccatgtcctggccaagttcatggcacagcccctgcctagcagtgtgctggatgatgggggctcactccaggctgaccaacctcctggctgtatctcccttgcctccacctgacatgcagagcgtctgggcagcggccctcacccctgtcccctttacctccgcagccctgtcagcctccaagtcccaaccctcccagcttctccctgtcacccccaccgctggtcctgctttcccattccaagttctgagtgtgtttccaatctcgccatcctccgtccccacagccccgaccctgatcccggcgcctccccccgagacccctgccccactgagggctctttcttttttcttttttttctttttttgagacaagagtctcactctgttgcccaagctggcaatagtgtctcactctctcactctgtcttccaagctggtacagtggtgtgatcttggctcactgcaacctccgcctcccaggttcaagcaattcttgtgcctcagcctcccaagtagtggggattacaggcgggtgccaccatgcccagctaatttttgtatttttagtagagacgggctctcaccgtgttgcccaggctggtctcctgagctcaggtgagccactgcacccagcctgtgagggttttttctttctctttttgttttttttgtttttttttgagacatggtagccaccacctgtaatcccagctactcaggaggctgaggcaggagcccgagacagagcaagactccgtctcaaaaaaaaaaaaaaacagaaaagacttgggcttgtttcctgagggctctgtgcagaggagggcgtgttctgcactttctagcaggatccttctagctgtgcataggaacaaaccacaaggacaactgcagtcctccaggtgggaagtggcagtggattagaccagggcagggactggggaggcgtcagaggtggtctaactagataaatgtcaaagaaggaggtgacagggtttcctgatagattgcttatgaggtgagagagaaagaggtgaaaatgccttaaaaatggactgtaggcaggacgcggtggctcacgcctgtaatccaagcactttgggaggccaaggcaagaggattgctttagttcaggagtttgagaacagcctaggcaacaaacagtgagaccccttctctacaaaaaaaaattttttttaattagtcaagtatggtggtgcccgcctgtagtcccaactactgagaaggctgaggtggtaggattgcttgaacccaagaggttgaggctgcggcaagctgggatcctgcactccaccctgagcaacggagtgagatcctatcccagaaaaaaaaaaaaggaatgttaaccccacagggcctgaactatcctattcattcatttggaattagaaattcagaatggggaacttacagcaatgggattttttttttcagacggagtctccctctgtccccccagctggagtgcagtggcgcgatctcagctcactgcaagctctgcctcccagattcacgccattctcctgcctcagcctcccgagtagctgggactacaggggcctgccaccacgcccagctaatttttatatttttaatagagacgtggtttcaccgtgttagccaggatggtctcaatctcctgacctcgtgatctgcctgccttggcctcccaaagtgctgggtttacaggcgtgagccaccacagctggcccttttttttttttgagatggagtctcactctgtcccccaggctggagtgcagtgctgcaatctcagctcactacaacctccgcctgctaggttcaagtgattctcctgcctcagcctcctgaatagctgggattacgggggcccgccaccacgcccggctaatttttgtatttttagtagagacggggtttcaccatgttggccaggctggtctcaaactcctgacctcgtgatccgccctcctcggcctcccaaagtgttggaattacaggcgtgagccattgcgcccagggattttagaacctcattcattcgttattcagcaagtactgagcatctactaggtaccaatctctcttgcagatactgagggtacaggttgtgagcaaaacagacagaagatccctgccctcgtggcgctggcagtcagtttccaggaggatgtgatatatctagtgtgtgagatggtgagaagcactatgcagacagagaacgtaacagggcaaaagggcggaagagcagtcaaccagggaggggagaggaggtggcagctgaggtggagtatctcggggtaaaagaaccccccgaggagtgtgccccacaagaagctaaaagtggtgggtttgtttgagaccgagtcctcactctgtcacccaggctggagtgcagtggcgcaatctcagctcactgcaacctccacctcctgagttcaagcgactctccctaaagtagctggaattacaggcatgcagctaatttttgtatatttagtagagacagggtttcactgtgtcggccaggctggtctcgaactcctggcctcaagtgatccatccaccttggtctcccaaagttctgggattacaggcttgagccaccgccccatcctaaagtcggtttttttgttttaatcctccaaatccagtagtgctcagatgccatcctaaatggaggattggaggggagcctcccttagaaggaagatctgggcccctggaagccacaggactgctccttaagtcaagaactctgaatctggccaggtgcagtggcttatgcctataatcccaacactttgggaggccgaggcgggtggatcacttgaggtcaggagtccgagactagcctggctgacatggcgaaaccccatctctactaaaattacaaaaattagctgggtatggtggtgcatgcctgtaatcccagctacttgggaggctgagacaggagaatcacttgagctggggaggcggaggctgtagtgagcccagattgcgccactgcactccagcccgggcaacagagtgagactccacctcaaaaaaaatttttttaaaaagaactctgagttgccgggcgcggtggctcacgcctgtaatcccagcactttgggagtcccaggcgggcggatcacgaggtcaggagatcgagaccatcctggttaacatggtgaaaccccatctctactaaaaaaattagccgggcgtcgtggcgggcacctgtagtcccagctactcgggaggctgaggcaggagaatggggtgaacccgggaggcggaggttgcagtgagccgagatcgcgctgctgcactccagcctgggcgacagagcaagactccgtctcaaaaaaaaaaaaagaactctgagtcagcctggcgcagtggctcacacctgtaatctcagcactttgggaggccgaggcgggcagatcacgaggtcaggagatcgagaccatcctggctaacacgatgaaaccccgtctctactaaaaatacaaaaaattagcagagcgtggtggcgggcgcctgtagtcccagctactcgggaggctgaggcaggagaatggcatgaacctgggaggcggaggttgcagtgagccgagatagtggcactgcactccagcctgggcgaaagagtgagaatctgtctcaaaaaaaaaagaaaaaaactctgaatcccagagacccagggacttggaggaggtgaagggtgtggggctccagggacctggggctcagcttttcaggtctcctcctccaggaagctcttctttcgttcatcgtccctccctccttcagacaggtcaagcctcttcaggttcctcccataccacccctactccgtcttccaggcattcttggtgataattatttgtgcaatatttgtaccccctgcaatctggatgtcaaccctggaaaacaagcacctgatttgtcctgttacttctgcagcatccacacttagcaacattcattcacttggcagtgtttactgagcacctactacatgctaggccctgttgtaggtgctggggatacagtaggggaaaaacacagacaaacctcagggctggagagggcagaccctctagcacccaggacctgtttgttgagtaagtatttgttttttggatttgacctataagatgtgaaagaacagccagattcttccaggttctgccttttcctgatccctccctctctccctactaccaaatcccttccattttaaaattttaaatcctggtggggcacagtggctcacgcctataatcccagcagtttgggaggctaaggtaggcagatcacctgaggtcgggagttcgaggccagcctggccaagatggtgaaaccctgtctctactcaaaatacaaaaattagctgagtgtggtgacatatgcctgtaatcccagctactcgggaggttgaggcagaattgcttgaacccagaggcagaggttgcagggagccaagatggcgccactacactctggcctgggtgatacagcgagaatgtgtttcaaaaaaataaaatcctgagacctattagcctcctccccaacactcagtctcagtcttaacctcttgttcttttcattgccaactttttgtgtcattttgctgtctggtcatctatctctgctcagcccaccaccttcccctcaggcctccttggatgaagttaagtcattctctatttgaagaacccgcaacggctcccacttgccacaaagaggaaactaacttcctcggccccagcctactttgctgtctctgcagttcacacaggcccaaatggctttccttgaccctcattgagtggccttccccccttgcctagctaggaaggggccagagcgcttaaccaccctgatcccaaccttagtgcctttgggggccaggcgggtgataagtcccagcacctggggaatctggaggagccggaagggagtgtgccttgtgggaggggggtgatgtccttcctcagccccacccagctgttgcccccaggagccacatatccggacttctgtctggagctttagacagcaatctccaggccttctgtgtgggctgctacttcccaactgaaataacactctgtgggccaaagcaaacatgcaccacagtcagatctggcctgcagcaggcggctgacccctgctgctctgctcacctgggccacgccccgtgaacatcccccatgagcaagtccttccctggaactggcacaagggaccctggagggtggctgaaacatccccattttacagatggaggaagttgggcttggagacaaggctgccagctggaaagggtgtcagcgttaaataacaagattcagaaaataggattaagtatagagtttattcaagcctaaagcttgaggatggccaccccggagtgtggattcaagttgccccaaataaaccctttgactagctgtgattacaagtggactttttttttttttttttttgagacagggtctcaccctgtcactcagtctggagtgcagtgtgtgatcatggctcactgcagcatcagtttctcgggctcctggccttgagtgattctcctgccacagcctccctagtagctgggactacaggccctagccatcttgcccagctattttttttttttgagacggagtcttgctctattgcccaggctggagtgtagtggcacaatctctgctcactgcaacctccacctcccgggttcaagcgatcctcctgcctcagcccccctagcagctaggattacaggcacctgccaccatgcccgggtaatgtttatttttttagtagagatgggatttcgccatgctggccaggctggtctcgaactcctgacctcaggtgatccacctgctttggcctcccaaagtgctgggattacaggcgtgagccatcgtgccgggtttttgtttttttttttttttttttaagagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattgattggctatgcactgtttattgtatcacaaattccaggaacaagaagctaatggggagggcagctgtgcaggaaccactgcctcgggcatgggtggaggaggcgtgtgaccgaagtcccctattcactgtacagtctccctgggcctgatacatttcgcatagctcagactgatctgagctatttttcttttctcaagttgggtgggggtggcccctctggactggaaaagcctcatttttcccccaagtgacacacctgagtttgtttgacttgtttcccccaagtgacacacctgagtttgtgggacttgtgtggagatgatgtatttatgtcacacttcagtcttcgctgatggcttttttttttatatttatttacattttttcttttaaggtaggcagggccccattctatcgcccatgttggagtgcagtggcgaggtctctgggttcaagtgattccccttcctcagcctcccaagtagctgggaatacaggggcccgccaccacgcccagctaatttttgtatttttggtagagacggggtttcaccatattggccaggctggtctcgaactcctgacctcagggtgatccacccgcctcggcctcccaaagtgctgggattacaggcatgagccgcagcacccagccttttttctttctttcttttctttttgtttcccctcccgagaccgagtctctctctgtcacccaggctggagtgcagtggtatgatctcagcttactgcaacctccacctcccgggttcaagcaattctcccaccttagcctcctgagtagctgggattacaggtgcctgccaccacacccagataatttttctatttttagtagagatggggttttgccatgttggccagtctggtctcaaactcctggccccaagtgagcctcctgcctcggcctcccaaagtgctgggattacaggtgtgagccaccacacctggccttattttatttttaatttctgttcttgtattgctataatttactgatgatttcttacccaaagatcctcggcctgtccccacccaaggggactgccttccaccggggacccctcataagagttactcattaggatggtgttccctggggttcctgtgtgtatgacgccagggcctgtgcaccgcctccatggcccatctccatcagacagagctgggcagtggtgttggccctcgaaatgaggcttgtgccctggcctttcctggcctgggggctgagtgccaaggccacctgtaattaaactgagcttcctatgtttacttagcaagcactgacctctcatttcctggggccctatgctgagtgttccacagctattctttaatctttaaacagcccttgggacgcaggcactattattaacctcacatcacagctggggaaactgaggcacagagaggttaagtgacctgcacaaggtcgcagagccaggattcaaacccatgaactatgggccactcagtcgccatgctgtactgccgtgcacagcagaggaagatttgttcttgttcttgtttatattaaaagtgagaaaacatgggccacacgcagtggctcacgcctgtaatcccagcactttgggaggccaaggcgggtggatcacctgaggtcaggagtttgaaaccagcctgaccaacatggtgaactctggtctctactaaaaattcaaaaatcagccggaccgtagtggctcgcacctgtaatcccagctactcaggaggctgaggcaggagaatcgcttgaacccaggaggcagaggttgcagtgagttgagaccgtgccactgcactccaacctgggtgacagagcaagactccgtctccaaaaaaaaaaaaaaaggtgagaaaccacttaggctggctgagaactgcaaacatgcgtccacataaaaacttgaacttgcatgatcccagcagctttatttatcagagccaaaaagttgaaacaacctcaatgcctatcagcggctgaatggataaacaaaatgtggtccatccatgtagtggaatattattgagccttaaagaagagtgaagcgtcgacacgtgttacagatggatgaacctggaaaacaagatgccaagtgaaagaagccagacacaaaggctacatagtctattacatgaaatgtccagaacaggcacatcaacagagacagaaagttgcatcgtggctgggggaatgggaagtgactgcttaatggataagggggttacttagggaattataaaaatgcccaggctgggcgcagtggctcatgcccgtaatccgaacactttgggaggccgaggcaggtggatcgcttgagctcaggagcctaagcaacatgatgaatccccatctctacaaaaaatacaaaattagctgggtttggtggctcgcacctgtagtctcagctacttggggggctgaggtgggaggatcacttcggccccagagacggtttgcagtgagcagaaatcgcgccattgcacgccagcatggacagagtgagatcctgtctcaaaaaataataccttaaaactgattatagtaacagatgtaaaactccaaatatacttaaagccactgaattgtactgtattttttattttacttttttataaaaaaattatatatatatattgttttttcttttcttttcttttttcaagacagagtctcactttatcacccaagctggagtgcagaggcgcgatctcggctcactgcaacctccgcctcctgggttcaagtgaacacgtccggctaatttttatatttttagtagagacagggtatttcaccgtgttggccaggctggtctcaaactcctgacctcaagtggcccacccacctcggtctcccaaagtgctggaattacaggtgtgagccactgcacccagccttaattgtatactttaaatgggtgaattgtgtagcgtaagaatttatatctcgataaagctgtttaaaaaaaaaaaaactacgtaaaaaatgagcaaaggacccgaagagacatttttctaaagaagacatacaggcagccaacaaacatgaaaaaatgctcaacatcattaatcatcagagaaatgcaaatttaaaccacaatgaggtgccatctcacctcagtcagaatgtctgttactaaaaagtctaaaaaaacagatgctggcaaggatttggagtaaagggaccgcttacccactgttgatgggaatgtaaattagtacagcctctatggcaaacagcatggagatttctcaaagaactaaaaatagaactaccatttggtccagtattccactgagtatcctcccaaaggaaaagacatcattatatcaaaaagacacctgcgcttgtatgtttattgcagcactattcacaacagcaaagatatggaatcaacttaagtgtccatcgatgaatggaggattggataaagaaaatgtggtctatatctacaaagatttcatgacgaaattgccaaaagcagtgcagcaaaagcaaacattgacaaatgggatctaattaaactaaagagcttctgcacagcaaaagaaactatcctcagggtgaacagacaacctacagagtgggagaacatttttgcaatctatccatctgacaaaggtctaacatccagaacctacaaggaatttaaacaaatttacaagaaaagaaaaacctaaaaaagtgggcaaaggacacgaacagacacttctcaaaataagacagtcatgcagccaacaaacatgaaaaaaatgctcaacatcactgatcgttgagaaatgcaaatcaaaacaatgagataccatctcacaccagtcagaatggccattatcagaaagtcaagaaacaacagatgcaggcaaggttgtggagaaataggaatgcttttacactgttggtgggaatgtaaattagttgaactattatgaagacagtatggcgattcctcaaagatctagaaccagaaataccatttgacccagcaatcccattaccggtatatacccaaaagaatataaatcattctattacaaagatacatgtatgcgtatgttcattgcaggactattcacaataccaaagacatggactcaatccaaatgcccatcatggatagactggataaagaaaatgtacaggccgggcactgtggctgacgcctgtaatcctagcactttgagaggccgaggcggcggatcacgaggtcaggagatcgagaccatcctgggtaacacggtgaaaccccgtctctactaaaaatacaaaaaaattcgagtcccagctactcgggaggctgaggcaggagaatggtgtgaacccaggaggcggagcttgcagtgagccgagatggcaccactgcactccggcctgggcaaaagagtgagactccgtctcaaaaaaaaaaaagaaaagaaaaaagaaacctgcacatgtatcctggaacaataaaaaaaaaaagaaagaaagaaaatgtggtatatgtctaccatggaatactacacagccataaaaaaggatgggatcatgtcttttgcaccaacacagatggaactggaggccattatcctgagtaaaatagaaagtcaaataccacatgttctcacttataagtggaatctaaacagcagatacacaaagattggaataatggacagtggagactacaaaaggtgggagggagggaaacgggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatacaaaaaaaaaaaaaaaattagctgggcatggtagtgtgcgcctgtaatcccagctactcgggaggctgaggcaggagaattgcttgaaattgagaggtggaggttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaattagccgggcactggtggcacatgcctgcagtcccagccactcaagttgcagtgagccaagattgtgccactgcacttcagcctgggagacagagtgagaccctgtctcaaaaaagaaaaagaaaaattaactgttgggtacgctgtttgctattcaggtgatagatatgctaaaagcccagacttcacctctatgcaatatatgtatgtaagaaactggcacttgcacctgctaaaaatataataattttaaaatttttattttaataaaaaaatagaaacttagggccaaggggggagctgatcatttgaggtcaggagttcgagaccagcctggccaacgtggtgaaagcccatctctactaaaaatacaaaaattagccaggcatggtggcgggcgcctgtaatcccagctactcaggaggctgaggcacaagaatcccttgaaccagggatggaggttgcagtgaccaagattgctccactgcaccccagcctgggcaacagagcgagactcagtctcaaaaaaaaaaaaaagaaacttgagaaaaaatgctatgtaggaggtctgtaggtttcataggaaggtgagagaaagtatattactgaggggggatgaagacaatactcagcctttaaatgttttaaaatgtattttatgaaagtttttttttattgatttattttcagaggatttcccccccccccaaaaaaaaatcttatgaaaattttggggtgggctgggtacagtggctcacgcctataatcccagcactttgagaggctgaggtgggaggatcacttgagtccaggagttcaagaccagcctgggcaacatagcgagacattgtctctaccaaaacaaacaaaaaatacaaattagccaggtgtggtggtgcatgcctgtagtcccagcttgaacctgggaggtcaaggctgcagtgagctgggtggcccactgcactctagcctgggtgaaagtgaggccctgtctgagaaaaaaaaatgtagttgaaagaaaagaaaacttttatttttttattttcttttttaattttaaaggcagggtctcactctgttgcccaggctgttcttgaactcctaggctcaagcattcctcccaccttggcctcccaaagtgctgagattgaagtcttgagccactaccctggccatcatgtcaacttttaaacatacaaatataggtaagaatggcctggtggccgggcgcggtggctcacgcctgtaatcccagcactttgggaggctgaggcaagcggatcacgaggtcaggagattgagaccatcctggctaacacagtgaaaccccatctctactaaaaatacaaaaaagaaaaaaattagccaggcatggtggcaggcgcctgtagtcccagctactcaggaggctgaggcaggagaatggcgtgaacccgggaggcggagcttgcagtgagccgagatcgcgccactgcactccagcctggtcaacagagcaagactccgtatcaaaaaaaaaaagaagaatggcctggagcctccctcaccttctccacctagacccacttgacaatgggtgacatattttggtttttgctgaaccatttaggagtaacttgagatcatgacattgcgacttcatatcttctgggaaaaatagtgtgtgcacagccacaatttaattatcacacctcggaacatgaacagcaattccaaaatcatatgtaatatgaactcatagtacacgttatagttgtataatagaatagtcattttagtcttccctaaaatgtcttttccaggtggcttttttggaatcaggatgctgcgaagctgcctacgttgcatgtggagcctgcatttcccgtggggcccccttcgtggtggccctgcctggaggtgtctgggtccctcccccacccgactacttcactctctgtcctctctgcccaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcataggtgagcagggtaagggcgggaggcaaggaggtgggagggccgcggtgtgggagcatccccttgcgggtcagtttctctcttggcttcagctgtgaggttcacattctctgtgggtttccatccatcagcaaatgttcattaagcacctaccgcgtgccagatgcttttctgtgtgctgaggatgtggcaggcaaccaggcattcttgggaaaaacaaaaaaataagtattggctgggcgcagtggcccacccctgtaatcctagcactttggaaggccgagatgggcagatcgcctgaggtcaggagttcaagaccagcctggccaacatggtgaaaccctgtctctacgaaaaataaaaaattagctgggtgtggtggcccgtgcctataatcccagatactcaggaggctgagtcaggagaatcgcttgaacccaggaggcagaggttgcagtgagccgagattgtgccaccactgcactctagtctgggtgacagagcaagactcggtctaaaaaaaaaaaaagtattgaggttgggtgtggtggctcacgactataatccaagcactttgggaggctgaggcaggtagattgcttgagcccatggtggtgcgcagatgtggtcccagctacttgggaggctgaggtgggaggatcgcttgagaccaggaatttgaggctgcggtgagctgtgatcatgccactacactctagcctgggtgacagagtgaggccctatctctaataaataaataaaagagtaagtcaggcagttaaaggggccatggaagttggagagggccaagttgcaattctagctaaggaggtctggggatatttaggcagaaactaggagaggaggagccctctgggtatctaagggaagagcgttccaggcagacggaatggcaagtacaaaggccctgagacaggaatacctggagtatttgagggccaggaaggaagtcagggtggctggagacatatgagtgggggaaagtaggaagcaataaagtcaaggagaggatggggacagattggcaaaagccttgtggactataagaagcctttggcttttgcccagggaggataagagctgtagtaggttcttagcagcagacaggtttgatctggcttgggttctcaccagctcctcctggctgtgttgggaggggaaagaatgggagctgagaaaccacagggtaaggcaactacaaagtccgggtggggccgggtgctgtggctcacgcccataaccccagcactcagggaggccgaggtgggaggatcccttgagcctaggaatttgagaccatcctaggcaacatagtaagactcttgtctcaatgacaaaaaaaattttttttttttttgagacagagttttgctcttgttacccaggctgtagtggagtggcgcgatctcggctcactgcaacctccgcctcccaggttcaaccaattctcctgcctcagcctcccaagtagctgggattacaggctcccaccaccacacctagctaaatttttttgtatttttagtagagacggggttgcaccatgttggccaggctggtcttgaactcccgacctcaggtgatccgtccacctgggcctctcaaagtgctgggattataggcatgagccactgagcctggccaggaaagaaaaaaaaattgttttaattaaccaggctcagtgacttacctgtaatttcagctactcgagagactgaggtgggaggatcacctgagcccaggaggttgaggctgcagtgagctgtgattgtgctactgcactccatcctggacaagagagcgagaccctgtcttaaaacaagtccagtccgggcaggaagtaaaacggcttagaagtaggggacatagtggcctcattgagataggatgtgcagggaaggcgtcttagtcaagtcctagagtctgagaaggagctacctttgggcatagcagaggggcacgggcacagaaacctgggaggtgggcatgagatgggagctgggcgcgttccaggaatggaaagggggctggtgaggataggcaagggcttgggtgaccctcagcggggccacattacacgggcttcacaggtggaggcgaggaggctggactatgccctcagcatggttaagagccatgggaggtgtcaagccacaggagagatctggacaaacgtttgaggttgcaaaaaatgaccggcagcagtatgaggagtgattggaggagtggacggaggtagaagggagctgggacgagaggggagaagaggcattgctgggaagacggatgaggcagtggggggcagagggaagcgggcggcatatagtggtgtttttagaagatagtaggtgctgggcttgcccatggattgagggggaagcaggatcagagaggagtcccaggcctggtgcggtggctcacgcctgtaatcccagcactttaggaggccaaggtgggcagatcgctttgaggtcaggagtttcagaccactctgggcaacatggtgaggccccatctctacaagaaaaaaaaaaattagctgggcatggtagcacacacctgtagtcccagctacccaagaggctgaggtgggaggatcgcttgggcctgggaagcagagattgcaagtgagccaagattgcaccactgcactccagcacgagaccctgtctcaaaaaaaaaaaaaaaaaaataggactcccagcgggaaggtgactgatacttggcaaaaatagagaaggcagggaagattttttttgaaggatgcttttttttctttttcttttcctttttctttttttttttttttctttttttgagacaaagtctcactacattgtccaggctagactcgaactcctgggctcaggggatcctcctacctccgcctcctgcatagctgggattacaggcatgagtcaccacatccagctacgaatgctctttctttaaatcttgaggctgggcgtggtggctcactcctgtaatcccagcactttgggaggccgaggcgggcggatcacgaggtcaggaaatcgagaccatcctggctaacacggtgaaaccccatctctactaaaaatacaagaaattagccaggcgtggtggcgggtgccttagtcccagctactcgggagattgaggcaggagaatggcttgaacccgggaggcggagcttgcagtgagccgagatcgcgccactatactccagcctgggcgacagagtgagactctgtctggaaaaaaaaaaaaatatgttggaagtcccctgggagcccaccttccctaggcaacttcccagaagccacgtcactctggatgccttttcttcccccttctcagcccagagcgtctgagaaggtcaccctgtgctatccttgagtaaacacttccctttccagtaacacatgaaaccacagccgttttccataatacaaaggacagctcttctcctccccaccctcacaaacgcctctcttcttgtgcaatcatttgttctcatccagagataacttcagggctgggcacggtggctcacacctgtaatcccagcactttgggaggctgagaggcaacaagagcaaaactctgtctcaaaataaataaataaataatgagactcagaaaatatgattaagggccaggcgcagtggctcacgcctgtaatcccagcactttgggaggccgaggcaggcggatcacgaggtcaggagattgagaccatcctggctaacacggtgaaaccctgtctctactaaaaatacaaaaaaattagccgggcgtggtggcgggtgcctgtagtcccagctacttgggaggctgaggcaggagaatggcatgaacccaggaggcggagcttgcagtaagccgagatcgcatcactgcactccagcctgggcgacagagcgagactccatctcaaaaaaaaaaaaaaaaagaaaagaaaatatgattaagtgtagggtttaatcaagcccaaagcttgaggatgaccacctgggagcatagattgaagttgccctgaatatacacttcaagcaggggccaaggcaagcagctcttgcaagtgagcttttgtttgtttgtttgtttcttggagagagggtctccaaaactacaaataaaaattagctaggaatggtggcgcacacctgtaatcccagctactcaggaggctaaggcaggcgaattgctgaaaccagcaagggcaggttgcagtaagctgagattgcaccactgcactgcatcctgggtgacagcaagactctgtctcaaattaataaaaaaaaaagagagagagagagataacctcaagagcttccgtatacacactggtgcagaagtaaggaacaaaacagccaaagcctctgtcttcatgatgcgtgagccaccaaggaatagttggccagagtcggcggtcaggaaagtgcccttgacgaagtggggcttggagtggggtctggagaaggaggccaaagcaatccaggcacaaaatcaccaaccaaaaccccaaagtgggtggaggcagagactgaggagggcgtggatggggagcatgtggagtggccaggggaggtggccatggggaagtggtgggctcgggccctgagtcactattctaacagcttggagggcggccaggaggatgtggggaggcttgttggatgctccacgatggtcaggggagaaggcggtgggaagggagagctgggaagaagaggagagtcagaccgtgttgagaagttcagaggtggatacccaggtccagaaagcaacagaagatgtgagtctgggtgggggacacacatcataagcatgagctgctattcttcctggagttttgtttttgtgatttttttccatgttttccaagagaatgaggtggaaagggtataaaaaaaagaaacggctttgagattttctgcctttatcacacttccagtcattcaatcatctaatggtgattacaggaaaaggaacagggggcctttccagctggacctttgaaccacagtactcagttactcgctcggccttgatttgctttttttttttccttttttttttttttcttttggagacagagtctcactgtcacccaggctggagtgcagtggcacgatctcggctcactacaacctctgcctcccaggttcaagcaattctcttacctcagcctcccgagtacctgggattacaggcacctgccaccacgcccagctaatttttgcatttttagtagagatggggtttcaccacgttggccacgctagtctagaactcctgacctcaggtgatctgcccacctgggcctcccaaagtgctgggattacaggcatgagccactgcgcccatcctaatttttgtattttcagtagagatgagttttcaccatgttggccagactggtctcaaattcctggcctcaagtgatccaccctcctcagcctcctaaagtgctggtattgcaggtgtgaaccaccacgcccgaccagcttttttttaaatctcagcctcctctaggcttttggaccctgtctctgcatctctggcagggcgaagagacagtataccgaaatggccaggccaggcgcctgtaacctcagagctttggggagccgaggtgggaagatggcttgtgctcaggagtttgagatcagcctgggcaacatagcaagaactcatctctacaaaaaaatttaaaaattagccgggcatggtggtgcatgcctatggtcctagctactctggaggccaaggcgggaggatcacttgagcctaggaggtgcaggctgcagcaagctatgatcacaccactgcactcgagaccaggtgacagagcgggcccctgtctctaaaaaataaataaagtaaaataaaatgggcaacacttggatagggcagtgcaggccagacattaccctaagccatttacctatcaatgtattatttaattcacacagcaatcctaggggtgggtactttcattatccccattttacaaaacaagaaacagctacagagttgcaaaaccacttatcccaagccaggccgctgataagcagcagagctgggattggaaccccggcagttagggcctaaccaccctgctcctctgctgagtgtttgttgaatgactgccggtgaggagtgacgcaccccctctcctcctctccccagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctgtgagtgtatcgggggtgacccctcccccatcaaaactgcctacactggcttctctaaagcactgtctacattgtctctgaatgttgtctacgtgggttccctgaagccaaattctgcactaccttcctgccattgtctacactggctcccatgggcaaatctacatacttccccctcattgtctacattggctttactgggttcctgcatgctgtgcctagtctgtggtaacctgggatgggcttgcaagagccagtttgatacatttctttccaattccacatccaatgaagtcttctcggtagcttgaaatcaaccttggggaatatttacaccaaggaaattggcaaaccctagaaatgggggcttcttttattccccagagagttggtttaccagcaaagagctgcccccaacagtgtcttttctggctcccatggaccccggttgacactgcccctggaccgttagatcaatcatgctgggccatgtccacatgtctacatgtctacactgcccaacctaacatcgtctccacaccttcccatacttctgccttgacttccctaggtgccatctatactgagtctcccagagtctctacaccgacccctgatccctgatattatttacattgtatttattatttattatttattattatatttttatatattatatattatataaaatatataaattatatattatatattaacatatattttgtcattatttattattgttatttaatataatataattacattatattatatattacattacaggctccaccccccgggccctgttgatcctgacccctcccactgggttttttgctagctcttccagaaactgcctatactcacacctcgtaatgttacccagagaggccaccctggcactcttcacacagaatccctcaaatactggcttaaccacctcttccaccactgtccaaaatgaccacatatcccaactcaatgttgtctacactagctccccaggcaatgcctccacttacacagattccctaagccaagtctacaccagctcccccaggcaacatgcatcacgtgcgcccataagtgcaacagctcccctgagcctcgtctgtgccactttcctcccgggacctacactggttgcccaaaccctgttttgacatcctccctccatgccaaaaacacacacacaggccgggtgcggtggctcacacctgcaatcccagcactttgggaggccaaggcgggcagatcacttgaggtcaggagttcgggactagcctgggcaacatggtgaaaccctgtctgtactaaaaataccaaaattagctggacgtggtggtacatgcctgtaatcccagccatttgggaggctgaggcggagggatggcttgagcccaggacgtggagtttgcagtaaaccaggatcaccccactgctctccatcctgggcaacagagcaagatcctgtctcaaaaacacacacacacacacacacacacattatttgtagtggctcccttaggcactgccagcactgaacaataactcccacaaaattatccacagtggtttccctgaacagtgtctacactgacatcagcacacaacagcctggactgatttgccccagacagttttgactgctgtacctcctgccaacccgccccgtttctttagcattcctgtctatctgctaacttgtccacccgctctgggattctcctccttgctgatccagtccccccatttcccccagaccctcctgaagtgtccatctccggctatgatgacaactggtacctcggccgtactgatgccaccctgagctgtgacgtccgcagcaacccagagcccacgggctatgactggagcacgtgagtcacgtggtctcagaaccctgggtctgagggaggcgggactgggggcctggactcctggatctaagggaggaggggctgggggcctggactcctggatctgagggaggaggggctgggcctaaattcctaagtcctccaggatgaagggagcttgcattttggcaatttggggtctccgggagtacttaggtccctggagcttggctcctggtgggtgtatctttagggatgaggcctgtgctcccctctcgaccttggtatccctctcacctgaccccacacccctccaggacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgaggtgagtgggtcttgggggccgtgtgtggagacctgggtccgctcccctggagttctgcccttcaggacttggggctgcactgggggaggctgcgccgccgacctgggagggatgcagacctgcctggctgaggggagatgagggttggccttcccctcgtggcctcagactggggtctggatttggggtgtcggggtaggtgaaggcagcagagttggggggttgaggactttgctcggggttcctagaaagtagaggcctgggtagggtcctcacgaatagacccgaggaagctgccctgggctccagctcctgagaaagacgcacacctagagtcaggcatgcaaacttcaaagagacagaaaccaagagctcccacccccagaaacacaatccggccccaaggcacggagccaaagaggaaaagcacaaagccagaccatcacccagtgatggaaactgggtcaaactcacaactgcagggccacacacctagagcgcggccgggactgttaacagagccatgcttcctgggacagagagacccctgggtcctggagatagggccagagacccctcctgtcagagccacagctggcaggatccacagccacagacactccctgtgctgagaaattctgttgcagagatgcatcagaatccagacactcacctggatggtaaccctgcacgctcaaacccattgtcaccaagacacacacccaggaggacagtggcaccagccaagatagactgaacgaagccagatgacacctggaaagggacattctttttttttttttttgagatggagtctcgctctgtcgcccaggctgaagtgtagtggcgcaatctcagctcaccgcaacctccgcctcccgggttcaagcaattatcctgcctcagcctcctgagtagctgggactatatgcgctcaccaccaaacccggctaagttttgtatttttagtagagacagggtttcaccatattggtcaggctggtctcgaactgctgacctcaggtgatccacccgcctcggcctcacgaagtgctgggattatatgcatgagccactgcgcctggccagaaaaagacattcttagaaacacgccagggcgacggtccatgcagcacacctgtgcaaacacgcaatgtgcaggccccccagaaacatgactgaaggtgtagggacaaactcccagacaggggctgtccctgtcatgcagacagactagccacggagggacagaagcagacccccttactgagtcataatcttagaatgcacacacacttgcagggacacccgagggaaaacagacccctcttcaggaatccagatacagccagggagataggacacccctacgggaaacactgtcacagacagcaaacccagagagacagctgtcccgctctgggctcgcctggcgcgtgaggatgcacataagtccccggaggaagacgtcacacagacacgctgggggcaaaactaatccaggacagcaacggctgcacacggaggaatgtcatccctcactcacagaccctcagacggaaaatcaaagacatcctgggaggagcttcttcccaggaactctcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggaaatacacccctaacctctaccccagatacacctgacaagctgatcccctgcccacacacccagcaggtggctccaaggtcagagcctgcagaacacagacgcaatagagaaagactcagcgctgtggaaagacacccccacctacccacgacagtggccacagggccacccccagccaataacaccattacaaagacacgtgccttcagataatgcctgcagaaacgtgcatgctccaagcactctagaaatcccgtctcaagcagtgagtgccccgacagccacagccagaggagacacactcaaagctcctggggtcactctcagagggtctctgagccacgaacccacatccaggcacacacagagtcgtcacagagacacagtatggagtccacagcagcacgaacataggatacgaacgccgcaccacaggacagatctatctttagggagactcagagaactttttatttttaatagagacagggtctcgctatgttggccaggctggtcttgaactcctggcctcaaagcattcctccagctttggcctcccaaagtgctgggattacaggtatgagccagcacactaagcctgattcagagctttgaaccctagacatatgaacagactcagcttcgagttccaaaacaccaatgccacctccagaaacagagacaagcctcccaagataggctcaacctggtccagttagtgaccagcacaggagaaaaatctgtttcactcctcaacccagtgtatagttagagacatatataccaccctaccccctaccaaaaaagattttatcctcctttttttaatgctatttgtgagtcactaagctgatttgacagcccgctgggtcatgaccccctgtttgaaaacaacagaaacagatgtccttcctgggtctcagcccctcctgtgtgtcgaggtgtagaggtggggtcaggtgtgggtgaaccccccacccccgtctgtcccagttatgccttgcatgcagggatgggggaagtggatgtgggtaggttctggttacattgacttctgtccctggcttggggcccaggagccccatccctccctgctcacactgccctcctcagcacttcatggcttcctctctctctccgcctccccactacctcccatcccccatccccacctgctcagcccctgcagggagcactaaggaagtcccactgtcccggtctgtgagaaccccattttacacactggggataagtggcctagagatgaggcagccacggcacttggaataaatgctcccagccactcaagagggcagaattatcaggaatctgtggccctctgcagagagctttgggatcagacagcctcccactgaaacccagctgtcctcccccgagggggtgtggcccccaagctcatagctttgtgaggaccccacagcacattcagggagggctgcgaagtcagatggcaccagggtcctggccagtgaccgggcggccagatctattgcatccaaatagccagcttccactcggctacggcgatcgccagacatgggagtttggtgttgctagatctgatttgtccccctaagagaaacctggatttttaagtgaaatcgcctgatttttgaaaggttggctagcaatttaaattttgcaaaacactaacacctggggaccaccggttggcatccccctccttgtacaaagtggtgctcaggctgtagcgaagggcggaggggcttctgcttccccacccccctcctcctcctcctccattcttctgcccagagtcaccccctcattctggtcactcccgctccctccatccccgcctatcctgcatctcccccaccccctcactccccagagcgatcctcgtgatcttgtgtctccctttctctctctctcacccctccttctctctctcctcagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatcaggggtgtcttgtaatacatcagaccccctccttgcatgttggggaaagagagggtgggacagggactcctaggtcccagggctgggaagagctgatccacgcccccggggaacgagagcctggcaggggttagactggggaaggctgtggggctcggaccacttggatccttgaaagacgcattggatggccgagaaccgcaaggctcgtgcaactaggattcaggtcactggattggggactcagaggcctggacatttggactcctgggtcccaggacagaggctgcctttctggatggtgtggccagacccatcagaggcaggagttctctggactcctgggccctcgggtggaggtgggggtggggacagcaggggctcagccaggttccctgcgtcctgagagaatgaggccagagggctgtgatccagtggagcctcagacctcaactcccccaggttgctgggggtctcgggaggggagggctgctccccactcccattcttaggggccctaagggcatggggcaggcggggggtgctggggaagtcccacctctggccaccccgactgtggctcccctccttctccatccttgcccccagggatcaccccaggggacttttcagtggctccctgggagtggcggcagctccctccagctcctctcaactggaaaagcaaagacggggggaggggcggcccttggtccttgaactcccaggctcagtaagggacaggtttttacccgcgtcacctctgctctcccaagcctccatgcctcctctgtaacacggggcaggtgtttccatcggcctcacaaggctgtcgtgggacccagtaaggacatgcccgtgatgccctcatgcagcctcattgacctccacagaccccaccaagccctgtgccaggcagtgctggggctgcagctgtggcctgcacagacccagtgccgtcctccggtgtgcacggccataatgaccacaagaatagcagcagtatgtttaggatgaaggtgtgtgtgtggaccgaggggcagtctctctctctcactcccccaccctctgaagccctccagaggatgccaggctgtggaacgggagcagtggagatccaacagtccagcgtcctctggaagcttcctcctcatctggagagtgaggccgatgcatgcgtgacccccacgggcccttccatacttgttacttcctctggttgtttgttgtctgtactcacccacccaccccacccggacaaccggagggcaggggcggggaattgggtccgcctggcacacagtggatccttcagtgccatgctgagtcctccttacacacccagcaaacacctactgtgtgccgaacctcaggcacacagtctagtatggaaattggcaagtaaacgggtaaccactccaaaaactcttccattaggaaagacttgagaaatggaaacgggaggtgctagcaaggaaggagaggcccaggagcaaacaggcttctcgcttctcgaccccttttcctgtcttgccttttttttttttttttttttttttttttgagacggtgtctagctctgttacccaggctggagtgcagtggtacgatctcggctcactgcaccctccacctcccaagttcaagcaattctcctgtctcagcctcttgagtaacgcacccagcctttttttttttaagaagtggggtggtctccctatattacccagattgggctcaaactcctgggctcaagcgatcgatcctcccacttcagcctccaaaagtgctgggatgacaggtgtgagtcactgtgcctggcccctggctaattttttttttttttttttaagacggagtttcactcttatccaggctggagtgcaatggcgcgatcttggctcatggcaacctccacttcccaggttcaagcaattctcctgcctcagcctcctgagtagctgggattacaggcgcgcgctagcatgcccagctaa

SEQ ID NO: 12150 - DNA, 59252 bp, Human
aagcctccccaggttcaaatctcagtttccttacttattagctgtatgacctggagtaattcaacctctgactctcaactcttccagctgtaaaaggggctaacaatgctcatctcctaggcttgtggtcagtattaaatgtcttgtctacagacctttgcacatgctgttccacacagctgggagtggggcgaggctactcatccttcatgctaaccactttgctcttttgcgtgcacctttagattcaagaaggtagacatcatgttagtcttattcatcatcccagcctacgcaacaaagcaagactgtgtcttaaaaacacaaaaacaggctgggcgtggtggctcacacctgtaatcccagcactttgggaggctgaggggggcggatcacctgaagtcaggagttcaagaccagcctggccaacatggtgaaaccctgtctctactaaaaatacaaaaattagccaggcatggtagtacacgcctgtaatcccaccaggaggcaggagatcacctgagatcaggagttcaagaccagcctggccaacatggtgaaaccccatctctactaaaaatacaaaaattagccaggcatggtggtatgcgcctgtaatcccagcaggaggcaggagaatcacttgaacctgggaggcggaggttgcagtgagctgagattgcaccactgcactccaacctgggcgacagattgggactccatctcaaacaaaaacaaaaacacaaaaactaaaacaaaatagaggtatgtgcaagatgctggaaaaccacgcaatagagtgtttgaggaacagtctttggtcttgaatttattataggagaatgtggcagccacagaagctgcttggatctgcctttataaaatgactgaacatggtgggagcattggaacccggatacttctgcccaaggagacttctcattttttttgtcctggaattccctgatgggttgacctgtttgtcagatctgagtctccttgcccaaccctgcttatttccccttctctgtcacgggcattacccctagctttatctcagcatctcatctgctttctggaggacctgatctgacccagaaggcctggattcttgagggacaaggggaactcgaagctgtacttgcagagcagttttatataaaatccacaaactgccatcacccatcccaacgggtagggaagtacctctaggaggattaatttagagaatagctatatagtgtctgtctattcagacactcaataaatggtagttgttattattacccaatttccgagtgtgtgggagcactgggtgtgactttcctgtagttttccctttaatgtctaatctggggacccctctgccccatgcagttttggaaaagtgtctagggagggtggctgtgtggaagtaatattaagagagatggaaccacacaggtattgggtttgggccagaaagggtgaactgcgagctgcactgccattgatccagaggacgaccccaggaaaggtcagccacgggctccgggccttgcctggtactgatttatggtcctcctgggtggtgacctacaggtgacagacggacaggtgggcaaaactgactgtccagtggacaggcatgtgatgacccagtggctgacgaatgcacagacacatggctgactgtggacggatttgtcatccgcagggtcaggcaagtgactttgagagggacagaaagatggatgggagtggctggaggcctgggagccgcccacctgcccgcttagccgcgagggggcgccaccgccccgcccagcgacgcccactgcccgggctcttggcgggggcgggaccagcgtgcgcagggggcggggccagcaagctcgcgggggtgtccgggggcggggcgcgcgtgcacagggggcggccgggggcggggcgcgcggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcggtgagtgagcgggaggccgagggaggaggaggcgagaggcgcgcagcttggggccaggagggcgccagcgagcggcaggggccgcgggatcccaccctcggcggccccggcctcagctcctgtccctgccggccggggctccgcggggctgggatccctaaccgggccttagtctcgggccaggccggccccggcaccgaccgcacagcagcgaccccccgtctgggacggcttcacctctggacccccgacctcggggacccatcaccatctcccagaagggccccagggaccagcccgcccctcagggacccaccccgtccgctgcagggacgagacttcctgcggcagaccacctcgtcagctacgggaccctcacctcgcagacctctccccacccccacctcacagatcgaccgcccaactcggggagcagctgcccgatctcatgggctgctccctcatttcctcgacctgctccccgtccctccagggccgccccccacttcacagactagcaccccccttcagggataacccctcggagcccacccctttcatttcacaagtcagatgcaaaagctagagatgagcgtgtgatgaccacacccccatttcaaagacaagtttcccagtctgcctgctcttctgaccccccacttcaaatctggtcaccccgtttcaaggacccatcactcattttctctcactgacctccccgctctgtggaccagcccctcaattcacagaccagtccgtctaccatggtatctaagtctagaacggtaatttgggagtcctgattctctccccacccctagattctggtgaaatgccaggggaatgaggtggaaggtgggccccaaggtatgaccatccctgaacgtgtcctggctagcagagtcccctccaccctctctgcgtcaggccctgctggaagccacgcaggtgaaagaggacaggatgcccagaacagagttttactgttttcctgttattggagccccaaggctactcttttcagtccagtcttgatctggtgttaggggaaagaaagtatctcctggaagccgactctaaacccaagggggttggtgccagggttctaggaatgccttgggtggcgtgaacgcaggagtgggaggattcgctgtctctccctccccttcacgcctgtagctggagggccctgagcttgggaggtgaggaggggggcaacgtttcttctctgcaggagccttgtctttcctctctggactgtgggtggcttgtgtgaccactgatgcttcctctgtcccaggctctgaggagtagattcagcagacaggactgatggacctctaccaagcagcgccgggcactaagttaagactggctatttgtaggtgctggacttgactgcttccctccagcttccttttgggatcagggtgcccctgagatcctggagctggggttggtgtagggtcctgcctgttttgcagagtgagatggctgccaagcgtggttctgcctttgggtcaggcttggcacccatttttccagtgtgctcaaggttggcatggcttccaggcaggtatttttttttttcacataaaaatagctcagctggaaggaggctgggggatgttctttgaaccaggatctaagagtctgagtgctttcccagtgggaactgggagcaaagttacagtttctaaagtgctggtgcagttctgttgcttctcggcagtccccgtgctgtttcaaggactgagaaagtctttgtagagctcgccatcgaaatctggaattcctgtcttctgacagtcttccatttagggccaggaaactgagttctgaaaggaaagagagtactgtatacgggagaggggattgtagggatttaaattgctgtttgtggagtacttccctctacctcgatttgtgatatcctcacaacaacccttttatcagattccaccttaaagccaatgctgtcatgaccacctgcctttttacagattgagaaagccgagacgaagagaggctgattctcttgcccaaggctgcacagccatgaaatgacaaaaccataactggaagcccaattcctagctcccagatctgtggctcttgtataccgagaagactttttttcctggggaggaggcaagggcacttgaaggaggggttgccactgggtgatggcgatcacctgtaacttctactgctttctaccatagactcccagttgcttacatccgggctgcccgacttccttggcctgagctcccaaggggcaagccacgcctgactgaccggagcctggggtgggaggaatggggtgtgcaggaggggagaggaatttgcctttgcactggggccccgtcagctgtctggatggcggctcagcacactgccatcagctgttttccttagggtggctcagctgttttccttagggtggacacaaagcccagacctcttgtttttatttttctcctgagcgtgctctcagccgtgtgcctcctggtccctaacacaggggagagtttatggtgtgtccggtagcaaggccagagggtgcatcacctcctctgtgactttgttttttggtctaataaaaaatggggaactcttctccttcccatagttgccaatgacagactcaccatgtgctgcttaataagttacaaatttatagctctctgagcagaaaaatatcaacacagcgtgttctgcccttccctgtgtgttctctccactttgttctttggggtggctgcttggtggcttttcttattactgtttagatgctggtttggcccagagttcgctctgttcaagttctggccggagtttcctggacagagttcccacaacactgagatgcactctgactgtgttttctaacccgattgcttgctcttcctctgttcatgttctcagtgtacttggtgggggctttgaccacaactgtggtctaatcatgatcatgtgcgcttcatgggagacaggcactgtactcagcactttacgagctgtatcacaacctttcagaaagggaggtgttttcgctccactttatacatgtggaaacctgagctcagggaagtttagtggtagtgctgggatttgaacccaggctcatccaattccagatccggttatcttaatcatcataaggtggtaggtgctggtgactaaccagggggatgagccttggggcctgctgagtaattgatagttacctttaacaatctctgccctaggggcccatcccaggaaatggcaaagggtgtgtccagtgcaagactgggtagctttgccttcccatcctctagcagggggaacagccagctgttggcagtgcccagttgctgctggaatctggacatgtcttctttcagcttctcagcagtcttgaccctttggaaaacagtgcctcattgtccttgggggtagtgctaggggggcagaggagttgcctggggcattgggagctatggagcctccctgtttccatggaaagtctggactttgggctttcctgtctgtggtccctctgtgtgttagggcagagtcagggcacccagctgctgggcgtgtggcagaggcggcatttacccatgcagcgatagtgccctcctggtgggctctgcatcagtgccagaccttctcctgggcttgtgctagtaaggggcagagctgggattcaaaccttggtgggtttgattcttcagcgggtacactttctgatatgtgaagctgtctgctgcctgggcagacatagcttgatggagaaatgctcagcctactggaacccaaagccctgtcactataggttcaaggtcttttgagggaatatctcagtattccttttttccagcttccctagtgatggtcatgcattgaagagactgggtgtacccttggctggagaggctgatggaaggccagagttattggtgggccactgagcagccctcctctcctatttagtcatcctgcttggagtatctgactctgaagcttctcttgcgtctttacctcgctccagagatgttgaataaacttccagcctcattgcagcctttccggggatcatcctagtctcagtgccttcattaataataacaaaatctgccgggcatggtggctcacacctgtaatcccagcactttgggaggctgaagtgggtgcatcttttgaggtcaggagttcaagaccagcctggccaatgtggtgaaacccaatctctactaaaaatacaaaaattagctgggcgtggtggcgcgtgcctgtagtctcagctactcaggaggctgaggcaggagaatcgcttgaacccgggaggcagagattgcagtaagccgagatcgcatcactgcactctggcctagggggtacttttcttttttacagtgtttacagaactttttctcataatatttattgagctcttattatgtgcaggcactgtgctgggcactttacatgcattgtttgcttgaatcaagctggccatatgaggcaggttttattagtagtcgtattactactacctgttttataagtgaggaaactgagacacagagaggtgagcccacttgcccaagttctacaactagtgaatggcagtgctaggatttgaatccaggtggtctggctgctgagcgggacttgcagccaactgttttgtacacttttttttggagacagggtctgcagcctctgcctcccaggcccaagtgttcctcttccctcagcctcccgagtagctaggactacaggcatatgccgtaacgccccgctaatttttgaaattttttgtggagacagggtttcaccatgtttcccaggctgttcttgaacacctggcctcaagcaatgtgcctgcatcaacctcccaaaatgctgggattacaggcatgagccattgtgcctggtgcattctttacacttctgttcataatactgcatctgatatgggttgcccattggtttgactgttttctgtttctaggacactaacatttttctgcacccaccctattctctgttgtcttccacatctgtcatttccctgttctctgcagcttcttgtctgtcttttgttctttttttttttttttcctgagtttcactcttattgcccaggctggagggcaatggcatgatctcggctcaccacaacctccacctcccaggttcaagcgattctcctgcctcagtcccccaagtagctgggggcatgagccaccatgcccagctaattttgtatttttagtagagacggagtttctccatgttggtcaggctggtctcgaactcccgacttcaggtgatccacccgcctcggcctcccaaagtgttggcattacaggcgtgagccactgcacccggcctttttgttctttcttggggacacacactcaggatgggatgcagggtcctggggggagtgtctcctgttccaggggaggccccaatcctccctccctggtcacctctccagtcacctgttactcttgagacagagcagtgagcttacagcaccactgccaaggagaacctggggcaggtcccctgtggtcccttgccacctcctctgctcaggaatcagaagccttcctgtgcccccagccccgctgcacccgaacatgctccttgtctttcccgtatccagaggagggagttgttgaaaactttatggtggagaatgaaggatgtcctatgggagggggagaggaagagagaatcaggaagctgagttttctcagaaatgttcacaaagcaagtcatggaaatggcttcagggtgccctcctcacctgggatgggccctgagactccatcgacagcctcacggggtccactctgccttttgcagtctgggtcttgttgggagtctcatatctggccttgagtgtacattcataccctgataagtcttccaactaactaaccgattgcctaaccagtggtgctcagggctggcctctccagggaggccttggatgctgggccagtggtagacagaacatgcggttggccaggcccagtggaaccccagtggccaaatcttcccttaaagacggacttttaatgcttatttcttgtgtgattgtggtattgtggttttatgggagaatattgttattgttaggtgcatgctaaagtatttaggagtgaagtgtcatgatgtcttgcaacttatttttattttttcattttttatttttgaggcagagtcttgccctgtcacccaggctggagtgcagcagcgcgatcttggctcactgcaacctccgcctcctgggcttaagcaattctcctgtctcagcctcctgagtagctgggactatgggtgcatgccaccacacccggctaatttttgtatttttagtagaggtggggtttcaccatattgtttaggctggtcttcaactcctgacctcaggtgatccacctgcctcagcctcccaaagtgctgggattacaggtgtgagctaccccacctggcctcaacttagttttatttgtttttttttgtttgtttgttttgaggcagagttttgctcttgttgcccaggctggagtgcagtggcaccatctcagctcactacaacctctgcctcctgggttcaagcgattctgctgcctcagtctcccgagtagctgggattacaggcatgcaccaccacgcctggctaatttttttatttttagtagaaaccaggtttctccatgttggtcaggctggtcaggctggtctcaaactcccgacctcaggtgatccacccacctcggcctcccaaagtgctgagattacaggtgtgagccactgcacccagctcaacttagttttaaatgatataatgaaaaaaaggatatacacataaagggcagagagcacaagggccatgcgtttacacaaagtggtaaaacaatgacagccattcaatctaagtgagagtacccgggcctctcaacttctctgtgtgcttagacatttttataatgaaaagttggagaaaagtaaggaaaccctgcttttccatgatgggcttggagttgttgggcctaggtgctggcctgcgcctgcctatggttggcctgaatgactgctggtctcctgtgattgagcaggtggtgggaagactgggtgagcagagacagtagctgggggggcctcaggtgacagtgactgctgactatcatctgggaaatggggagcacagtgctgtgacctgtgcagaaaaaagacaggcccagagacagtgtgtgtccataggtgtggaggcagcctcatgagttatttgagcatgatgacattaatcagaccagggttgaagcatgtgagatgccgaactctggttggagtttgagatgggttgtctaggctgatgggatgcagagcaagacttttttttttttttttgagacggagtcttactctgtcacccaggctggagtgcaatggtgtgatcttggctcactgcaacctctgcctcccaggttcaagtgattcttgtgcctcagcctccgcagtagctaggattatgggcgtgcgtcatcacgcctgactaatttttgtaattttagtagagatggggtttcaccatgttggccagcctggtctcgaactcctgacctcaggtgatccgcccgccttggcctcccaaagtgctgggattacaggtgtgagccacggtgcccagccacagcaaggctttacataattcagggaacggtctctgggcagcttgaggcctgtgggcggggaggagatgtcttttgcctcacatcatgaaccccttatctgtggccagtggaacaccattaacctgtgggcagtgatggctgagtgtccccaggcttttgcttatagctcaagtctgaccatccagttttccagccttcaggctccccctcctggaatccccactcccttggtccctcctgtctagtttgtgctgactcaaagctggccctcttggacctccagtctgttttggggaaatagctggattctggcaccagtggccctcttggctctgaggcagaggtgagggccctggtgcctactagaaacatttcgggcagccagcaggctctcatgaggggagggcttcatgccaaggtcttctttcagcctcatgtcatctatgtcagcgtgcagagatgccgaggctggccacttggcgaggactatgaggtcttctagcgagggctcagagcttcactctgcctatttgaaagcagcatgatgtgtgttttatgggggagggggtgatgctgggaggaagctttatgtaattcttggctggagctcaggtaattgttttaatgaaatggaatgcagcttattcagaattcgcttggcagaaacagccatgttctgttctgttttcttgttggggagagcagggcacacatttccagctgttttgaatcgtagaactctgggtgagctggagcaaggggggtggaaccctccagggagctccagggagcttcaggccgattctcttctggatcccggtctgtgtgtattgttttgaatgagccttggagactttggcctcttctaaaacataaaaaccctactgaggccaggcgcggtggctcatgcctgtaatcccagccttgggaggctgaggcaggtggaacacctgaggcctgaagttgggagttcgagaccagcttgaccaacatggagaaaccccatctctactaaaatacaaaattagctgggcgtggtggcgcatgcttgtaatcccagctactcgggaggctgaggcaggagaattccttgaacctgggaggcggaggttgcggtgagccaagatcaggccactgcactccagcctgggtgacagagcgagattccgtctcaaaaacaacaacaacaacaaaaaaaaaccctattgaaagcaggctatgaaatgggtgtaatgcctgccttccacattgttgggagactgagtgaggtgcttagcacatagtagacagatcctcaaggatggcctctatttgctcacgctttactccaccccccacgtccccatctttctacccccttttatacctcatggtcatcatcttctgtcagtgtagatggctgtggccccatgtggccccgatgtccccatctgcaggtccacctggctctcctttttcttctggttccgtttttctcctctccttctcttctcttctttctcttttctcacagggtcttgttctcttgcccaggatgaagtacagtgatctgatcacagctcactgtaacctccaactcaagcgatcctcctgccctcagcctcctgagcagctgggactacaggcacgtgccaccatgcctggccaattttttattttttatacagccggagtctcattatgtttctcaggctggtctcgaactcctggcctcaagcaatccttctgccttggctttccaaagtgctggtattataagtgtgagccaccatgtgtcttgcctgtttccctctttttacttttctgcttttactaacttcagttttttgttttgttttttagagagtcttgctctgccgcccagaatggagtacagtggcatgatcttggctcactgcaacctctgtctcccagggtcaagcgatcctcctgcctccgccccaccccccccaaccccccgcagtccgcagtagctgagattacaggcacacaccaccatacctggctaattttgtatttttggtagagatggggtttcgtttgccatgttggccaggctggtctcgaactcctgagctcaggtaatccgcccacctcggcctcccaaagtgttggaattacagatgtgagccattgtgcctgacctgcacttactaacttttttactttgctcctttttattttatttatttttaaatttattattatcttttttgagacagagtctttctctgtcacccaggctggagtgcagtggcatgatcttggctcactgcaacctccgcctcccgggttcaagtgattcttctgcctcagcctcctgagtagctgggactacaggcgcccgccaccatgcccagctaatttttgtggttttagtagagatggggtttcaccatagtggccaggctggtcttgaactcttgaccttgtgatctgcctgcctcggtctcccagtgctgggattacaggtgtgagccaccgcgcccggcctgttcctttttaaattttaacacagtctgacccattcttccacgtttgctcttttgctgagacacctgtctcaccctttagctgcatatttttttctcccttccttaagctccgcttgcttctccagagaccctcccaccttcttttcccaagtctcctctgatccctgagtggaggtgcacctgggtgttttcccaaaggatttctctgaactccttgtttttcaactatgcacctcggtcagttaatcaactgcatgacctcttttataacctgtgtgctggtgactcccaaatttatatttccacccctgacgtgaattctattgtccagattcttccggtctgcgcaccagcagagactcaactcatttcctttccactctcccttctcatctactcccttctcatttccttttcactctcccaggccccatctactgcctgttctctgttagcgccccctctcttctctgggcctgtattagataatgggcatttgtgtagcacgttaagcttgaggaaatattttcatgtgcttctttattttttaaaaaactaaaccttaggccgggcattgtggctcacacctgtaatcccagcactttgggaggccaaggcaggtggatcttgaggtcaagagatcaagaccagcctggccaacatggtgaaaccccgtctctactaaaattacaaaaattagctgggcgtggtggcacgtgcctgtaattccagctatttgggaggctgaggcaggagaatctcttgaacctgggaggcggaggttgcagtgagccgagatcacaccattgcactccagtctgggtgacagagcgagactccatttcaaaaaaaacaaaacaaaaacaaaagaaccactaaaccttattgtgtatattcgaggtttacaacatgttgtcataggatacgtacagatagtaaggtggttgctaaagtgaagcagattaacctgtcagtcatctcacagctactttcctgtgtgccaagagcagctaaatctacttatgtaacaaaaatccgaaaatcccgagtacgattttcttaacttcagccctcatatcatacattagatttctaaacttgtgcatctcgtgtatctgctacttagtattctttgacccacgtctccccattctccacttccacccatagtaaccactgtttcattctcgatctctgtatttgacctctttatagatatataaatatatatattggactggacgtggtggctcacgcctgtaatcccagcactttgggaggctgaggtgggtggatcatctgaggttaggagttcgagaccagcctggccaacatggcgaaaccctctctaccaaaaatataaaaattagccaagcgtggtggcacgggcctgtagtctcagccacttgggagcctgaggcaggagaatcgcctgaacccaagaggtggaggctggaatgagccaagatcacgccactgcactccagcttgggtgacagagaaagactcgatctcaaaaataagtaaaataataaataaataaatatatgtatatagtacatataagtgagatcatgcaatgtttttcttgttgtgtctggcttatcttacttagcacgtccttccatgctgtggcaaatgggcagaatctccctttttaaggctgaataattcactgtatctatatacaatggatgtataaaccacattttaattatttgtccattgacgatcattttttatatggttctgatagccaccctttgaggtagatagtagttattttctactttcagaggaagctaaactgaagcccagaggagttaggggaagggaacacacccagtgttaccacaggcaatgatgcaagaacctgcaccttgggtgggtcttcccacaactagcccggtctcttttttctttttcttttttttcttttttgagatggagtctcgctctgtcacccaggctagagtgcagtggcgtgatctcagctcactgcaacctccgcctctggggttcaagcaattctcctgtctcagcctcctgagtagctgagactacaggcgtgtgccatcatgcctggctacttttcatatttttagtagagacggggtttcaccataatggtcaggctagtctcaaactcctgacctcaggtgatccacctgccttggccttccaaagagctgggattacaggcgtgagccactatgcctggtcttctttctggtttttcatatgggaaacctcaaggtagaaatcagaaatctacgggtcagatttggtctgcagacccttgttgcttggtctgcatggtattcaaaatattccaaattagttgccaacatttaaaacatcaggagattgcaccaaaaagtccatgttgttccttttttttttttttttttttttgagacagagtctcactgcgtcacccaggctggagtgcagtggcatgatctcggctcaactgcaacctccgcctcctgggttcaagcaattctcctacctcaacctcccgagtagttgggattacaggcgcccgccaccacgcccatctaatttttgtatttttagtagagacggagtttcattacatgtcgtttcttttgaaaaatcagatcaggcttcatgggatgtgtgtactctgtgtcaccacttggttaacctcaatagctccagccttgtatttgaccctctctgttgcctacattgggtctcacttgcctcacacatattcctacttggcccctgctttgggggattctaagaactctctgtgctcgatgtttaatgacaaatgcagttgccagatctagggggtatcttgtattgcagtctctgaattacatttgacttctgaccatgccaaccactcagttctgccttgagtctagatgttggttcaagttgcagaaaatagccttctcctgactcaccttaccctctgcctttaaaatcttagctgaatccacctttttgagaaggcttttttccccgataaaactaaccagcctgttgaccctcctgctaaggtaaaactttacagatctgtgtaaattaggctttcttctgtctcccgctctgccccgtaagctctttgaagacagggattttatctgcctttcaaataccccttgccaccaagcactgtgctgttctctctgcggtcacttaataactacttgatggtggttggtgattaaatgggtatgaactgcgacacccacagtgatgctgagcctgcagcaaaccacttcctcctctggagaacctgagttctctctgggtttggggtggggaggtggcatagaacccagcctctgacatcagccacacttggttctgtatcaatgctgttgcctactacttgtgtgaccctggcagatcactttacactctgagccttggtctcctaatccatgaaataggtgcatttcctgacatactttcccgaaatactttcaaagtgctcagtaactggtgatggttatcgttcattcttgggataatcttgacaactcctggggtggagggtttggcttttggtatcattctcttggcatttatttgtttgtttgtttatttatttttgagaccaagtctcgctctgttgcccaggctggagtacagtggcacaatcttggctcactgcagtctctgcctcccgggttcaagcaattctcctgcctcagcctcccaaatagctgggattacaggcgcccacgaccacgcccagctaatttttgtatttttagtggagacagcgtttcaccatgttggccaggctggtcttgaattcctgacctcaaatgatctgcccacctcacctcccaaagtgctgggattacaggagtgagccaccgcagcggcctgtttgtttatttatttattgagatggagtcttgctttgtcatccaggctggagtgcaggggcgtgatctcagctcactgcagcctccacctcccatgttcaagtgattctcctgcctcagcctcctgagtagctgggattacaggcatgcgccactatgctggctgttttttgtagttttggtagaggtggggtttcaccatgttcgccaggctggtctcaaactcctgacctcaagtgatccacctgccttggcctcccaaagtgctgggattacaggcgtgagccaccatgccgggccttatttattttttaattaattgattttttttgagacagagtctcgttccgttgcccaggctggagtgcagtggcgtgatctcagctcattgcaacctccacctcctgggttcaagtgattctcctgcctcagcctcccgagtagctgggatcacaggcacctgccatcacacccagctaattttttgtatttttagtagagatggggtttcgccatgttggccaggctggtcttgaactcctggcctcaagtgatctgctcacctcggcctcccaaagtgttgggattacagacgtgagccattgcacctggcccactcttcgaatttaagcttccacttcatctttaggttggctgcatttcccgtggccttggtgggcacttagtgcaattggccctgtttggttgcttagctaggcctgggggaagaatctgacttcagttactttctggaagaatgtgatttaggactcttcatggcgccatgggttggagaatgtttggaactctgctgtggaggtgaaatggccacacccttgggctggtggtgttaagttgggttttggttatatgacttttaatttcccctgagcctctttggtggctttcatgaggaagtggtgggggaggaggtggcttggtggcttggtttatactaatcgctcatctaacactaatattagtgagagctgccacagggagctgtgctgagatccactcccagatcagccctgggcttctcctagcactctaggcatccagaaagcctcatggggtggtctggcccctgaggctcctagtagcagtagaaaaaaggagagttggttttctggactgtgaacttggtggttgtacactgagtggacacagctgtgtcatgaagctggcccagtgactgtacccctttaggggtagttgatctgtgggacccaccctgggctctgttggaggtttgaagtggctcagagagtcctggccgagctttgccccctctgtttccaggaacattcctcttccttaggtggaaatgggagtgtccaatggcctgcacttggtttcctctggatttgccatttcccctgtgtactcctggctcggctggccggctaaggcagtttctcatcactgatgtgctctgggacagctgagtgggatgggctcctctggggtgggtgtggaggagtggtcgtgatgcctggaacactgcagtcactcctcagagacacgacttggcagccctcctgagcctgcctggtcacatgctgcctgtcttggaaggtcctctgtcccaagcagtggatgtgcagtttcttcacccctgcttagcttcatcaggcacaatgcgtctttgaggtgaggtagctgttgggatagctgggtggtctcatttcttccctgcctcaccacctcaaatggcctcttctgctgtgtcctgaactttccaagaactcctcccccttctctctctttggaagttggcacttgaagtctttttgtctggtctttggaggcagccaagccggaaagaagctggggaagaagatcgttacctggaggcggttgtcatggcttcctgtggtcacttgtggtcatctgcttctaaacatcctgtttgtgcctctagagcagcaggaacagtgaccaggagacagctgttatctgcctgactttggccaaagcatgggggctggggtgtcaccatcctgggggatgcttgattggctgatcactggcaattgagggcattgctggtagcagctcctttgggcaccactggcttgggctctgtccttcctcttctccctgcttcgactgtctgagattttccctcctaacggcctgttgggtattatcagtctgcactccccctctgtgcttctggactgatccattctttcttagagtcctctggtgcttccagagctggaaggaaccttaggatgtcatttcctcctatgcttgggagtttgtggccgtcatcttcttcagtcagagctgcttacttttctctgtttatatattgagcttccatctaagaccacaattacaaaaggggttttgtggatttttattttattatttatttatttatttattttgagacagagtcttgctctgtcgcccaggctggagtgcagtggtgcaatcttggctcactgcaacctctgcttcccaggttcaagcgattctcgtgcctcagcctcccacgtatctgggatcacaggtgcccaacaccatatctgactaagttttgtatttttagtagagatggagtttcaccatgttggccaggctggtctcaaactcctgacctcaggtgatccacccgcctcagcctcccaaagttttgggattacagacgtgaaccactgcacctggccataactgccagcattaatatagtgttactcactctgtggcagccactgttctaaatacctcccttacgttcccttatcatttcctcacaacagccctctgaagtaggtattctagctgacgacactgaagcacagagaggtgagcaacttgcccgaggttagttgctgattagtggtggagctgggattggattcagtgactgtcgcatacagccctttgctgacattgtagactctgttctgattcctgctcgccaatgagggtgatgccacgcggtgccactggggaggagggaagagaggggacagtctggtgtgtgtgtgtgtgtgtgtgtgtgtgtgtgtgtgtgtgtgtgtgtgtgaaagtcatctgtggattgtatatggtgtgcttgggggtgcagtaattgaggaaacatagtcaaccaggtgtctgctgagggcagtgggggctgttgaacactgacccctatccagggttatcagggactgaaaatgaccccaggagaagtgtggtgtgagctggcgtgcttccctctggggaaggtctaggggctgtggacagaggagggagcatttcctgctctgtggccatcctccagccccctcttctaccgtgagcaaaggctggggtccctcatgttccccagaccagcagtctggcagccctctgtcctcctgctcttcacctctcttgggttatttgcttatatcttccactggcttcctttggaagagttttttctcaattattgagctttctcaactggagagtcaaagtctccagtttccaactaggattgtggatttgtcactttttcttttcaattttgtccatttttgctttatctactttagagctctgttgttgagtgggtgtacatttaggatgattatgtcttcatgatgaattgactcatcattatgaaatgtccctctttacctctggtaatattcctgtctggaagtctgccttgcctgatattaacagaagcacttcaactttctttctttttttcttttaaacaactgctattctgttaataaaatagttgcttgaaacatctgcagtggtgactttaaccttgaatctcagctcagtacagatggacgtaatctgcttagcaatctcgggaggaccatccaggtcagtgagtcacttgcggattctcatctggaaacgatcccttgtcctagaaccttcatcacgaggcgtttttcttatagtgattctcagagtcttgataggcatctgaactgatccttcactttgagattcttttcctttgcacctctgatcaagtcagcacacaccttctccagagatttgatgttgcggcaggctagggtaattctgatttaataaattgccacctctagttccacggatggctttgaaagccatagctgtggtgtggcttcctagctgacttgttctggggtgagggcaaacagtggcaactcaggagcaggcgagggcacaccagagtttagtggcagctgccagctggctccctcaaagggccactctgccttccttgatattagtgtttgcatggtatatctttctccattgctttatactgaatctatctgtgtctttatatgtaaagtatgtttcttgtagatagcatgtattaaatactgcatttctacccaggctgaaaatctctgccttttaattggagtatataaaccttttagattttaaagtaattatcaatgtggttagactgaagtctatcatgttgccattcattttccatttgtgccatctgtttattctttcttcttttctagccttcttttttttaaaatttttttttatagagacagggtcttgctgtcacccaggctgaagtgcagtggtacagtcatggcttactacagtgtcaaactcctaggctcaagtgatcctcctgccttagcctctcgagtagctggaattacaggcatatgctaacatgcccggctacatttttctttttttttttttttttaagacagattctcactctattgcccaggctggagtgcagtggcgcaatcctggctcactgcaacctctgcctcccgggttcaagtgattctcctgcctcagcctcctgagtagctgagactacaggcacgcaccaccatgcctagctaatttttttgtatttttagtagagacagggttttaccatgttagccaggatggtctcgatctcctgatctcacgatctgcctgcctcagcctcccaaagggctgggattacaggcatgagccaccgcgcctggcctggctaaatttttcttttttctttttcttttcttttttctttttttttttttttttttgagacagagtctttctctgtcccccaggctggagtgcatggctcactgcaacctctgcctcccaggttcaagtgattctcatgcctcagcctctggaggaactgggataacaggcatgcgctaccatgcccagctaatttttgtatttttagtagagatggggtttcaccatgttggccaggctggactcgaactcctgacctcaagtgatctgcccacctcagcctcccaaagtgctgggattaaaggcatgagccactgtgcccagcctaattttttatttttatttttgtagagacggaatctcactgtgttgcccaggctggtctctaactcctggcctcaagcaatcctcctgctttggcctcccaatgcgctgggattataggtgtgagccattgtgtctggcctcttgccttgttttagattcattgagtattttttagggttctgttttatttccactctttgcttatttagctatacttcattggtttgattttagtggtcactctgtggtttgcaggtttaaattaatcacaatctgccttcaaatcataccataccatttcacgtataatgtaagaacagtatatttccatttccccctcctgttttttgttatttctacatatattatgaaacccgtactatgtagtccaccttttatgtttgtccacaaatttactataatatttctagcattcttttttttttttttttttttgagatggagtctcgctctgtcgcccaggctggagtgcagtcgtgcgatctcggctcactgaaagctccgcctcctgggttcacgccattctcctgcctcagcctcccaagtagctgggactacaggtgcccgccacaacacccggctaattttttgtattttttagtagagacggggtttcaccgtgttagccaggatggtcttgatctcctgaccttgtgatccacccacctcggcctcccaaagtgctgggattacaggcgtgagccactgtgcccggccgcattctttttttttgaagactaaagaagttaacaaaaatgtcaggaaaacattgttttgtttttttttttcttcccctccttttcccattctcgtctgagaacgtgttgtcttcttcctccctggctagtttccctgcctgtgaactccctcagcctcactaatctgtacgtgctttgtggctcatcccatctgtgcttcagtcatgataatcgatgctgtcagtctctctgggctacacagccccacacttggtgttgctgacacattccggtggtgcacgtttgagaaaatcgcacattccagctcatgtcccctgcctcctctgctccatggggagaggtgtgaccagatctgcagggcctggggctgccacactcctgttccttcttgctctgttgctacgtgatgcccctcctcctccttccccagcaccaagccagagagtcacccagtcccaggccccaactccctcccagctgcctcattcctatgccctgagcccacctcttggagctccccttccccacccacaaaggaagccagataggccacccagtgagtttaaaccttaagtacccacaaggggctatgctccagccacaaagtcttgtggactattcctttgatttttttttattatttattatttattttattttattttatttatttatttgttttgagacagagtctcgctctgtcacccaggctggagtgcagtggcgtgatcttggcttactgcaacctttgcctcccaggttcaaacacttccctgcctcagcctcctaagtagctgggattacaagcgtctgccactgcgcccagctaagttttgtattttttttttttttttccgagacggagtctcactctgtcatccaggctggagtgcagtggtgcgatctctgctcactgcaagctccgcctcccgggttcacgccattctcctgcctcagcctcccgagtagctgggactacaggcgcccgccaccacgcctggctaattttttttgtatttttagtagagacggggtttcaccgtgttagccaggatggtctcgatctcctgacctcgtgatccgcccgcctcggcctcccaaagtgctgggattacaggcgtgagccaccgcgcccgaccaagttttgtatttttagtagagatggggtttcaccatcttggccaggctggtcttgaactcctgaccttgtgatccacccacctcagcctcccaaagtgctgggattacagatgtggccaccatgcccagctatttttttgtttgtttattttagggtaggagttttgctggttggggaggggtggtggcaactagatcacagtagatgggacattctgggatagaagagtaggaacaacttgggccctgtgctcctgtgttgctctccctcaccgggctttgcatacagtgagctcttagggaggaccaggaggtggcatgagctgaagtggcaaggctgatctcagcagcagactgacttggcgcaggtcatttgttgatttgtttggtatcatccatggagcccctattatatgctaggctctgcccaatgctcagatgaagatgaatataggcgtactccctacccacaatgtgctattcctaggctgtgagacatggccccttaggcagacagttcctaccagcttgaggtgttctcataggagaagtgcacagtgctttgggaactcaaaggaatggagcctcaaaccctttgtaggagagtaaggtcagggagggcttcctggaggaaatgggatcctaaactgactctgttttgtgtgtgttttaagagataggatttctctgttgcccaggctggagtgcagtgatgccatcatagctcacttgcagcttcaaacacctgggttcaatccatcttccagcctcagcttcctaagtaactgggattacaggcatgtgctatagcacctggcgaatttttaaaaattttttgtagagacagggtcttgctgtgttgcccagtctggtctcaaatttctgccctcaagcaatcgtcccgccttggcctcccaaaatgcttggattacaggcatgagccaccatgcccggccttttgttgtgtgtttaaatagaacctcaacatttagaaaaggccccaacctttgtcctttacttaaatggtcattctgtaataagattttggaaagagaccttcccagcagaaaagcaacacgttgctttttctctaggtaggcaggatggatcctttttatcctctcgttgaagaagataaactaagctattatgagtctcaagggattagaaaggatttagcctggtaaagaagacaggagagaggtctagggagagggaatagctcatgcagaggcctggagggcggacgtgtgtgcaagcatgtgtgtttagttcattggtagtgatttggtgccctgtgtccagttggatctttcaagctaatcaaacttatcctgagccacaaggccaaggacagtcattaggctttgcatcttcattggaatgaccttttggggatgaccttgctacgatagctgagatggggctggcctttggggcatctgttatcctacagtgagatgagcttttttttttttttttaaagcccgagtctcgctctgtcgctcaggctggagtgcagtggcataatcttggctcactgcaacctctgcctcccaggttcaagcaattctcctgcctcagcctcctgaatagctgggattacaggcgtgtaccaccacaccaatttttgtatttttagtagagacagggtttctccatgttggccaggctggactcggactcctgacctcaagtgatctgcccgcctctgcctcgcaaagtgctgggattacaggcatgagccaccacacttggccatgagatgagctttatctgtgcaaagtctctctgtggtcagctggggctggggccgtgggtcagttctgaagggcatttccatgagggtttgaggcctgagattgtgtcctgggccctctggccccagtggtgagccgcatgctcatgtggcaggaaggatctggttcctctgataacctgcttaggctgacccctctttttcctggaggacggctgtcagagatggggctggctttctatttgaatttcagaggcagactcgtgcagatgggtgcgggcagaggaagggagcccatggtcttcctgaacactctgagaattcccagagcaggctgcatgcaacttcctgaggttctcccaaagccagacagggagaacaacttgtgttcaggagaagggtaccatataatttaacaaactgttacttagataggtgccttggccagagaaaaacgtccttgggccctggctcagggaacactgtggctctgcctgttcttggtgtaactcctgatccttgttaccgtcattacctgacccctgccgcagaccttcttccctgtctcatctgttccatccctcctgcaggaaacaaacatgggaggcatcctgcactcctcactccttctccatatccactcagtttccaggtaacattgattttacctgatttcatgtagagtattgcaactcttgctcttcctccaattgagccctgcctccctctgatctcccctgcctgagtgatgtaaagtgcaagcctggtcctgctgttccgctgctgaccgccttccttctgtggcttgcccttgtaagtccagactccccagtgggccctcggcccttgactcctcttccatcaagctgggacttgcactctgagctcccatcccctctgtctgggcactttcccaggctgttttccacctctgcctggaaagcccctcccctttcctcctggcccactgccgctttcagggccttctgcccctcgtttatgacagtctcccactagtcagtgctccccggagacaggcattgtatatttgcccctcccatgcccagcatagtgcccgtgcacactatgtgtttgtgaacgcgattggagccatcactagtaaaggtgaggctgtcccagtgagagcatcggagggagggtcttggaggaggcacgtgagacaggtgcaggtggctctgccttggatacccaagcgaggccacatctgttttgtgcctcctgaactggggtggcttcactggagtttgctgcctgggtcagtgtccaggcaggtcccattccagaaattctgatcacctgggattgaggtgaagatgaggcagcttcagcttcagcccctagtgatcagacttgtcttcaaaggaccaagctgtgatctgacaggggcagggtggtgcactgtcaggcctgcccatggcagtggtttcattcagattcccaacccctttgggccatgactattgggatctctccccagagtagtgtggtagggacatggtagtgaaacttcaggtggtccacagatccccaggagggtcagctccagatgccagattaagacttctgatataaagtttagctcccttggggggctctcttcctccctttccctttgaaagggaaaaaaagagaatgtggaatacttttgctccagggttagggagctgaactgagccagcaggaagagggtggattgtggggccaggtgcaggccaccctgagtgggtgggcactgttatgcctgacactcagggcctctggagtcagtcctgggtgggttagtgtcgatgttccaatggcgaatgctctggcagagttaggaggcagagacttcagaagggccatccctggactcctttcttggcacttgcgtcattgggagcactgtggggctgcgatgccagcttttggactggactcctgggaggatcagcagtgcccttcttcctgttggcttgtgcactgagcttcccacaccacgaatgcaggggcctccagatgcatctgcttggtgaccctttgaacttgggaatggcttcaaagccagggagagagattgctgttttggttgggtcctgcaaagcctctcagctttttagcccagatcttgtttacagtctgatggtctggtcccagtgtcttaacaggtgactctggagccactgtgggagagtcagactacctaactgacacctgtcagagcaccttctctgcagttgcttatggcttgcagtgctgggcatgcacttgctctggtggggcaatcagggatgtcagctttgtgggtgggacagctcctcatcccccatctgtcacctgtcacctggtgagataggcactaatgatatgcatggctgtgtgcttgtgatgtaccaggactgctttatgattgttatcttatttgttcctctaaatggcttgagtgaggcttgggaaccccacagtccccattatataaggggcagttattatacctattctatagatgagggaactgagctcaaagaggtgtcatgctagcaagtggcagagctggacctgaaaccacgtagttcagcgacaaaacctgtgctacatttttgttgcatactcacttacctgcagaggccaggcaggtcatgtgaatggatgaagtgggccaaaaaaaaaaaaaaaagggagctagatttcatgttgttccaaagaaggtagccaagcagaccagtgttgctagctagctcttctgactgttcctgggaagccagaaatcctggctttcatgtgaaatctctcaatttattcagattagctcagattttttatttaatttaatttattatttatttatttatctgagacagagtctcgctctgtcacccaggctggagtgcagtggtgtgatctcaggtcactgcaacctccgcctcccaggttcaagcaattccgttgcctcactcagcctcctgagtagctgggattacaggcatgcaccaccacgcctggctaattttgtttttgtttttgagacggagtctcactctgttgcccaggttggagtgcagtggcacgatactggctcactgcaacctccgcctcctgggttcaagcgattctcctgcctcagcctcccgagtagctgggactacaggcatgcgccaccatgcctggctaattttttgtattttcagtagagacggggtttcaccatgctggccaggctggtctcgaactcctgacctgtgatccacctgcctcagcctcccaaagtgctgggattataggcgtgagccaccccgcctggcctaaatttttgtatttttagtggagacagggtctcaccacattggccaggctggtttggaactcttgacctcaggtgatccgttggcctcgggctcccaaagtgctgggattacaggcgtgatccaccacacccagcagaaacttccaccctttaaaaaggagaaaccagtggcaccaggaagggcagtagtgggacaggtgcttgctcagctccctggcttttttggtgaccatttcctgtctgaacataaagatgggcaggaggagaaggagcagccccacccgacagtttggttcccgtcagaagttccctagctgaccacgaagctccctgtgttgcagtacagtagttagggggcagaagcacgggatttcttgtccttgggaagtttagcttaggagcgtccaaggacagctgtgccccccatacatagctaggcacagagcaggtactgcctgaaggaggaatgatggggttcaccctagcacctcatggcaagacagcaatctctgcagacactgcagaacctagcatccactggagctagtgatgtaaatagtctacctgaacagtcacccagtttcccctcagagtattgtttctattagaagacattctccacagctcaaaatccaacttccaaacaaccttctggaatgctccacgtgtgtacatggggactttctgtgtggtgtttctgggcattgcggccacgtactgctgttgccctctggctctgctgggctggatttgcggagccccagagtgtctcctgcaataaaatccaaaccaggggcgaggtgtgtaccccctcccccatcaatccctggcatagccagctgggcatggtggagggaggccaggccagccaagcctggttggagccctggaaccctctctgctgcatgaacccccgggcacaggcacctccgttcagtttacccatgaggcttggcatctgcttggcctgcttcctcagctttggagttagtgggcttcttgcaggctaactacgacgtggtctcatttgagttctgttcccaccctatccctctcccctgcaccttgatatacctacacgtgaactccactagccagactgaaagcccagaggtctccctgggtgctttttgtttcaggaaaatatcttctctcctttttttctattgtggtttcccagcgtgactctgcagctccatctgcttcctccctgtccaggaagaggcagatttccccatgcggagagttggcaaggctccgggcctccggagaaattggccttgccctcttcaggacagtggccggggcattcctcctttgtagctcagtgatgccatcccaccagcgccctgggttgggtcaggcctgctgcctatgattgtgcctggggagcctacaaagctcagtggggtggggggactgagacgagacttggagcttctgtgcatgggatgggccctcctgagaccactccttattcaggaggtgccaactctctgtggggacgccagctgtcaaggggcctcagcatttcctagagccctgaaatcagcagatggcttccaaaatttgtgtgcccaagaagacccagggctggatgaggtagacacttctagggaggcaaaagggtcactgagggtcagctcggggagcactctgggggcagctagcctgactcccctcccccacttcttctcagcactcgtgaccatctatgatagtggtttcaaatggtgcgctgccaggacatagccttcagatgacaccaagggtgtgtctggcattctttgcactcctagctctttctttcactcaagtaaatgcactggaacacatgcgggtggggctgatggtcatggagtcatcttgaacccacttcagtttattttctccaaaataaaagcaatggccagcaggagttcgagaccagcctggccaacatggtgaaaccctatctctactaaaaatataaaaattagcagggcgtgttggcacatgcttgtaattccagctacttgggaggctgaggcacaagaattgcttgaccccaagaggcagaggttgcagtgaaccgtgatcatgccactgtaccccagcctgggcaatagaaggagattattctgtgtgtgtgtgtgtgtgtgtgtgtgtgtatacacacacacacacacacacgtacatacataagcaagcaagcaatgaccaggtgcagtggctcatgcccgtaatcctagcactgtgagagactgaggcaggaggatcgcttgagcccaggagttccaggctagccctggcaacatcctaagaccctgtctacaaaaaatagaaaacttagccaagtgtggtggcatgcactgtagccctcatgacttgggaggctgaggtgggaagatcacttgagcccagaagtttgaggttgcagtgagctatgatcacaccactgcactccagcctgggtgacagagtgagaccttgtctcaaataaataaataaataaatacataaataaaattaaaagatcagctggggccaggcacagtggctcacacctgtaatgccagcactttgggaggccaaggtgggtggatcacgaggtcaggagttcaagaccagcctggccaagatggtgaaaccttgtctctactaaaaatacaaaaattagctgggtgtggtggcaggcacctgtaatcctagctactcgggaggctgaggcagggaattgcttgaacccgggaggcagaggttgcagtgagctgagatggcgccactgtacgccagcctgggcgacagagtgagactccgtctcaaaaaaaaaaaaaaaaaaagatcatctgggcatggtggcacacacctatagttccagctattcatgaggctgaggtgggatcccaggaggtggagattgcagtgagctgtgatcatgccactgtattccaccctccagcctgggtaacagagcaagaccctgtctcaaaaaaagaaaaaaatcagttgcagatgtccataccttatgatgattagccaaggactggtgacacacctcatggcagattgcacgtcagggtcgagagccagtggctgaggacagctctatgctcaggcttgtgtttccccagcgtgttgtgccctctgcagccctcttgtgcccagacacagagtagttaaaaacagcagtacagagggcaagacatggaactgcctacttttttgctcagtgggaaaagtgcttgggtgagacatgtggctgtccattgaagggaacagctatgctgactgtgggttggaaaatctaggctggctgtcttgctggctgtcccgtgttggctggtttggtgcctacagtggagtcccttgtctgcctgtgtgtctcttaatgattctgatgtcatctctgcgaggtcagaggttggttcccggggcaggcccatcttgcaccctgaggttcagatgggaccacaagcagcgtagcacagggggaaaacacttgtgcgcgtcgaccttgcacatcaacaagttagaccagaacatggagtgcaccagccttctcagaattcttgagctctctgtaccaccactaggggctcctctgtggctcaagacccctcctgaggcagagggtgaggaggaggcagaaagaaaagagaacaggagacttggagtgggcagcagtagagcggaacccagcaggcccgcctttttggattcctctgggggctctggggatgtgtgttgtgggagtggagagtggtgacgagcagaggacggacagctgctgaaagcgatcattcctctccttgtggggcatcctgggaagaacatgggtgatctctgcagtcaggcagcgcagtcctcgtggggccttatggggcggctctgggtgtctgcattctaatccctggcaacaaatggggctgcaaggctgggctcctggtagatgctcaggaagggttgttccactcctcaccccctcctgagctgctttctagcctcgcagccccgtctttggatccctttttggcactctgctgggctcagagcttccgtggcaggagcagaggctgctctctcctgggttcctctgggagctaccatggagcttgggcagttccttctattgttgcgattctgggttcaaagccacaggcctctcagacagctgtgacttcccggcaggcagtagggatggggtgggggtggaggcgttggggccctgcagcttccctcgcttgcctctgtccttgctaggcagtgagttggaggcgcctgggctcagctgatgttctccaaggaggacttggaatgaacccgagacacaaagggtgaggtcagtggtttgctcagcaagaaggctgagttagtgacaacctgtcacagctcccaggatccctggctgcagtccctggctccgactcctccccctgctggccttaagggagatgaaaatcagtgatgtggatctattgactgagtgtctcctgtgtgtcagagtgggaggcttacgtttattttatcccagccaccaggatggctctcacattctttttcatccattactcactgtgcgctatgaggtgcctgagtaaactaaagcccagaattatctagtcactggtcacccaggctagtgagtggcggatttgaacccatcctcctcactgttagatggcccattccttccactctaccacactgccatgcaggtgggatgcccagagggtgtccaaagaactgtgtgaccatcctagctcccaacgacagcagaccagccaaatctgtgatatgggcaggggtggttttatgtgtggacagtgggggctttgtggtgctgcttaaaattgtttgccaaagtccccaagagcaaaatcttatctgttttttttgttttgtttttttgagacagagtcttactctgtcgcccaggctggagtgcagtggcgcaatctctgttcactgcaacttctgcctcctgggtttaagccattctcctgcctcagcctcccaagaggctgggattacaggcatgcaccaccatgctcaactaaattttgtatttttagtagagtagagatgaggtttcaccatgttggccaggccaacatggtttcgaactcctggcctcaagcaatctccctgtctcggcctcccaaagtgctgggattacaagcataagccaccatgcaggccttgaagcctctctttttatcttacgatttcacttgcattttgcatttgactccataatgtagccttgtttgttttaagacaatgatttacatttcttgcccctgagtacatttgatcctcagagtgttctgggtttatcctgaggtggcttcctgtacccctggcttccatctgtcccctgggggtatggatatccttgtgcgagaggctcaaaccaggtgaatgatgatagaggtagtggtgggacacattcagtattgtgaagaaaggcacgctggcaaaaagggaagcggggagtccagtttggctggagacatgggttgcagtgagggggaccaaggaggcagtgaaggttagtttggggccatattctgagagggtcaagaacagaatgccatccccagggtttctgaccttgttttataggcagagagggcaacagtgggtgagtattataactccaccccttgctctgcacacattcattcaagcccctctaagaggcctgtgagggccgggcacagtggcttatgcttgtaatcccagcactttggaatgccgaggtgggtggatcacttgaagtcaggagttcgagacaagcctgtccaacaatgtgaaacttcgactctactaagaaaatacaaaaattagccaggtgtggtgtgtacctgtagttccagctacttgggagactgaggcaggaggatcatttgaacccgggaggtggaggctgcagtgagctgagatcatgccactgcactccagcctggttgacagagcaagactccatttcaaaaaaaaaggaggcctatgagggtatccatgctgtggggattcaggagcaggaggatgttcttgcccacagaggacctgcagtctagggggagaagcaagagtgaagtgtgaggcatgccccaaaaaggctgggtgccaagaagttcgggccgatggtgtgtgcaggaagcgttagattgggagaacccagggcagggggctgcagtcaagttcaggtaggcactgagcatggattcgaatgctagtccaagtggttggctgtggtgatgaaaggaaagggaggcaagtgatgacagggagaggccccgcgaaggaagaattgatgtgacttagtgaccagctaaatgtgggagctattaaagggacttagaaaagagaactggggaagtcaggcaagcgagagctgacttcgggaaatgaccttgctgcctgaaaaaaggggaaggtgctggctggttagtgagaacctgattagcaaagagtgggtaactaatgctatgaaatccacaaaaatcgcaaaaaaactgcagctcatctcaggaacaggcaaacttttgaactttttgttcgggtctctgtgggacgatgactcactttgagcccctcctaacctctgttggtgattagcaggggtgagaggcccaaggagccgccctgctctgcaacagatcaacttgcctggaagagcccagattgcaggaatgggctggggtcgatttggaacagctgagaacctttccagcccatgagtctcctgggtttgaggctgtcttttttgtatgtgaatctgggttttacccattgaaggagctgtgagttgggcctggaatggggccctggacttgacctgaaaaggtctagcatctctgggcgacctaaagaggtggatgacatctgaccaatgaaatgtgtccacaatgttctgggacctctggaggagggagggcccactgattctggacaggagagatgagttatttacaatatgaaagagactctggggatgggcatggtggctcctgtctgtaatctcagcactttgggaaggcccaggcaggaagatggcttgaggccaggagttcaagaccagcttgggcaacatagtgagaccctgtctctacaaaaaagtttttaaaagcctagtgtggtggcatgtgcttttagtcctagctactcgggaggctgaggcaggaagatcccttgagcccaagaattctaggctgcaatgagctgtgatcaggcctctagcctgagtggcagaacaagacttgtctcaaaaaaagaaaaaaagaagagaaagactctggtgtttggccagcctggcctgaactcctgtgtctgtagcctaaggcagatgcatagaagtgctcagagtcaacctgggcagccttgtctcacctgctgttgcttaagctcctggagcccaatttgatggggaagtggctgcagccaggagcctgatgggtgggccttgtgtgtgcctggtgcagatgggcctggcacagttggtcttctgcctggagctcagggtgactgctggagttgccttgcagccattattttctcaggtctctggttacctgtgccctgtgaccttgggcacaagccaggcagccaataaagccagtctgtctgcacactcatattgtgtcaccctctgcaaggaagagctcctcagcatacaggaagccaccctcctaagctaggcctgtaggaagcctggggaagaaccacttcatccaaatgaccaccccctcctcccctggcggctgactggaagactcctgggccttctcccctggcttcctgtgtgtcaccccccagcccacacttccttcagggctgtaagggtaaaatgcagttcctgttgagtgaggcatgagtcagcggaggagaattggtggctgagtctttgtaacctccaggcatggctattaaatatttaaatgacactatggtattgatcgtttctcatccatcctcttagcagagcagttcctgtctgggattcagataatagcagaatcttggatttagactaactcggaagagctcaaaggtgctatataaatctcacccataattgtattatctcctcagagcatgctactaggaatggggacaaatcgggttctgcccattttcttgatagagaagacatccagagaggttagaggatccgctgaggggcccccactcatccgctgggcctgggatcagggcatcctggctcccctcctccgcactggctgtttgctctgctcactgctgcttccccatcctcctcctcttcacagcccctctgtcattcagccattcattctagctgctggggatatggcatcgaacaagaccgacaaggcccctgctctctggagcttaattcttggagaggagacagttgacaagaacccaaattggcagggaaggcccctcaaggagactgagttcctagtcagtgtccaggccctaggtccctgggctgggggtgggtggggcagagtggatctggcctaattgtggattggcccttactgaggacagacggttatcaggataaatatacccagctcaccattcctggggacttactcaccgagtgaaagcaccccgctgcggattagattacctctgctctaactgctcatgtgctctgggctgggggaggggaggggaacttggagccagggggaggggggagacccgccttcccgttctgttttccttcctaatctggaagagtctcaccaaaggggctgagatgagaccatccctgagctggtcctgctgtttacatagctccttccttaggaagggccaagccctgctcactgcttatatccctgagcgtgggcaactgtaaggaggccgcagcttctctgacactcagagctaccaaggctgcccaggtggtcatcagggggttgggaacctcccttgtccagagttctggacccaacaggatagacaggccatgaggctgggcatccccagaccccctaggacagggacttgtttctctgggagtctgggtttcctatcagatggcagggatggacagctggcccagggctgcggggaaggcccctgtgctatggcagcccgttgctgctggtgctggagctttcagggcggtgcttgctgctccttcctttggcttgtcagctcctaaggaagctgcactggccgctccctgcctggggcaatgaaagctgagtgaaattggcctgcagaagaaggtgggtgaaggggctggaaaataccttgttcttacgtgggcctctcctgggccaggcctcgagaatgcaaggcgtgctaaggtggggcgctgcctgagggccacaggactatacctcttctagttctgcctggggctgctggtggaggagtccagaatggcaaaggtgggcagggaccacggggccctggcgctggggctggtgtggcagggcagcctgtaaactccaagaagggatggaaaagctggctccatgccccacatttacctgcttcctgctgatctgggactagagggcagcaccctttgccctcagggattggataggacggggaggtgatttctttcccctcctagggcttaacacctccctgggaagaagcttgtaatctatttagcaactcccatttcctgtgtgctgtattccaggcactgtgctaagtcagcactttatatctttttctcatgtagtcccaatcctgtgagtaaaatggtggaattcctattgggcagacaaggaaactgaggcacaaaagcagttaagcagcctatccgagcagttcagccattgagcagagcccaggtgactgaggattcaccgtacaagttgtaacactgaaagtcctcagagcctgggaggagagaatggaatcgctctgggtcctcccaccccctcagagagatggacttttatctcctctctcttggcacctgtccagctccaggcctctggtcttgatagtctttatcacacactaagaagtggcaggggcttaggtaggaggaagaagcctggcttgtttctgtgctgcagtcgggggtgggggcggaaggttttaattgattctctttaatctgatattgagtgccatgcgtcagtggatcaaccggggtccccagagccacagtctgggggacatccccccattgtaggtacaaggggacccaggtttccttccacccggagcccctaggtgggtacaggaatgtgagggatgcagctgcagcacttgccctggaatgcaggcgaaccggtcccctcctcctcggagcagtgggctgagggtgtctgtaccttaaccctccagcggctcccaccggttgtaaggattacgctcagtcagttgctgaggcccagggaagggcttcttcctctcagcctggccgtagtgcactgtttctgcccagccacctgccccagggcggcctcccgacccaaagctgcagctgttccatgctgttgctccgaccaggtgcagccatggggtgcagataggggcgcacacggtgctgcatttgcacagggccctggaagcgagggcgtgcacccctctggttctccagagccctgcatgtcacccttgggttgtgccttcaagtgataccaggctacctgtgttcctcccactagcttgctgtgttcctccagctcagccttgttctctaaggatagaaacttccccactgcgcccatggccaggggctccccagtcttccccggctagaaaattgcaagattgcacgaggttacccagtggcaagaagctgacgggccaatggtgccctctggtggggagcagcagacagtctgcaccccttcctcaccagggcggagccaggacatagctccgtggcctttgcccatggctcgctggggactttgcacctagcctgccctcagcctcgagacagcctggcctacctcctcatgttgcatacttccgctggcccagagagacagaaaacctgcagaattcagggtgggtttcctccagaaagtggttgggaagccccagagagagagcttcctccttcagggtgacttgggtctggagggccccaggcctggacctggaaacttagtagagtaatgccaaggaaatttgaggcctttcttagcttgaatgaggtctcccgactacttccgagcagcgtgtctggaatctgtcctcccagcatgtgggaagggagggtgtattcctggtcttgaatggtttcagtgggtaccattttctctgaagagtggatagcctgacaccttctttggggtatgaggagcaggaatatttagagcagagggaaaggctggagccggacactgggggaccccgctgggatggggctctgccttcaagtggactccttcctgtgtgcagtgtctgccagctctgtttgctcaagccaggggggacgtttgctgagcttgcaaggggactctgacccttaaccattttgcagcctatggggaagtctcaggtatttgcacccattggaaatcaaagtaaagctaggagtctactgttggcttgcctcctgtatttctggttttctttcttgaggagtttgtggggggtttggaggcaccaacccctacccctcttgcctagtccttgcctgtccaaatcactaggtgagaatgaagggtggagagagaggaggaagccataccagagaccctgtggctggtggatggacttgctggggtttttctctgtccctcaaatagacaaaactttggagaaaactgaataatgatgtgccttctccctgacatctgcactctatgatttgttcgtttgtttttaagacagggtcttgctctgtcaccccggctagagtgcagtggtgcaattgtagctcactgtagtcttgacctcctgggctcaagcaatcctcctgcctcagcctcctgagtaattgggactacaggcgcatatcaccacacccagctaatttttaaattttttgtagagatggggtttcactgtgttgcccaagccgatctccaactcctgttctcaagtgatcctcccacctcagcctcctgaatagctgggactataggcatgcgccaccacacccagctaatttttaaattttttgtagagacaggctctcactgttttgcccaggctgggacatgctacaatttgaatgttactttattacttttcttttcttttcaaggttgcccttttcatggtttgctcatattctacccagaaaagacttaggagacttagaagaagttagtactttgcatcctacctacactgctctccttggaggaagaccttattctggattttacagagcaaatcagatctgatgtttgtagcttccaatgtgctatggagcttcctcctgcagagtgacttgggtctggagagcctgatatttgcaactgatgtctgcagcttccagtgtacctgctagcccttataaacctcacaccagtactttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaatccataaaccaaaagcccaggcttagaatcacattgtggtggagcgggtgtttggtggagtccctgattcaaaatgtttgacaaggaagcctgaccatttgtcttctgttgggtgtttggagtccaagagacctgagatcagagtccagcattgtcacttcatccagccttggcagtgtgggatgtgactctgcctctgaaccgcagttataccatctgtgctggtggcgttgtgaggatggcaggtaacaaaggtgaagctcctggccccagtgggccttcaaggatggcagctgctcctgccccctactggggttgcactcattcgttgcctgctctggggagtcctatggggtttcttagctggccctgcccatggtggagaaagagggatccacccattgctgattgggcccagaggaaatgaggacactgcgtgaagccaagacagcaggtgtggccctggagaggccgtggggattggcctggacactggttccttttctgccgttacctagatacctaccaactccctctagttccggtttgctagagacaggaagccaggcctcctccatgggacccggagggcggggcgggctgtaggacctgaacttccttggaggtcaggcgaccagacccggggtcctgggccttggaacagacatcccctctgtccatctgggcaggagcatggggtaggtgtggccagccttgagggtaggagatcaggacaggcagctgggacaaggtgtggccccatagaccgaggccctgggtgagggccttgcttctctattccctcctctgaacacaggttgggggactgggagcaaggccacaaggaaggatcacactggcaggcctcacagcttgggcctccaacattcaggaagttgaaccctttaagtatggcatcatctggtagtcatagtggcctcttacaggccaggtttttggggtttggggcttctgaggagtcagacaattgtgccactcactggctttgttatttggagcaaacacctctgacctctgcctctccaagcccggctttcctcatcgcttcggggagaatcatttccagctacagggggtattagggggattaacggagacctcgtacatgctgctagaatgcctagcagtctgcctgctactgataagtggcaataaacgcagccattgctttttagatgtttattatcctgagggctagggatcaagctgtcagctccctggacccagcaggttaccggggagctgagagcaagcaagttgtgaacggggcaggaatgagggtgtggcatccagggccaggctgtctgagccgtggggctgttgagggtcccaggaggggatggaggaagtgggggtcagcaggtcctactcctgcccttctatacccttcttttctggagactggggagacctagtgcccccctgttggctgccaggtgccagggtaatggaagcttacactagagggctgatttggctcccttgccgctgttaaaagcagaacagtgggggcctggagcctctggggccgggctgcttgccagacttccgcagaaacagccaatggagcagtcttgccccctgctcactgagggggtggggaccgctgcaccagcctcactccagcccccacctccccgcacaccttaccccataagcctagagcctcaggaggaacctggagcctgggcttctgcttccacctggttaggagggcagggaccatcctgagtgccccttccagtcgggggctgggaaagcctaagctcttagaaatcaagtgagggcctggcatagccagggcccctccctgtgacgtggggcccctcccgcccattctctccgcgttgccctgcagattcagagttccagacaggcacttcactcgcggctgcgcggccctgtcaggagggaacgcagtgccaggtgcctgactcccagaggtaggagatcccacagggcagccccagagcccgcctctagagcactttcagtcctgggtggccagaagaagttagctttgggagccggctcttggttaggctggtcggggctggtggcttcctgtcccaaggctggtcatttctcccatgggtggggcaggtgctagaaggcattaactcttgaggtgcaggcagggagggccctgccacgggagagtccccaggatcccggttctcacctgctacccgtgccttctctttgcagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcaggtgaggcggggacagtggctgggaaggccaaggaggctgggggacagagggaacttagctggcaggggcttagggagccaggggatggaatggaattggggcagtcgacccttcccaaccagacactgctcttcccactcaccacgtgagtggaacagtgaccaagtggttaatcacaggtttcctggcccaactgtggaaattccctggtgagactggctgtgggcaggagcctcctgggggtgactggagctgctcctggcccctgttcctttttctcccctcggggtagcctctgagcattctccttctcgcagcctcagtcctcatcacctgtgtacggctccagtgccaaaacttccagtgtctccaaccctcaggacagtgttggctctccgtgctcccgagtgggtgaggaggagcacgtctacaggtactgccccagtctgcccagggcaccttccctcctgcttagaaatctcagggacctggccagggtgggaggcagcggaggcccgggagcaggcatagcaactgggccttgtggggttattctggtttaagctgcagaaggcctgtcggtgggcccgtctacctcatcagtgccatctccatgcagtggacattctgggctatcacagcatctccgtgtagctgaggaactgaagcaagacttcattcctcccctcttctttttttctttttttttgagacggggtctcgctctgtcactctgtcgcccaggctggagtgcagtcgcgcgatctcggctcactgcaagctccgcctcctgggttcacgccattctcctgcctcagcctcccaagtagctgggactacaggcacccaccaccacgcctggctaatttttagtagagacggggtttcaccgtgttagccaggatggtctcaatctcctgacctcatgatctgcccgcctcagcctcccaaagtgctgggattacaggcgtgagccactgtgcccggcctcctcccctcttcttaccacatcccttccctaccctctgtcctcttgcgggggaagacttcgcatctcctctgccttgttctccttgggaatctgggaactgccaagccagtacaaggccagaaagcatctctcactatcttctttcctttgcctctcaaagcttccccaacaagcagaaatcagctgagccttcacccaccgtaatgagcacgtccctgggcagcaacctttctgaactcgaccgcctgctgctggaactgaacgctgtacagcataacccgccaggcttccctgcaggtaggaccgggtccctggggcagggtctaccagggcccagggcccatctgctgacctctagatcccaggagggctcaagggctgagcagcctttttctctcctctctgcaagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtgtgagtacccactgggccctccccaggtggggaagggctggcccagcctgccccgggtccagtgtctgtccccttagccctggtatcacccactccctcccgtgtctgccatttgccaggcactggggggatagtggtgagtcacatggacaccatccctgccttcagccagtcactgccagtcagaaaggacagacgttgtgcaggctgagggcgcctggagcttagcagctcttagcacaggctttggggccacacagtggggttcacatcttggctctgacagttactgtcagctctcaagccttagttttcccatctgtaaaatgggacaagaacttatgggatcactgggataagaccacctacctcagtaagggtgagaaccagtaatccatgtaaagcgcttggaatggtttctggtgtgtagtgcgtggcacacatggtgagtgcccaacacgcgagctcttaccagtgccgtcgtgttactgcagtagcctcacctccatgtccagtgttgtggaggaaacacagggcgcttgggcttgtttcgcaggccagctttcacttgggctgggggctagaggagtcttcctggcacttcctggtgccattgaactgccctttcttctgacccagtgatgggtccccaggagagacagggagctggtggacctccctggggttggggatggtgagaccccagtgtccgaggtgagaggtcgatctgatccccgggaagtgtggggctgactgtgggctccccactgatgctgtgcccaccctgcagccctgccatcactgtgaaccagggcgagatgagcagcccgcagcgcgtcacctccacccaacagcagacacgcatctcggcctcctctgccaccagggagctggacgagctgatggcttcgctgtcggatttcaaggtgccctgtgaaccctccatcttccctgccctgccgcccctccctcatccttctcctcccttacctcagtgtgggtagctggatcttggcatctcagtgtttgggtgccttgcccctgagccagggacactgtcatgccctggccttgctgtgatgccaggagatggggagggagggccgggtcagcctgcctgaggattgcagtagccagtgaaggcagacaagctggagaagtgctcagctgggacattccttcctccctgggtgctcccagcctctcaggtcgaggggatcaggaggctgggacgctgggacaaagaaccttgtgttgatggctgctctgggtgggggagggcattctctgctgggccatgtgggacttgggagcctgtgcctgggaggtcatttgccctggagccccatctcccacgctagctgtcctcaacacatcctctttctttctgcctctgatcctgaatccacaagcctcccttgctactcttctcccatccttccctctcgccctccagggcctctgagttcccacgagcgtgtctgtgggaaaccatggggccaggcttgcacgaggtacctgcccttcccctcccctgctgggcctccccagtcctgccaggcctgagatgtttaatttagaggattcagtgtttccttggggattgatattgacagaactcaccagcagctgctgacttcatacttccacgtgggtcagctggagacctttggggcatgacctagggaatatgagaggggagtgaacggtccctgcacccttggccctgatggtgtctcctagcctcccttcagctgaggtttcatggtgggagacaggagtgtggctggggtggagggttgagcctggccctgtgacccttgcgtgctatagttccagctccaggccagtggttctgagcagccatggtcagaagcaagtaagttggattcagggcctggcctgagggagctgtgccccggtgcttttaaggctgccgttttctcagacagcctgtgtcctgatgccaggagaagcagcagtggttttagtcagatccctggagcaaggatgtggaagacgtagaggacttggggtgtaggaaagctgggattgtccggagggacatggccgagttgggccagtgtccgaggcgggttcagcagcccctggggctggctctccctccatttgtgcctggggctgtcttccgtagccacctggctccccatttgtccaccttaccgtggtcttttctttctcataccctccctgggtggctccacaggcacggcttggtggctgctttctcttgcttgggtttggtgagggctaagcacgcaaagcccagggaagcttttttggggtctgggtctccttcaagggtcagtcctgtgcgtcagctttgcagccaccttggtcagccctaaggccgagcccaccgcctgcaaggtgcagccgtcctcactcccctcatctctctctctcctctcccctctgcatttctctcttctccagaccagctcctccactgtggctctgagtgccccggggctgtccagctctgctccgtcctcatactgctcccttcctccttctcctcctcccatgccatctgtatttctgccacccaccactataccctcccctcgaggccagggccacactccggagttcccttgtactgagcagagtggacgaggccttctacctcctgtagcccccagctggcttgatttggctggtcttggggtgatgcctgacaccttcaactcaaggtctccctctgtggagggttctctgtgggcagtgggcacagagagtcagggtcgagattggaggcacctgccgaccatcacaagtgagctctctggggctccccgctgccacactgtaccctgtgctgggagcacagctctccaagagcctggggagccccaggggccaccagccagcccttcgtgcccagaggaggccttggctgccacatgggagcagccatgggcttcggaggtattcgggcctgagagaatgcccccctctggagctgctcgaagcttccaagaagtaacagagccagctgtagtggcagtggaccggcaggccatcttcccagatacctggactctcacggaggaacatggcctacagcaggagaggccaaggccagagccagggaggctgggaagcagctcccctgcctcagttaccacggagcagctaggtgcaaagatgaccgagaggggaagtgtggccaggccaacccagggacctgaaaccccaaggagcccagagggcaccacggaagctgccacccaggacgggaaggaacagccagagcttccatgtgccatggccatgggcacacccagcaccacggagaggatttccacctctggccaggcaggcaccagctcgcatggctgctgggcatggccattggcgggtctgagtgtgggccgctcctcgctaactgcatgcagcctcccactctgcgcatgtctgcttgggcagaaaatgctgagacactgtggccggacctgacagtcagcacttggcagtgggctctgtggacccagcatttctcatagcgtcaacccacctcttgccttgttgaggctttttcctttcagatgagctgtccttgacattctgatgtggtgaaatggttagcagcatggactttggaaccagatagacctagatacaaaccacatgtctaacacttgctacctctgtgaccttgggcaaccccctccctcagcctcagttttctcatctgtaaagtggggagaatttccatcaagattgtccggagacctaaatgagataattcctggaaagtgtttagaacacagcatgtggtccctcaataggccgtggctgacagtacttttattacttgctttttgcttaaattaaaactttatgccgggccaggtgtggtggctcacgcctgtaatcccagcactttgggaggccgaggcgggcggatcacctgaggttgggagttcgaggccagcctgaccaacatggagaaaccccatctctactaaagatacaaaaagattagctgggcatggtggcgcatgcctgtaatcccagctactcaggaggctgaggcaggagaatcacttgaacccaggacgcagaggttgcggtgagccaagatcataccattgcactccagcctgggcaacaagagtgaaacttggtctcaaaaaacaaaaacaaaacaacaacaacaacaaaaaactttatgcctcaccctggcacagtagcttatacctgtaatcctagcactttgggaggctgaggcaagaggatcgcttgagcccaggagtttgagaccagcctaggcaacacagtgaaaccctgtctctacaaaaaattaaagattagctgggcgtggttgcacatgcctatagtcccagctgctggggaggctaaagcaggaggatggctttagcccaggagtttgaggctgcagtgagttgtgatcgcaccactgcattcagcctgagcaacagatcaagacactgtctcaaaaaaaaaaaaaaaaaaaaatcccccaagctttatgcctctttggaaaacaaaacgaaacaaccaaaaacccccaaaacactaccaacaagtataatagcataatataatattagcataataatataaataagaaaaaaaaaactagttaaaaaagttcctggctagctgagcacggtggctcacacctgtattcccagcactttgggaggccgaggcaggcagatcacgaggtcaggagtttgagaccagccgaaccaacatgatgaaaccccatctctactaaaaaaaaaaacaaaaaacaacaacaacaaaaattagccaggcgtggtggtgcatgcctttaatcccagctactcaggaggctgaggcaggagaatctcttgaacccaggaggcggaggttgcagtgagaccagatcgcgccactgcattccagcctgggcgacagagcgagactctgtccccccccaaaaaaaagttcctggaaggaaacactttttctattataaattaaaaaaaagaaaaaagaaaaagccgtatgccttgtcaagggcatgcacttacatcctctggaataattcttgtgcaaaccctgtgcggtaagccaagaaaatcttgtggttccattttaaggaaggggaagctgaggcccatggcaattaagtgtcttgcccaaggtcagtggccaacttagaggtgaatgctgggtcagaggtctcgctcgcagcctgtgcttctggagccagtccgatctgccccctccccttgcctctacccacctccaccggtccaatctgccccctccccgtgcctccacccacctccgcttggttctttggtggttttcttttgtgctccctctcctgaggcatctgagtgtggcctgagcagcgttgtgcaagctgggagtgggacggtgacagcctcccctccccctccccctagatccgatctgtgatcaggaggagctgggagtctggccacgcacaccccatgtcccgggagccctcccctcgccgccggctggaccctgccaccttgagcaggaccccatcccaggaacagctcatcgcggagctgcaggggcggctgggcatccagcctgaggcagaggagccggcggaggcggcggggccctctgcccaggactggctgaccgagggcgtcatcatcactgtgcagccacgtgggaagcgggccggggggcagctcgtagagaaggtggcgaggagatgcccatggctggggctgggccagagccaagcacctggggtccgggttcttccctggccccagtgctggccggaggggagatctggggagagggtgggggtttcttgcctcctgtgactttggaagactggccccactcttggtgcagagtgggaaggcccagggggagcctggggaggtcccgccacccctgtgggctgagctggcgatttcttcctcatcgctctccctcctttcttctccccaggttgtcttccctcctggctctcccattcccctgagaagaaccatctctgtcctggcttctccttctgtccctttgctccagcatcgcacagacgccgcggccagcagctcttctcccctgcccagcctgctcgcctcctcccccctggggccctcagcttatacctgtggttcttctggggtccagagtgcaggggaagagccccatgatgagggggtgcagggccctgcccttcccattcctgcaccccacaccatgaggtccgtgggctgccagactgatgaggacccgctcttccccccgatgcaggcaggccttaaaggagcccctccctttctgtcccctgtcctaatgcctgagccatcccccactctgcacacacacacgtgcacacacacatacacagataccctccatccctccatctacaagccccagcacagtaaccacagtcctgccgtaaaccttgaccccggtcttcccccactcagaaggtccgctgccctcttgcttttctgtgggtccacccatgtctgctccttcctcgactggtcctcagtactgccccgggctcccatcgaggaaagaagccactccagaagggagaccagaaacctgtctcctcccttccagcccccaggcccagcgcccggtgaggcctcatcactgagcccggccacctccccttgccatttcctctgcctttggtcgactcccctccctgtccttcttcctttctccctaggcctctctctcagggctctttttctccagattttttcccccaattttggtcctgccggtgggggagaaaccctcagatctcatcctagattcccttttagtccagtgacaaggtcttgtattctttcttaatttttaaaaaagatttcttaccctcatctcttcccctatctaagatccagggcctggagcaaagagcggatggggagcggtgctgggcggccggctggcctcgggacggcgggcggagcagccccggagggcaggacgagggaggggtcagtgccaaggctgggctgggtgtcctgcgtgtcgtgctctccctgggcttggccatgcctgctgggtgccctcagcctttccgaccctggtgggcccctccgaccaccaggagtcctgctgacgtcactcccactttagggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggtgatgagggggagtgggcaggggtgtggccagtggactcctgcaggggtgggggtgctccggggctggccttggccctggaccgcattccatctcctcctcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggatgtgagttcctcatccggcaccgcgcccgcttccgctcattccagcttcaccgcagccctctgaggatgcagggggtgccgtgggaggctcagagaggtcacatgcccgaggctcacagggctagggaacagtggggccggattcacagccacacctgaaccacagcctgtcccgatgtgcatcgggcagccccacctcccttcacctcccatctcgattcctttctgtggagactcccaggactcaggagccctgaggagataaatggagttggatgccagcggcctcactctccctctctgtgaacttaggaaatgcctggcctctctgagcctatgtttcttcacttataaaatgggagtcatagaacttgtgccctctacttggggtgaggagtagaggagagggtatgtgtctggcttgtcccatcctgagtaactctgaattcttagaggcattcacagcacaattaggagagacccccatcttgggagtgttttgctctgtctatggctatgagctgcgggtggaaggacggccttgctgggcgtctcagttgtgagatctgcccagagctcagccttgatcccacattttgctttcacagaaagtggtgacagcccttgaccggacgtggcaccctgaacacttcttctgtgcacagtgtggagccttctttggtcccgaaggtacgggctggaccggcggactgacccaccgcctcttaggagggccggggaggtgggggtgggagacgctgctgaggttggagtcagagtggctccacttctggaagccggaatgaactgtgcctccaaaacccccgctccccagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggtaaggagcccctgaccacatctggaggggcgaggagcaggcagtggggagagaggggtcttcctcattgtgctgtctggatccaactcagaggcctcatttggggttattaattgggggagcaggcaggggatctccttcctccagtccagtaggtcctgggccagggtttgtactgaggctgggacaaaccaggagcaaggtagacatgtcccccagtccagccctgtgcagcggccctgggccattcctatttgggaggagagtgtgtgagaactaaatgagataatgcaagtatttagcagactcaacagaaatgggcagtggtttccaaaaccactgcattctgggggccccacaggggttattaatgattcaacaagggctctctgaccaaatgagtttgggaaacactgttccctgcaggacttctcagagccttttcttttcttttctttttttgagacggagtctcactctgttgcccagactggtgtgcagtggcacgatcttggctgactgcaacctctgcctgctgagttccagtgattctcccgcctcagcctcccaagtagctgagattacaggcacacgcccccatgcctggctaattttttgtattttcagtagagacggggtttcaccatgttggccaagctggtcttgaactcctgacctcaggtgatccgcctcccttggcctcccaaagtgctgggattacaagtgtgagccacctcacccggcccctctcagagccttttctacctatatgtgatgtgaatctccaatgagaatctaggaggcagagtttgactacagaccagtgtcacacctgtgtttctgggaacactgttacagccacctggctaagtgctcaggagtcagacctgtgtatgaatccaggctgtgacctcagtagctgcatgaccctgggcaagttacttcacctgtgtgcttcagttgcctcccctgttgggagaactaaataatcccagccctgtgggaggccgaggtgggaggattgcaggaggccacatttgaccagcatgggcaatatagtgagacccccatctctacaaaaaaaatttatttaataaaataaaaatgaaaaatgagcgtttaggacaacacggcacatgggaaacgcctagcaagtaggagtcactccgagcgtgccgactatgcccacctcggccccatcacacagggtgcagctctagcccgaggggcagctccctgagcccctctctccgcctggcaggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttcacctgtgctagtgctatttcttggtggtctgaacctcatggtcccagcagagaccaaacccaccccagatgcagctggatcaccagatggagggtaaattgtggatgtttcctttcttgaggtcaaaatccctggggctggggtccgtggtccttgcctgtggtcacaggtcctccccgtgggctttgctcctgcctgggcagttggtgaggacaggctggggagcagcgggatggggccctgtggggcagggcctgcccagggtgtgatcacctgggtttaccaagggcatcctcactcacgggcttgtgggtggctttccactcatttagaagtagggaaagaggctctaggacaagaacctacatgtacaaggcaatctgagtgagggcagagccatgatgcggacccagggcttgcctctgcctgtgttcctgcacagaaccagacgcggccgtgcctgagcccacacaacgtgggttagccccttccctgccgaaggcagttacttacagttgaggatgggtctctactgcctcctcgtcgtcatgtccggatttgcgtgcttcctctttgctccggtcagatccagagctccagtcctaggccctagagcagggatgtccaattttttttttttttttgagatagagtctcactctgcccaggctggagtacagtggcatgatctcggttcactgcaacctccacctcccaggttcaagggatcctcctgcctcagcctcctgagtagctaggattacaggcagctgccaccacacccggctaatttttgtatttttagtagagccagggtttcaccatgttggccaggctggtctcaaactcctgatctcaagtgatctgccttggctcccaaagtgctggaattacaggcgtaagccaccactcctggcttttttttttttttttgagatggagtctcactctgtcatccaagccagagtgtagtggcacgatctcggttcactgcagcctctacctcctgggttcaagcaattatcatgcctcagcctcccaagtagctgggattacaggtgcccaccaccacacccgggtaatttttgtatttttagtagagccagggttttaccatgttggccaggctggtctcaaactgctgatcccaagtgatctgcctgcctcgacctcccaaagtgctgggattacaggcatgggccactgcgcccagctgggtgtccaatcttttggcttccttggggccatgttggaaaaagaagaattgccttgggccacacataaaatacactaatgatagctgatgaactagaaaaaaaataataaaatcacaaatctcataatgttttaagaaagtttacaaatttgccctgtaattccagcactttgggaggccgagacgggcagatcatgaggtcaggagatcgagaccatcctggctaacacggtgaaaccccgtttctactaaaaatacaaaaaattagccaggcatggtggcgggcgcctgtaatcccagctactcgggaggctgaggcaggaggatggcatgaacccgggaggtggagcttgtagtgagccaagatcacgccactgcactccagcctgggcgagagagcgagactccgtctcaaaaaaaaaaaaaaaaaaaaaaagaaagtttacaaatttgcattaggccaaattcaaaactatcctgggccgcatgtggcccacaggccatggattggacaagcttgtcctagagcttcctgggcagttttgtttaaccttgagctgtgtcttcacagcttccctgttgtttggaacggttctccaaaagcagcatgttgaattctagtttaaactcttcccatgctatagtgagctcagaagtgaaaattaccttcaacgctcacccaaagagaatgatggggccaggctctgtggctcatgcctgtaatcctagcattttgggaggccaaggtgggaggatcatttgagcccaggagttcaag

SEQ ID NO: 12151 - DNA, 10228 bp, Human
attctctttatatcatattagtaatgattagtagcttaatatttatttagcacttagtatctatcaaatacttaaaatactttagttatttatatgcattatctcatttaatccttacaacacccttatgaagtaggtgcttataaggctattatctcattttacagatgaggaaatgaatgcacacatatatttagtgacttgctcaaggttcatagctagtaagtagagctgaaaaacaaacgtggagaattggactccagagcctttattcctctgaattgcctcctgtatgattttctgtctttacgatctagtaagtggggttactgaaaatttttaaccccagtttaactccagtcccactaattgtggtgacaaaataatgatgtttccccacatatgccatagagtatgatgtctgtgaagtcactaggatctgctttggaaaagcgaaagagtaatttgaacaagcaaagtacaactctcaagcaatgcttaggtttgggagagaggtttttgcatgctctgcctatgctaacttccctttgaatttcatagttcctttccgctcagagtcaggatgatgaaatgtattcagatttagacgattagaatctcaaagtcccaactcttctctctgttccctgccccaccagcagctttcttagccctcttagaagatagaggagctgattcagtctattctttcatcaaatactgattgcttgcagacttaacgccctataccatcctctggagacttctgcatgtctttagaaggtatacctttctctgcctctaatttggagggctacagctgttaggcccctttggtgtggagggtaatctaatccctaggcaccagcaagacagctgcaagttgagagtaggtcaagcttactgattcttgatagactttcagatttggaaagatggcagaaacaaagtgaaaaaagagttgttaatgaaacaaagagttgataatgaatgtgatctgttggttgtatttctctctttaccttcaaccaaaaatgagaaaggatagattttgtggcaatgggaccctggttagatctttagaaatgtcttatcagggagaccggtcatatataaaggatacagcagcaactacccttctgcccttaggagtggtgactcttatcccacacccctagagtgaatctctcattttgacaaagagctaaggaaaaatgaaaagaaggccaggcacggtggctcatgcctgtaatatcagcactttggaaggccaaggcgggcagatcacctgaggtcaggacttcttagactagtctgaccaacatggagaaactccgtctctactaaaaatacaaaattagccaggcgtggtggtgcatgcctgtaatcccagctactcgggagactgaggtgggagaattgcttgaacccgggaggcagaggttgtggtgagccaagattgtgccattgcactccagcctgggcaacaagagtgacgtctcaaaaaaaaagaagaaaaggaaaagaagagcacagcaccaggatgccaaggagatactggggatctagggtaccggtgggtggatctggatattcttcaggccagctaaaggttgatcactttgtgtgactcaaacaaaaaactttgaagacctggtggggaattactggggaattaaaaactctcagttttcagtctctctatttcggctcccttggcagttagagattatgtggtagggcagactccagaagcagttcttattttgctcttcccaactcttaccactgaggatcagctgcctgggaccttctcagagctaagtcctcatagaagcaaggagatgaagaggttctatccttctctgaaaagcgattgcagcttcaatggacgtatgtttaattttattcacttttttttcttgcaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggaggtgagtgccttggggtaataggagattgaatgtttggtaagggtttttttttttttagatggagtcttgctctgttacccaggctggagtgcagtggcgcaatcttggcttactgcaacctctgtctcccaggttcgagcgattctcatgcctcagcctcccgagtaactgggattacaggtgcacaccgtggcacctgtctaatttttgtatttttagtggagagggggtttcaccatcatgttggccaggttggtctcaaactcctgacctcaggtgatctgcctgcctcggcctcccaaagtgctgggattacaggcgtgagtcaccacgccgggccggtaaggcttttgaaaagagatataagacctgattatggagctggccctcttagtcccattcttttccccagaaatggaaaccctttataaaaacagaggccggtcccagtggcccaccactttgggaggccaagatgggcggatcacctgaggtcaggagttcgagaccagcctgcccaacatggcgaaatcctgtctctactaaaaatacaaaaaattagccaggcgtggtggcaggcgcctgtaatcccagctactcgggaggctaaggcaggagaatcacttgaacccagggggcagaggttgtagtgagccgagattgcgccactgcactccaccctgggcgacaagagcaaaactccatctccaaaaaaaaaaaaaaatcaaaatctggtaaaataggctgggcatggtgggtcacacctgtaatcccagcatttgggaggccaaggcaggcggatcacttgaggccaggagttcaagaccagcctggccaacaaggtgaaatccccgtctctactaaaaatacaaaaaattagctgggcgtggtggcacatgcctataattccagctactcaggaggctgaggtaggagaactacttgaacccaggagatggaggttgcagtgagccaagattgcgccattgcactccagcctgggtgactagagtgaaaatccgtctcaaaaaaacaaaacaacaacaacaacaacaaagattagccgggcatggtggcacatgcctgtaatcccagctacttgggaagctgaggcaggagactcgcttgaactcatgaggcggaggttgcagtgagccaaaatcacgccagtgcattttatcctaggcgaaggagcgagactgtttcaaaaacaaaaaaaaatctggtaaaatagaggctggaactaatgcaaaatacaaagggtgtctgtctttctcatctttgctacctttttccccactactaccccaaaatagggtgctaattcaataaaggatcttttatgagaacttccaaattattccttccccttgttatttttatttatttatttatttatttttgagacggagtctctgtcgcccagactggagtgcagtggtgcaatcttggctcattgcaacttctgcctcccaggttcaagtgattctcgtgcctcagcctcctgagcagcggagattacaggcacataccaccatgcccggctaatttttgtatttgtatagagacagggtttcaccgtgttggccaggctggtctcaaactcctgacttcaagtgatccacccgcctcggcctcccaaagtgctgggattacaagcatgagccaccgtgcctggcctctttcccctttttattagtcatcttggaaatgtattcctggacctgcagcagattatatgaaaaagtaacagccaaataatattgataatgatgggacttgccatcaagctttaaaatcttctaattaattcttttttttttttttttttttttttggatactgagtctcaccctgttgcccaggctggagtgcagtggtgcagtggttgcccattgcaacttccgcttccccagttcaagcacttctgctgcctcagcctcccaagtagctggaattacaggcgtccatcaccatgcctggttaacttttgtgtttttagtagaggcggggtttcactatgttggccaggctggtctcgaactcctgacctcaagccatccacctgccttggcctcccaaagtgctgggattacaggcatgagccactgcgcccagccaatcctctaattaattcttttgtttgtttgcgtttgtttgtttgttttttgagacggagttccgctcttgttgcccaggctgaagtgcagtggcgccatcttggctcactgcaacctccacctcccaagttcaagggattctccagcctcagcctcccgagtagctgtgattacaggtgtccaccaccacgcctggctaatttttgtatttttagtagagacgggttttgccgtgttggccagactggtctcgaactcctgacctcaggtgatccacctgcctcagcccccacctcccaaagtgctgggattacaggcgtgagctaccgtgcccagcccaatcttctaattaattcttgatgtgacttttatctgaagctattttctctgtcatttgttattctcctattttggttagaagaaggatgactcgtataagtgccagttcttctgtccctcttagtttatgatgtacccccattccttagctagtgacatttctggcaggaaggacttagccaagggcagtcttaatcctggtttcaagacttacatgtaaggagaactcaaaaccttttcctgtagctgactatcctgggtggtgactggtcttagtgtagggcagttacattttgaagggggggagggatgttcccattcatcctcccacttacagcatcttcccctccattctctcatccatagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggtaagtgagctaagaagactgtccttgttggctggacatggtggcttacgcctataatcccaacactttaggatgccaaggcgggaggatcatgaggtcaagagattgagaccatcctggccaacatggtgaaaccccgtctctactaaaattacaaaaattagttgggcgtggtggtgcgcgcctgtagtcccagctactcgggaggctgaggcaggagaatcgcttgaacccaggaggcggaggttgcagtgagccgagatcgagccactgcactctagcctcggcgacagagcaaaactccgcctcaaaaaaaaaagaaaaaagactgtccttgcttatatttagaggagttagtttggggcagggggtaagggggcagaaaacgggttcttgaaatagcaaataagagtacaaattatgcttccaagtgctaagaagacagataatgaattatcagagacctgtggtttcactgagggaagaccacctagaagaggtgaattttgagactcattttaaaaggtgatggatatggattggcagtcattccagcctactcattctcttcatgttttcctaggaaacctttgcccgagcaaagacatgggtgaaggaactacagcgacaggccagtcctagcatcgttattgccctggcagggaacaaagctgacctggccaacaaacgtatggtggagtatgaagtaaggtggcccgtggagttcctctctaacacttcctctgttcctgggacctctttttttccaaaccagccctctctgaaaacgtcaacagaggacattcattgtctcattccccagttctacaccaagttaaatacagcaacactgtgaccctaatgacagccaggagattttcaaaggagtcaggagaaaactccagagcagagggttagggaagtaccagctgtgggggtaccagtgtgaaaacaggaaggagggagcaattaaatttgtggtaagggactattcaagtgtcacaacccaaaagcccccaactaacttaccctctcccctataattaagctttctgacatttgtgtgttggactgagtggacatggggtcatcttgagggagttgtcattaaattatgcatctaggctagctggctcaaaggggtattaattaaggggagggaacctaggattttgcctagctgttgtgctgcatgggagtggaaaggcaatactcgttcccaccctacattctgagcactaatacatcccactccttgcaggaggcccaggcatatgcagatgacaacagcttattgttcatggagacttcagccaagacagctatgaacgtgaatgatctcttcctggcaataggtaaggtcagaacatcctgaggtcctcctttttccctcgtttataggcaaaattatagctaacccaaatcaaggataggtgcgagtatctccttttgcaaaaactttaggtatggaaataccttaactttctgttatgacctccatccttggctgcagctttagctcccttgtcttcaatgtgtaagtttgccggccaggtgtggtggctaacacctgtaatcccagcattttgggaggccgaggcgggcggatcacgaggtcaagagatcaagaccatcctggccaatgtggtgaaaccccgtctctactaaaaatacaaaaattagctgggcgtggtggcgcacacctgtagtcccagctacttgggaggctgagccaggataatcacttgaacccgggaggtggaggttgcagtgagccgagattgtgccactgcactccatcctggcaacagagcgagactccatctcaaaaaaaaaaaaaaagtttgcaaatagtgaaccctcccatcttcagaacattcttttaatctctcaaattctcccttttccccaattcagtagccgtttttggcgggtggaggcagaggggtagggaagtaaagtctaccatactttgttctcttctctttttatctctagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcattggagtgttgcttttttttattttattgttattattattattatttttgctatttgtcaggtactaggaatttggaagaaaggatacccagtaatgttctactgaatcagaaacacacctttccctgcatcttgatacatctttattccctttaatcttttcttaaacatctagtttagaaaatagcccttctattgctatttaatcacccctcttctaaggccactagattgttcatcaaatcaaaccctattatatctttttaggccctcttaacagaatgtatatgtgtagggtatggtctgtggatctttgggcccactgatcagattagagagaggggtgctatttgaagtagtatacaaaaatgtatgtgcatatttctttttttttttttaattgagacggagtctctgtcgctagcctggagtacagtggcacgatcttggctcac

SEQ ID NO: 12152 - DNA, 51723 bp, Human
  misc_feature (1)...(51723): n = A,T,C or G
aaaggtccaggctggaggtatttcaaaacaagggccaagatgaaaccacctggtgactacgagtagatacaggaagacagagggcagaagattgcatatttaattactatgaagggagttatgtgttgtgaaaggggaaatatcaggttagtggagggagaagctggtcaaggaaagtttcttgaaaacattaaacccaagctccttgaagccactgaaaaccaagcagtgacattgtattagtgaggatgctgtcccagagaagtaatttgtaattggtcatagagctagtggcctgactagaactgtgttttatacttgaactaaatcaaatgtgccacaggcacagtataaaacagaggagaatagctgggagcgatggctcacatataatcccagcactttgggactccgaagcaggaggattacttgagcccaggagttcaagaccagccctggcaacatagggagaacatatctgtacaaaaaaataaaatatcagctgggaagcagtggtgtgtgtctgtggtcccagctactcaagaggctgaggtggaaggatctcttgagctcaggaggttgacgctgcagtgagccgtgtttgtgctacagcgctccagcgtggatgacagtcagacgctttaaaaaaataagaataatctttaaaacaaaaaacaggggaatagtggcacaccctgggacacagactctggagtcattctgtctgaggtcacattgtggatttgccatttactactggctgggttattccaggtgcattactcaacatctctgtacttcagttttctatctgtaaacggactttctactaatagctaactgcttacagactgtttatcatgattttacatacaatattcaacttccccctccaataatcaatgagtgacattattattctcattctactgctgaggatccagaagcacattcacccattccacaaatatttaccgtgcacctgcaatgtgccaggcatgttcatgggtgaacacagcaaaatctttgcctctgtgcagcttcagtctggggttcacaggaaaaggagaaagatgataaacaagagatacgtacattacagggtaattataaagggatacccgctatacaagaaaacagagcaggataacagagataggaagttgggattttaagtaaggcagccagaacagacctcaccaagaaggcaatatctgagcaaggatgttaagggagccgggggcaacctagaatccaccagtggggagagtaaggcgactcggagaaaggcgaggggctaatgcatccgttctaataactctgactttaactcggggctagatggggaaacactggacagttctaccccgaggtgtgacagaacttgaccttcattttaaatcggtccatctgtttaggctagtgagaaaaaacaatatttgaactcgggcagtccagctcaggagtctgtgctgtcgggattaaagaatcagtcgacacccccagggctgagccccgcagcaagcgccccgcgggtgctggcccccagactgtggttaccgccatcctttcacttaaactccgccccgattactcccccgctccagggctccgcatccactctgccgggtctccacgtagcgcttcccgggctacacattgcgtaacttcggcagccgggcggagcctgcacagaggcggagccgcggcagccggagagaacgccccagcaatagtcgctaggaggaagccccaggagcccttgccgcccacggaacgcgcctgcgtaatccgggtccaggccgccgacattccaggaccgccttccgccccgcccccaattctggggcggagtcctcggccgcgccggcgcaaagcgtcgccgcaccccacgcctgcgcgcttcgcccgcccggccccatccccccaggtttttcgcgtgggggagggggcacgtctcggcgagtcacgatgatggcggccaccatcctgtggtgagctagcggattccctgcttgtctcgccgaccccctcgcgccttctgcagactccgtggctggcgctcggcgcgtgaggaagcacggcggcccgagttcgcggggaaggccgcagtcgcggaggcagcggcgcggtccggggcacgggctgggggagaggccgctccgctgggcgaatgtgacaagcccccacccccaccgccttcctccccagagcgcgaggagcgcgggcgaccccggggccccgccaggccacagaccccgcccagcggccagcacccggcgcaggcccggcagccgagctgcgcggcggcaccatgcaggtcaccctgaagaccctccagcagcagaccttcaagatagacattgaccccgaggagacggtatgcgcgcgggccgggggcaggggcagccgcgtgcgggccgcggggagcgccaggagctcgtggggccgggcggcgcgctccagcgggggaagccccggagggcgcgatgagggccctgggtcctggtgccggccctggcggcgtacagcggagccgatcctcctgtcttggccgtgggctttgtggcaggagaatggggaagcagtggccggacgccgaaggcctggtggcagatggcgtggagcgcacgcccgcgggcctgggcctaggagctcgtgctagcggggccggagggggatgggaaggtccaggccgtctcagccgtagagcctggctttctggtatgggtgcacaggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgagtggtggtgaaaatgaatttgcccctttcccctcagaattgtttacccttttatttgcaaatgaatcgttctgctgccttcctcccgccaccaaacccacacccttgcgtagattgcactttgaggcctctttggtgatggttttagctgttagagctcttcacagccatccaggctcaaactaaacttcagatttaacgggttttctgtgttagaaatcttggaattgtaggagttggaacgctgcagccaccctcccccgatgccccaaacagtagcagttcaagggggaaaaaagaaaaaaaaaacaaaaaacaacaactttgaatcctttctgcagttaaagccttaaacatttcagaagtccacattatacatttttctgtatttgtgactgcataaagagacactgttgaggtcagtacaactttatgccaagaatctaaaaacgctgtgagtgtaaatttactgcttatgttcggaaatacaccgccaagattgtcataatactaagtttaaaccagcagctttctgcccaactctatttttaaaagtagttgattctattttgggtggagatcaggggctttggtgttaagtagacctgagttccatttgtggttttgtaacttatttgctatgaccttgggcaaattacggttagtttcattctctgtataatagggataatacctgccttgcagagatgtgaagattagatggtatgtatttacttggtggtcagtaaatggaatcgattatttaaacaatggattcctttgagtggagatacagtgttacgttttacttatctcatttaatcttaagttttgtacatctttaattttttaagaaacagcctttttgggattttggtacaaaattatttgatttcagaatatttatatgtgggtgtatgctgtgtgattaacttcttaaaagtacaggagatctcagttatacatgagaaacttttcagtgtcctcagaagtaattgacaataccctgtggactgacagtactaatagaatctaatttctcttgaatatttctttactgcttaatgtgcattaataagttgaagggtgaaagttaaaatggagtttgtttgatgatttcagacaaactacgtaaaatgcctatttgactttggttctttgtggtaacaaatgttggtgccccagtaacttaatcggcttataatactcagttaatttcagaattattgaaagctaaagaaatattgtggctttttggtaaatatgtgtgggtgtattgaagttatgcagtgactctgtcaacagctccactgaagtatttatgttctgtaagatttgtttagcgttttaggcactttacgcatactgttaactgagagtcaatgctgtacctgtgtttgtgtgaattcttaactatttttgctgttttccagtttatttccaaggaaaagtaatatgttatacgtctggaagtatatttttgaaaagcccattgttagggagcggtttctacagctttcgctgctatttatataaatataattttgttgctgttagtataaaaaaactaatactgttagtccggggcaagaaattaaagcatttcctctgggatatatggaacgtttgcatttaatgacttgtcagtttttattttaatgactttaggaaatatttttcatgacaactgtttcaattctatgtttgtagtgggttttaattagtatgtgtttttgatacgacaccttagaattccagtaagaaaataaacaatgaaaattatgttttctagggcaacgctaagtgtcctgtttctaagttgttgtgagaacgaggtaaccaaggatattagaaatagatctaaaataagataggatcttattgagacctgtttttggtctggtcacagatttgtccttgtttaatttttacctagaaggaaccaaggaaattaagtaacttacgtagccagtatagcaactcttgtgagcttgagatgagcatgagcaaaaatggaagaaaggactgtgagataagtggaatcatgggaatgattcatttgttgaacaagtaaatgtttagtgagctttgctggcaggactggaggagtacagggacctgtagaacgtggtctggggcttctgggagccttattgacttagtcaaagctcattggctatagagtagggggatatacaaaatggaaagagcaagataatttgttttaaggtgtttttatttgccctagttttaacaaaactttcttagacttattaggcattttgtaccatttacttgactattactgtgatacattacatgaccactgcctttagtgttaatctttgcaaagatctttttgtttctacaattgtaatgcaagccttcttataaaatattcaaacaatatagaaacaaaatgagaaggtggtatgtgtggggtagggagaccattgctaggagattttcttcattatgtgctttttttgttttttactgtaaaaattgtgggagacttttaagtagcctacatattaaagcattttgagatgtgtgatagagcactgcttctctgaaattcttaaaaattctgaagtttaggctgggtgtggtggctcatgcctgtaatcccagcactttgggaggccgaggtgggcggatcacaaggtcaggagatcgagaccatcctggttaacacggtgaaaccccgtctctactaaaaaaaatacaaaaaattagacggacgtggtggcatgcacctgtagtcccagctacttgggaggctgaggcaggagaatcgcttgaacccaggaggcagaggttgcagtgagctgagatcactccattgcactccagcctgggcgacaaagcgagactccgtctcaaaaaaaaaaaaaaaaaattctgaagtttaatggtgtgatggacatttagagggaaatggaatacagtttttaagctcagttttatagtcaattagtgttttatattactgttgcttaaaaacattaagaaaggtagatttaggaataaaccttttgagataaaaaaaatacagtgcagtattttattgcatcactgaaatggtgacaagaaaaagtatgtgatatacaaattaatcctgcagtctaactcttgacactgtttgccttgaacaactaaaaacaaaactcagtaaatttgagatgagactttaaatgcaaaagctgaaatgtgattggattagtatataagtgacattaaaattctacatatacattggatgtttttgctaagagaattgcaaagacatcagttttaatatctataaatagcatattagtgtgctgtgaagaattacctaatttcgtggtttacctctataatgtgattgttataaaatactgctttacccagcaccttgggaagccgaggcgggtggatcacctgaggtcaggagttccagaccagcctgaccaacatggtgaaacctggtctctactaaaaatagaaaattagctgggcatggtggtgcatgcctgtaatcccagccacttaggaggctgaggcaggagagtcgcttgaacctgggaggaggaggttgcagtgagctgagatcgcaccattgcactccagcctgggtaacaagagcgaaactccatctcaaaaaaaaaaaaaaaacaaaaaaactgtgtgtgtatattgctttagtacttgctctgtattatacagtatttactagccatcatttattagtgaagtattcctgtggtggtttattgtattttcaatatagtcatgctagatacaatttcatattatacaagcttcctagattaaggtaatgagtagtaaatgtattaaaaatactatatcacagaggtgaaattaagagttcttggcatattggcagaacaagatacaggaagaaactgagaaatctggtacatttttgccagacttttgctgttttgatgccgtgcacacagtaggcatttagtaaagatctttgaatgaactgaatatattcttttggtgaactggcaaagcagtgatcccccaacgtagtgtgtttgcatgttgatttatttatttaataaatatttgctgtgtacttactagatgtcaggccctgctgtgatggtatgtgcattctagtgggataaaactgtcaaaaaatacattttaaaaaccaggtaatggtaagtgctatgcagaaagttgaaataggataaagtatttgataatacttcactgggtggctacatttttgttgttgttttgttttgtttttgagacgcagtcttactctgtagcccaagctggagtgcagtggcgccatcttggctcactgcagccttcgcctctggggctcaagcgattctcctgcctcagcctcccaagtagctgggactagaggtgtgccccaccacacctggttaatttttttgtatttttagtagagacagggtttcatcatgttgccctgggtggtcttgaactcctgagctcaggagatctgggtggctacttttaaatttactagtcactgaaggcctttctgaataaggtgacatttaagctgagagctgagtaaaaatgagcactcgagaatgaagagaatgttttctatagggaactgctagagcaaagacctttaagaatgtgttttgggtactgaaaaaaagcctgcattgctaaggtgatgggtaagagataagggtgagttgggtaagagataagagagtgagttaggcaagtgagttaggctaggggttttcagggtaaacttggaaacatttacaagcaggacagaaatctttgtttctttgtctctgtctctcttttcttctttttccccttcccttcctccctcccttcctccctcctttcctcccttcttccctccctccctcccttcccccttccctctcctttcctctccttccctcctttcctcccttccttccccactcctttcccttccttccttcccttcctttttcaacaaggtcttgctctgtcacccaggatagagtacagtggcatgatcatagctcactgcagccccaaactcctgggctcaagtgatcctccaccctaagcctccccagtagctgggactacgggggcatgccaccacgcccagctaattttagtttttttttgtagggatggggtcttgatgttttatccaggctggtctccaacttctagcctcaagtgatcctcctgcctcagcctcctaaagtgctgggatgacaggcatgagccagcacacctagccaagaaatatttcttgtaggatttttaaaggttactttgatgctgtggggtgggcaagagtgaaaagcagagacatcagttagggggcttgtgcagtagttttaagtaattgcagcttgaaccagggcagtaggagtggagatgtagagaagtagatggaattaggatatgttttgagaggtacagttggctgtaccacttgctgtgtcacctcaggcaagttactcagtatgtgccttttggtcctctgctgtaaaatgagaatactagtatgaaagtactaacttattggtatatgggttttgaaataatattaacagtgcttggcaatgtggtaccactctccctccattgttcttgcttagaaagcctcaaatgtgattaaattcaactcagtgtttgtacttgcacctgagtggccagagatgcaccttgtagccacattgacttgtcttgcttaaatttatgaacattaaggaacttaagttcatgagcactaaggaacattaaggcacactaaggaaccttaattgggtccttagtatgcagcacctgacagtcttacagtttactagtccagtcactcttccactgccacaggatgctttcatatcatctagcctgcttattttcacttgatgaccctagtctttatttgattgagaatttggaaataatcgagacagaatgtctacaaggtcctaccgtagctacctacctgctagcctcttcttactgtagatagttctgaattgtgggcggtgctatctaaggcaggtccttccacttttccactgtacctcatcccctgtcatgtgtgaaggacatcactccatcagatcttttctcttcatcactgatttttcccatttctagggtatacaaacatttttccccatcttaatgatacactcccttgtgtccacatccctctttagctgctgccctatttccctgcttctcaagaaaattcaggagtatctcttaattctgtttacttttttccacatcttgctcttttcacatccaccatactgttcctaaaagggagtcctcacaactttgtacttgtgctttgtccttaagcacaatacttttaaaaaagtctttctcctctttattaaaatgagagtaataataattgaactgctttcctaacagttgtgaaaatcaggtgagatcatgggcatggaaatatttagtgaattgtgaaattagaaataaattttgcagtttttaaacaaatcctgctttcatcagtttttatttcgatcatttcactattctttctttaaaaggtttgtatgaatgagatattctcattttcttagattgacataatcagcaattttgaacagtgtgtaaaatcaatgaacaaggtcctgccgcgatagatgccgtataggattccagttaatttctgaaagaaatttgctaaatttaaccctactgtggcacagtgaatcgtacgaaggacactacaccatctgttccctgtaagtttagataaataaatgttttttatagtgtcacgaaagctaattttacaactgaatgagctttataaaacttgtaaacattgtataaacttatttcgaggaggtagaccagctacaaatgactgacaatacatgaacagattctggaggcttaaacaggtagataaagttgttctcaccaattattccccacacacttctggttgaattaggtaggcaccttgtttttgctagtgcactggcgagatccattctttgcctatatagaaacttacaggtatcttgggaattctgcttactcagttttcaaattcctgtgtttcttttggtcttgttgaaatcatactgttaggaatatattttataatagattaaattggcatgaattggttggcttaatttctgtgggacaaatgggttttggatttcaaatcatatatttaaaataatagccttttggatcataaccccagtttgaggattgcctttgttatagtgcctgcctcttctcacataattaatgttatgctatcagttattgtttcaattgtaaaaatctcctgtactaaattattttattccttgggtccagtgaggagatttttcctatttgtactgaagtcagctgacatttttaaaatcaaatttgtatttgtagaaatatcaggaacctaccttgggacagaaattccccaggaaatactctggtgcctgtaccagtttctcaagtggaaggagaagaaccgaagaaccaaaaaagaaaaagcattacctgtagtgtaaacataagaaatcctttagtacacatttggctttgggaatctcctttattttgctaattgttgattgccaaaatttaattgctgctattattttttaattaggccgtgtagtattagaactgccttagacctttttcttttaaatgaaatctctttttctctttgaaagtccagttttccctaaattactcaagtaattcaggctcattatagtaaataaagtatagtaaaatgagaatggcttttgccatcggtctaaggaaccactgtagactctgtatatccctctagtcttttcaaaaaatatatttacacataatacatgaacacaactacactatttgtttaaaaaaattaattagcaactagctttttttcctcaaacatagttataaatattcatttatattgcataatgttcaaatgaatgtatgtacattaatttattttaccatttctcctttgtggatgtttagggtggttttcagtttttagtattgcaaaaagcaatgtagtgcacatactttgtacctttgtctttgaagtagttacatgagcacctctagcattgatttctagatgcgaaattatttggtcaaagtgtggcagattgcctttaaaaatgcctggtcaggctgagcgccgtggcttacgcctgtaatcccagcactttgggaggctgaggtgggcggatcacgaggtcaggagttcgagaccctcctggccaatgtgatgaaaccccgtctctactaaaaatacaaaaaattagctaggtgtggtggcgtgcacctgtagtcccagctacttgggaggctgaggcaggagaatcgcttgaactcgtgaggtggaggttgcagtgagccaagatcgtgccactacactccagcctggtgacagagcgagactctgtcaaaaaaaaaaaaaaaaaaagcctggtcagtacttacacacattaacaatacttgttatttacaaataccatctcccatatgagtagccaggattcaaatttagagactctgcctctagagcctgtatgtttaacctttttatttcatctgccttagtgtccccattagaaaaagaggataatagtatctacctgtgtactagttaacctattactgcataacaaattaccccaaaacttaattagaacagtaaacacttactatttcataatttctgtgagtcagaaattcagggatattttagctgtgtggttcttactcaagagtctcaggaagttggatttaaggacttcattctatgcattaaaggcttgactggctggagggttcccactgaaagtgacttcctcacatggctaacaacttggtgatggttattgactggaggcctcagatcctccccatatgtcctcatgacattgtggctggcttctcccagtgttagtgatccaagagagcaaaatagaaacgatggcttttatatataaaccagcctcagaagtcacacttttacttcagcagtatcttactgttcttgtggactagccataatttagtatgtgaagggtatgtaccaaaggcttgaataccaagagatgggagtcattgggggccatcttgggtgttggctactacaacctcatagagatgtagtacagattaaaagagttaattattgtgaggctcttagtacactgcctggcatatggcaagtacatagcctgcattagcttttattcagatgttatatttcagggctacccattaaaactttacacaattatttatactgtatatagttacaacagtaataaggaacaacatagttacaaaagtaagaagaaaaaataatactgtaacagtgagcacgctgttatatggaatatgcaattgctgacctaattaacaagcagtagcctagaaatcttatgcaaagtgctgtgtaagaagattgacatggcagctcattatactatcataggaatatgatttacaagatgttattttgatgtctcatgcatgacctaaatttgtcgaatgaaaaatgactgcttttttaaagagacagagtcttgctctgttgctcaggctggagtacgctgacaagattatagctcactccaaccttgaactcctgggctcagtcaatcctttcacgtcagcctcctgaggtaactgggactacaagcgggcaccacagcacccgtctaattaaaaaaatttttttggagatggtggctcactgtgttgaccaggctgacctcaaactattgggataacaggggaaatgactacttttaatggttgttggcctgaactagaatagtgccagtgccacagagatgcacggtagtgctcacattagggaataattagatggtaagtttagctttgtggcggcacttttaaatacactttatgattgtcttcctttggaggaaaaaagaaaaaccatgcccatcatgtttaatattatgttgagtacgtttttatttttaaatgcacgattttttaagagagaattaagtagctagaaaaaatgtttgatttcttgaatgttaaccatgtctttgtctctagtggaattgatgataaaccaccattatttatgtagtgggaaatgcagcacaatgaaagttctagccttggttatgtactgggactgtggtgctcaggtttatattcactctgttgagatggcttactggaatgggagcattggtgtggggctcagcgcagttaaaggagtcataattgcatctgttggtgggccatatcctttccaagagaaaccttgtgctgagttcatacctcttcctttgaagcatccagaaagaaggcagtctttcttgctaatctgttttgaagtatgctcaattaggttggattagggatgatttaaacaaagtaatttagacacagttcttctacagatacattatggtttaaatacctctaggacatcccgtgaaggtgttcagtagagagttaagtgtgcataaatgaaggtcagggagagagagctgggctagaaatacagatgacatctgcatggttattgaaactaggagtagacacgatggattatcctggaagtctaagtagcacttaaagggctggccagggaggaggatttcgtgaagcagtgaatggagagataggaaaaccaaaagtgtggcatcctggaagccaagagatggcagtatgtaaaggagggacaggtcagtactgtcacacgtgacaagaggaagataggagaggattaagaagtgtggtatcattatggtgttgcagaattcagtgatgttggtaaagagcagtgttaatggaatggccagcggtgggtggggggggactaccagagaaaataagcagcagaatgagaataaatttcatgtttttgtttatcagcacagtattgctctcttttgagtagttggtttgggattatgaataagtgaggacagtggtgtgtatttaagtttttgaagaattagattgtggggggagagagtctaggaggagacgtgattgttaagtgtttgtttttaaaatgatgaagtattaggtctaagtgtgaatgaaagtgaactgagtgagagagaggctgaaaaagctgggggagataggaaatataatgaatttagtaagatactgaaaaatacttggaggcgaaccagaggacaggtggaaataattaggtttgaaagaaagggatacttttttcatttaataggtgagaaggagatgtaggtgggtctggatgcaacaaagttagacaaagttgaaaataagttcctctgtcttctgtttttaataaggtagaaagtggtcacctgcggacagtacgagaggatgctgtgaatcagatttagagtagaatgcagatttgagatattcttttggaggatggagaagagggctaactagggggaacagaagatttagtgtatccttttctccactagcatttagaaaacggtataaatgtagataggcagtctcttaggtaaaagttgagatttgttagctaagcaaggttaggacaatgagacaccacagagtggttggagtaaattttagaggttgagtactgacaaataaatggtgttggtccaaatacagaattttgtgtgttaggagcagcagaaagacaaggaagtttttgatattagaaagaaggtgataggagcaatgatagtgaagattgaaatgaaagtagagactctagggaccaagtcttaaggagattcaagagcaagtatagtgaacagttaactaagagctggtaggaacaggagattggtcacttataattttaaacatggagtggtttttagatgacaaaattcagcctgtagggttctgtaagtatagattggattgtaagtaaagatcactgttttgttcaaggtaaggaacaatgccagaattttagacaggtcagtgcacctggttccaaagtctggttcagttattttctttgaagtgatactgttgggtcaaatccccgtgccttcccccaccaccttaaaaatgttgaagcatcttggcatgttgccctcaaaaattttgatcatttgatactttaattcttattctgagaatgtatttcttcactttcaatgccaagaattattcaaaacaatctttccagtgtgatagtctattggattaataacatgaggcatcaaaatttatgtctttggttactaatgaggttgagcttttctgtgctgtgactgtgtaattgtgaattgcctgcccaatcatttgtccaatttttttattagtgcaaaaacagttttgtgccttgtctctctctctttttttttttctttttcttgagacagtctcattctgtcacccaggctagagtgcagtggcatgatcttgactcactgcagcctcagcctcccgagtagctgggattacaggcgtgcgccaccatgcccagttaatttttgtatttttagtagagatggagttttgccatgttgaccaggctggccttgagctcctggcctcaaatgatccgcccacttcggccttccagggtgttgggattacaggcgtgagccatggcacccagctgccttttctctttttttaattgcttttttttttttttttgagatgcagtattgctctgtcgccaggctggagtgcagtggcacaatttcggctcactgcaacctccagctccctggttcatttggttcccctgcctcagcctcccgagtagctgggactacaagtgtgcaccaccatgcccggctaatttttttatttcagtagagacggggtttcaccatgttggccaggatgatcgtgatctcttaaccttgtgatctgcccgccttggcctcccaaagtgctgggattacaggcatgagccactgcgcctggcctcttaatttcttttttttttaatttttatttgtcctttttttctgtttgagttgcatgtttagcctgttaatttttcttctttattgaataaacatttttagtgtttagtctacaattacttctttagccaaatcatataggtatcttgtgtggagctcccattgttatgttcttaatattctgtgtttgttttgttttgtttttgagacagaatcttgctcttgtcatccaggctggagtgcaatggtatgatcttggctcactgcaacctctgcctcctgggattcaagcagttctcctgcctcagcctccgaagtagctgggattacaggtgccagccaccatgcccggctaatttttgtatttttagtagagatggggtttcaccatgttggccaggctggtctcgaatccaaccttaggtgatccgtctgccttggcctcccaaagtatgggattacaggcgtgaaccactgtgcccagccttaatattttttaatcaattttgatttctttgaagcaaaagttatttagtagtaaattactaaagggccttttttttttttttggtccagcttttcttaatttatggggcttttttttcctttggtcctccctcatttttgatataaagctagagagtcccgttacttatttaagcgttttgaaatatgaaatatttaagtctgtcttatacttcattgtaacctgtcaagaatgagatattcctgcatgtttattttcttttatttgttgcttcatatgtgtctttttttcttcacatatgtctatgctctgttcatttattcatccagcacaggataatggagcacccactccatgccaagccactatgtattgttctgagaactgggtttatgcatagagatacacttggtctgtaatttatttgtagttttcctaaataatcacacttgcaaatattgtatccttttgtccctctacaaacaaagtttgagaagaaatttaccatacaccactgagtgctccacccatgctctgccatcagttggttgacttggcaagtctcttagcatgtaggatagcagtcttcaaatgacttggtttcaagacttgtttacatttaaataagttattgagggctccaaaataacttttgtcgatatgcttacgttttattttatttatttattttttaaggcagattctcactctgtcacccaggctggagtgcagtggtatgatcttggcccactgcaacctccacttttcaaatgattcttgtacctcgtcctcccaagtagctgggattacaggcatttaccgccatgcttggctaattttttttttttttttttttttttttttgcatttttagtagagacagggttttaccatgttagccaggctgacctcgaactcctggcttcaggtgatcctcccactgcagcctcccaaagtgctgggattacaggcatcagccactgcgcctgacccaatgtacttacatttattaatgtttaccacattagaaattaaaacaaactttattaatgttcatttaaaaataaatataaacttattataataaatattatacttactttttttgcaaaaaataactatctgccaaaacaacagtaacaccaaagcactgaaaagactgacactgttttacttttttttttgcaaatctgatgtttggctttaaaaaaattttacttgtgttttacctttgaaatggggaacagtggaaaatagtggattgagatttttgtgatggatttctactttggggaacatcagaatagcagtgatgctactgacccatttcaggaagatcagtgcagcaaggaaggtttatatggtatttgcaaaatactctgcttggagtcataaggggtggtaacctctttatttccgtctcctcatctataaaattgagtgggtgacatttccttttgtcccagagttttgaggattgtgtgaaattgtatgttaacatctgaagctaaataagctttttttatctttgaagtacacaccatcactttttaattgtacaaaagaaacctttatttgtatccctttctgtctaaaactcaagagaactgtcaacttagataattttcaagaagtattgaatttttctccttggtttttgtgcctttaaagtaatgaaagtagttctataaaggcaaatgggaaagccatctctgccttttttactcctgtacctccctacttaacaagttaagaagttcattagactcatttttgtaaatactgtataatgagcctaattgtcacacaattttaggaaatgaagagactataaaggtcatggattccagctcctcttacagatgaatgaagctgatgctgagagaagctaagctgcttgtttaagagcattgaagttgtctggaggttttcagcctgggctgaactttggaaacacctgtaaaactttttaaaaatactgatgtcaaggtcccactctcagagattatgttttaattggtgtttgtaaagtccccctggtgattgtaatgaaacataacacttaaaatgaatcatttgccttttaacattcacaatttaacctttaacattgaagtattcttattgttgatgagactgttttatttcttagattttttaggtgatcaagctttactttcttgctccgtgggaaataaacccatgaacagtatataaaccaaaactttgatgttgaaaactttattttaaattatcagttcaactagtaaatttttaaaaatctgtgtgtatcagatggtgttaaagtttatggctatcataactagtaatatgagttaatgttgaatcttttttgatataaattggaaaaacataatatttgaggttttggaaacattaataattatgtatataatttttgtcttccattatttattcagattctggattgtcattttttatttagactttttccaaaacaaatctttatttttcctataggtgaaagcactgaaagagaagattgaatctgaaaaggggaaagatgcctttccagtagcaggtcaaaaattaatttatgcaggtatgaattaaatattaaaattaacatgccatgtcttgatattcttttagttttagaaatgttatcttatatattgtagtatattcaaattgtcagaaaaatgattgtacaaataaaagcagtgaaagagcagtcatttgaatctaatattaatattcaatcttctctttattcacatttgccctgtgtatttttccatcaaatggtattagttttgttttatcttttgtaagcatcgtgtaactggcttttgtttttttaatcaaacggagcttttttttttaaattgaattgaaaccatttatactgattgtgttattattagtatgcttggaatcattcctgtaaaattattttaaccaaaactaactgaagagtacagaaaaaacacatcacacagacacctacaggaagaaaaaaaattaatattcagattatgtaaagaattcttagaaatcagtaaggaaaggatgaccaataaagcaacaaaggataagagtaggaattatacatttgactagcctcactaataaccaggaaaatgtatattaaaaatacatttgatatccaaatttttagagaaaatgctttcattgtagatgttagtaaggtgggtgtttgatcacccatggattcttctctttttctgaatagtgtttcctaaagtgagacagcctggaggaaatgctaacctggtgattcagtcccattatttttataggtcagaattcagaagcctaaagaagcggacataaaattcaaatttccagtttcttgttttggcctgttttctcattcctatccatattcctttctgacttaatgttagcagcttttgattcaatagctttttaaaggtggaaaactaaattcatgtagcaagaaacactagagagtcctagctacctaatagtgaccttcagcacgaccacagttttgtgtacttcgtgcatttctaagttctgtagcatcttgccctttcttgtgtatcatgtcgttttctgaagtacttttagtatcttgctttgatagtgttagaacatttctgatttatcagatatcagtattttggggagcaggaaatttgtttctctccctttcttcatatcataaaagaatataggttattttccagaggacccctgtgcaatcggagtattgaattttctttatcttcatgatctcctccttttcagggcctctttcatatttccttgcccagtaagtcttttatataatcaatacatttgtaaaaattgattgtcattctatatacactatataagtttgacatcttttagtcaaatgcttatgctttttagttttatttgtttgagagagggtcttgctctgtcacccaagctggagtgcagtggtgtgattatactcgctgtatccttgaactcctgagctcaggtgatcctcctgcctcagcctcccaagtagctaggaccataggcatgtgccacaatgcctggctaattttgaatttttttttttcataaacagggtcttgctatgttggccatgctggtttcaaactcctggcctcaagctatatttcctcctcagcctaccaaagtgttgggattacaggtgtgagccaccatgccctgccacttaggagttgttttatttttatcttgattgattggtttttctttgggaaaagtattaactgatagaatttatgttggtgattcatattttaatatttctgaaatattcatatttcgagtagaaagttgttttaactgaagtgtaagagaaagattatgccttaaatgatttttttttctcttaatgtattaggcaaaatcctcaatgatgatactgctctcaaagaatataaaattgatgagaaaaactttgtggtggttatggtgaccaaagtaagtttcaacctcattctgtatatctttatgcatgtaggtctttttaaaaatgatgatcacaagtccacacaatggacacagtttatacacatccatagtggtgtacacttaactactatgaaaggtttttaagaatttaccttaagtgaaacataaagttattaatgttttacattaattacacattaaactataatatagttttaataaaattttatgtaaattaaaacaattgaaaaataaaatgtcatgttaaaattatttttgctacagtagtgaaatcattatataattcttttaaaatgtctttataagtggaataaatgtttattctgtagtttttgtaagcttgccttaaatagacctgctaaattacgtactagtcctaacagattcctcaagacagaaaaggcatgaaagcttattattacagtgatagttcttagtgaaagaatatgtttttagaaactaaaaaaagggaaaagataactaaagaaatgatggaatgatttttatgaggaagttttttttgtttttgttttgtttttttttttttgagacggagtctcgctctgttgcccaggctggagcgcagtgacgctgtcttggctcactacaagctctgtctcccgggttcatgccattctcctgcctcagcctccctagtagctgggactacaggcgcatgccaccacgcccggctaatttttttgtatttttagtagagacagggtttcaccgtgttagccaggatggtctcgatttcctgacctcgtgatccgcccgcctcggcctcccaaagtgctgggattacaggcgtgagccaccgcgcccagcctggaagttttaaacagatacttttttgtgatttagtaggctggaatgtatttggaacaatttataaaattaaattttttttaaagcagagaatgaacatggatttttttaagagactatttatatacttgtttatttaaagatatataatgcagtgtagaattaagagacaaatggagaagtggtactcatgacattcatttttaggattggattgtcataatctgagaaagaacagtgttacttgtagcactgaaaatgagtttaaatcactaattgaaaccacttcatcaaaggccaaaagtggattaaatgtgggttttttctcaaagtcacaaaatagttaatagtaatagaaaatagagtcgaagaaataaattctaattaccacatgcttttgtactgggagcaagcagctaaatagtttacaagtgttgaacattttttaattcattaagaaccatgttgattttgctatacttaagaacttaagtcattatatgttaagtttaaaaacaagcagaatcgtgaggaaaccttgtatcatctaggtttttttattcaactgtggtaaaatataacaaacttccagtttaatcattttaagtgtacagttcaataacattatagttacattgttttgcagctatcaccatcatataagtggaatcctatggtatttgtctttttgtgactggcttatttcacttagcataatgtcatcgaggttcatctgtctatgttatagcttgtgccagaatttgctgaacttttaagactgaatactatcctattttcctatctagttttagcatacatagtacataatgggaaatgtgatagccacacatttaaatatgttttgttactggtcttagtttcttttaatattacagtgatcctgactgtttagaacacaagaattaagcagaaaaagtctcaataggtgcgtgtgtttgaggaatagatacttgaagcctatcattatattgcatacagtccttttgtttttccttaaagtcttttattcctaatattacataggattctaatgatatttatgattgttttatttgaagttaatagaggacaactatgaaaagggagggaatgctgctacagtaaggcattatggaagcactgagaaatgaccttattaatacaaagaagggaaaggaaaaagctattaagatcaaaagcaagaataaaaactaaaaagcagagaagggcttggtactgtttagaataaagtataagtagctgttcttggcagtaggaaccttgaagggaagttacattgcaatattattttgataacaattaaggaaaatattaaatgagtataccacttttaaaaatacatttttatctagattggttattataaagttttggtgcttaagactctaaattttcacctttgtgaagctccagtttatccagaataactgaagatccagaatgatctcaggatttcagctcattttagttttagaacagtaataataatctgcagaatattatattggctgttaagaaagttaagctaaataggaaaagaagggagtaatgctactagtattttttaaaaacctatcacctttcactaacctttttcctagtgtcttctttattagttcaaatcaaaaagacaaggcagctcattggttttagagtttgtttatgcctgtggcaaattatgttgaatttaagccttgtcttccactaaaacagctaccttttgtccttgggaaagttatgaactaaacaggtagcgagcattgagaggccttaggagaagactaaaaatcatgtatgatttttacacatgtacagttgacccttgaacaccactgagcttaggagtgctggcctctcccctacagtcagaaatctgcatataccttttgacttgcccaaaacttacctactaatagcctactcttgaccagaagccttactgataacgtaaacagtggattaatacatgttttatatgttacatgtatgatatactgtattaaagtaagctagagaaactattaagaaaatcatggccaggtgtggtggctgatgcctgtaatcccatcgccttgggaggccaaggtgggcggatcgcttgagctcaggtgttggagacctgtctgggtaacatggcgaaaccttgtctctacaaaaaaaaaaaatacaaaaatttagcagggagtggtagtgtgagcccgtagtcccagctacctggtgttgggggcgggggcagtggctgaggcaggagccttgggaggttgaggctgcagtgagctgtgatcataccactgcactccagtctgggcgatagagtgagaacctctctcaaaaagaaacaaaagaaaatcacgagagagaatatttttagtgttcattaagtgtaagtggatcatcataaaggtcttcatccttgtcttcacgctgaataggctgagaaagagaaagggttggtattgcggtctcaaggtggcagagatggaggaggtagaaggagaggcaggcacactcagtgtaacttatattgaaaaaaattatcatgtaagtggacccagtgcagttcaaacccttgttgttcaagggtcaactaattgtttttttgctctgtgggaagctttatggctctatttccagttcagaaagtgctgagcgtgtggaggtaacttaatttggcctttatttttctgcttaattacatatatgtctgaaagtattgtgaacctttttgtacttggatctgttgatttgtagtcaattttgggattttcctccctcttctaaaaatacagtacaacagaatatttgacatgtttataaataaacatttatactgccatttcaagaacattattttgggctggatgtagtagtttatgcctgtaatcctagcgctttgggagcccgtggtgggaggattgcttcaggcccggagttcaagaccagcctgggcaaggtagcaagaccctgtctttaaaattaaagaaaattattttattaatgcttttaagtggtattaggtaccttaaagttacaacttaggtacataaagtttttttgggaaaatgatacggtttatatctatatatatatatatatatatctatatatctatatatatttcaaattttttattttatattaacttgatatgaagatggaaattgttgggtaaaattaattgtggttgatagttaagattaacatacgctgtcatgagctttgaaagagtaaccatgagtcagattgttaatattgatcatttattgtgtcattttacaaaattattttcaagttataggttgttattagtgctatgtttgtggcatcctgtaacggtacagtctaattagagatcaggcagtatgtagtattttattgtaattattttgtcttttaatgtgtttagcccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacaggtaggaactggattctaggacattctatctcaaaatccgtgtttaacaggaacttcatgcatttattttgattattgttttgatcaaaccgactatatctattacgttaagctttttttaaatgtttgactaaaacatatgctgcgtctgttttgatagcttactaaggagaatataagtacaaattttcataatcagatttctgtactctgttgatttgggcagggtggggggcagtggaaaggagaaagcaggtgaaagtcatttttttttttttgagtagaaacgttaggaaatacaaataaccaaaatgaataaggattacatcatgacattgccaccctgatcatcatttgtacttgatctgtattctttgtggtcattgtcatatatatcataagcatccttccatgttagtaaatctttcccgtagttatatagcattgtgtttggttctgacatttgttagctcttgtaacctgaacctatggactatttcagtttttcactgttgtatctgtatctttgtgaacttgtgagaaattcaggcttctgcctgtgtggatctttaggggaaaaaaaaggaaaagagtgttgagatatttgaggagcaagaaataatttcttgtgggaagttgacagcagagacacctcaactaagtggctgcttaggcagttaggattattgagcagtttaagacaagacttttgtttttctccccagacgatcaggtaaaatgaccaaagcaaatgcttaagtcagagttctcttggttggaaatcatacagcacaattccttgatctaagagcatgagttatattatgaccagccttcactggcactacagctgtttgtattttgtgacttagtgcaactcaggacctcagaggcagtagttatatgatctttggagtcagaatcagacacagtggaaaactatgcagtgactggaagggtttacagacatggaaaggggttaagatatatatgacaatgatcagaaagatatagttgtgatccttcattttagtgttctgcctttgagtgtggtttctgtgtctgacttagtcaaccatgtttggaggagtctgagccacctggttcattgcttacttgggggtctctttctaaataattgattccctaagaagacaacatgggtttaggcaatagaatatttgccctgttacttgcctagaacactgctttaagcattctatgacaccattgcctaacttgatccatctttcccatgtacaactagaaatgcattcaaccatcttatcctagtggataccacctagagtcaggttaagctgttacatcaaagggctgttgatcaggtctgtatatgagagggaacttacgcatttaaaaaattggtttactaaagcacttaaatattacaaacttaatatgtcttaagtcagcacaatacatcttattctcttaattgctttaagctcctttttaaaaaaaaaaagcttacagtgtgagaattttagagttgatcaatacattttaatgtgctaatgccatcaatttaaatttctttcttcattaactccattttttttttttttggagacagagtcttgctctgccacccaggcaggagtgcagtggcgtgacctcggctcactacaacctccacctcccgggttcaagcgattctcctgtctcagcctcctgagtagctgggattacaggcgcatggcaccatgcccagcttatttttgtatttttagtagagaaggggtttcaccatgttagccaggctggtctcgaactcctgacctcaggtgatctgcccacctcagcctcccaaagtgctgggattataggcatgagccaccatgcccagcccattaactctagttttattttcttcctggagttgcagttttacttacctattctaaaaagagccagggttatcttttcagaccttttcagacctacagaagttgcataagtaacttgatggtcagtgatccaggaaagcagacactagagtttgttacttagttggactttgtacaccaactgcttactcttatttctcaaaattttacctcagaaatacaacacaggaagagaggaatgagggaaactcagaaaacaagctgcttaaatgtgtcttagttcctttgtctttgctggaaaatatctagtgtcttgtgaagcacaaaacctagtgaataattatcaggagataagctgataagactttgtggagtgactttgtgagaagtctgtttaggaccactgacctgacgttttgttattagggatttgtttctttaggtcaattttgttcttttaaaaattgtctgttacagtgcaaattccacttgatatctacctgagagaaactgcacttgtgcacatgactgtattgtttgtagtaaaggacaaattggaatcctaaattgacctgtggtttattcgtagtagagaacaggactactcaaagtgtggtagtcaataggctgcatcagcatcactgggagtgtgtttgacatgaattcttgggccaccctggacctgtaaatcagaattatctgggagtggatcccagaaatcaacaagccctcctggtgaatacttgggattctcggactttgtaaaatttgagaaaccctgatagctgatactacaagacagttaaagtatgtaatgtataagcatgttaaatgagtgtggttttgaggctttgttattgagtgaaaaaagcaggttgcagaagagtataggcaataaccataaaccagacaaaacccataaacaacattgttcattttctgtgggtatgcatgttaatgtgtagaagaaaagaaggcaagcgttgacatataactaatgagtggtttcctctgtggttggagaggggagaagtagtgagacagaatcaagattaaagaataatggttaaagtctatgtacatccagtcttatctgtggtgtttaaagagaactttttaaaaacaatgtgtgggccgggcgtggtggctcacgcctgtaatcccagcactttgggaggcagaggcaggcggatcacaaggtcaggagattgagaccatcctggctaacacagtgaaaccccgtctctactaaaaatacaaaaaattagctgggcgtggtggcgggcgcctgtagtcccaggtactcaggaggctgaggcaggagaatggcgtgaacccgggaggtggagcttgcagtgagccgagattgcgccgctgcactccagcctgggcgacagagtgagactccatctcaaaaaaaaaaaaaaaaaaaaccaatgtgtgataatagtgtaaattattctaagggagatgtgtcttaccggattttaaaatgtattatacagtaatgattaaaacagtttggaatggctcatattagaaagattggtcagcgaaatcaacaatagctttgaaatagacccagatagatacaggaacttaatataaaggtacagtttcagaacaatgtggggaaaatgctattgagatctcaccatctagaatgaaaaaagaatgacccctcatactgtacacctgcaaaaataaattatagatggatacggatttaatgtaaaagcaaagccataagctaatggagaacaaggaaacaaaagaatagtcttcactgtgagaagtcattcttaagcaagacaaccaaaaaaaaaattataacaggaaagattgatgaatttgactatagaaagaatttaaatgcaggaaaccaaactacacattgcttaataagagcttgatttggtcttttaaatggaatactgtgcacatttgggaagaaattgaagtagatttgattgtgccgacatagaatgattgttaagttaaaaaaacaccaaagcaagacacaagttgttattcttttaaatagaaattggtgtcatagtggttgtctctgggttaggggtaggaaaaatttagtttttatgtattgtgcgttttgaaattttattttctctgcattagttttacagtatatttaatgaagaacttaaattataccaagggattatattaatcataatattcttattgggtgttacgatgccagacactttgctaagcactgtactagtgtagccctacccacaacactttggagtatatgatacggtcgttgacattgtactgatgaagaaacaggcttagaaaggttaagtaatttatgaatccaaacttgagttttctgctcttattatgtactaccaagggctttctcagaactgaaatataatgtgtgtgttgtttttaattgagatacaggtctaagtgtgtatgtgtgtctgctttaatttaaacttctaactactacctttaccactgttgtaaacttaagtttatatttctttggcttgctcttggtctttcataattttctgtcttttattgcagacttctctgtagtttcccaacagaaacttaatctctttaaactgattttcattacattcaaacttggatttaacccatatctaccttttttgcatatgctatatttctttatttgaatatcttctttcagtgtcctcattcagaacttacctataagacttcattatgtaaagactttatagcctaatttggtttctccatgtgctattttgtatactgcttttgatatttcttctggtgtgacttgatttataaattatttaacttctcatgtaaattatttcaggtaaataattgtgcattatcttttttgtattcaatagatagctgttaggatattattttatatattttgatatttaaagtgatggagtctcagaatagaaggagtaccaagattgaaaatttttcccaaaccacaaatgttgtagataaagcttttggatttaatctagaagagacagtttaaatactgtagtcagacttttatatttaattaaaatcaaagaatctgtttaccaattggatagttactaaactaatgtaaattaaattttatatactttttaaaatgtgatttttctaaaatccttttgtagtacatcgggtgattcttctcggtcaaacctttttgaagatgcaacgagtgcacttggtaagtatctgcttttccttataaataacctataaagagataggaaagaggtttcacttttctagatcatgataaaagtgttaataatttgcatggttgtttataatcaagctgtaagatgattgatttaggtaattattcaattaatagtgttactaaagacttttaatgtttatgtattgagttctttaaaacttgctctgagttgagcctacttggttaaagcaaataaatttccattttccggatgtgaattttaaatgtgatcctaacatggttgatctgtgtatggatttattacaaagggtctttgaaatgggtatgaaatttttctaagatctgcctcacacttcatgtgtattcaccattagacttaattcaacttgatggcactatacattcccatctacatcttgttgcttgcattggcttgcagcaaaaatgcctttttatcccaacttttaattttacctactgaataatgcctttccatctcccatcaccccaatctgtcaaaatgaagcagcattttttttctcccattgtagcatctctgatacagttcctgctaattactggtttattggctggcaactccattcctagtttgttacttttaaatggcagggagggagaaagcgaggaataggtagaaacagcagctttggtgcagtacaggcttctggattcctgcttagcttctacagcagcagggttccagcagcagtaccacctcctagcatctgagttggttctctgagctagttggactggaactccgtgatgcccttgttgctgtggaaaatggcatgtacatttagtggcaaaacggcagtttaaattatctaagatcgcctgggtgtgacaaccccagattttcatctttgaggagcagtgtcctaaaaccactctgctatcaaatacagtgtgagttagtctctagccaggaaaacagaaaccactctatttcaaagagggaaaggcttaatcttaggaaattgttaggaattggaagggctggaaaataggattacccagagaggcagtaaactgtctgtggcctcggctccagctggagccagctagcacttgcccctgatggtgttgaaggctctggctgtggtcactgctgctgcagctggaatgcattgatgctcctgagttcccgggagcctgggaggccatgctgtagctgctgctactcaagcctctttgacgatgtcttcccattctcagctttatggtctcgggatccctctacattttcatctttaatttacccaagtctctatgttgattccctgcttttttattttattttatttttctgatttatcttgttgctgtacaaattaaccttgcttctttaaactttccttctttggctgctgtgacaccactcttttcctgatccatacctcaggctcttccttctcaagctttctagttaattcttttcttttttcctttattttcttttctcttttctttcttcctttccttttcctttcgtagtctcactctgtcgcccaggctggagtgcagtggcatgatctcagctcactgcaacctccacctcccaggtttaagcgattctcccgcctcagcctcctgagtagctgggattacaggcacgtgccaccacgcccgactaattttgtgtatttttagtagagatggggtttcaccctgctagccaggatggtctcaatctcctgaccttgtgatctgcccgcctcggcctccaaagtgctggggttacaggcgtgaaccacagtgcccggccagttaattcgttttattttacctgactattaaatgtatgagttttctatggttccattctaggtcatagttcaaagtttaaattatgggaatgaccaataccatccatatactatatagattccccaaattacagctgcagtacagatctccctctgaactcccaaactcgtatcttcacattgtcaactagaaaactttagaacctccatgacttcaggtttcaaactgactcattttttattccccagtctgattcttttcttgttcacttcttacttgtaccatcattcattcatccaccctctgcctcttttggcccagtgagtctgtttcttttcttttcctttctcctctctcctctgtcctctctcctttctcctttcctttctccttccttcctccttccttcctttctccttccttcctccttccctttcttcccctcattccacagttactaatgactctgtttcttaaagtctctggaatatttgttttcactgtcatttagttgccttagttcaggtccttatttcacttgtactcttgcattatccttatccacctggtctgcctcttccttaccagagtggaaagcaactctcatggggtctttgttaattcttttaatagttcctcatgacctggaagataagtccaaagcttattctttttaatttttaaaatttgtatatagggagtacaagtgcagatttcttacatgcatatattatgtggtggtgaagtttgggcttttagtgtagccatcacctgaataatgaacattgtaccaaacaggaagtttttgaacccacactccactccccaccttttttgtagtttccagtgtctgttattccactctatatgatgtgtgcctattgttcagctcccacttgtgaggacatggggtatttgactgttactgagttatttcatttaggatagtggcctctgtagttctatccatgttgctgtaaaaaagacatggttttattctttttgatgggtgagtattattacacacacacaccacattttctttatctcatcctccattgatgattccatatctttactattgtgaataatgttgtgattaacatacaagtgcaggtatctttttgatataatgatttatttccctttgggtatatatacatagtagtgggatttctggattaaatgatagttctgtttttaagttctttcagaaatttccgtactgttttccataaaggatgtactaatggacatttccgccagcagtgtataagcattctattttctccacatccttgcccaacatctggtataagatggggcatctcattgtggttttaatttgcatttctctgatgattggtgatgttgagcattttttcatgtttgttggccacttgtctgtcttcttttgaagaatgttttttgccagtcatgttttttgcccactttttaatggggttatttgtttttttcttgatgttttaaagttctggataatagcactttgttagattgcctaagccagtgtccagaagagtttttctaggttttcttctaggtttttttgtagtttcaggtcttaatatttaggctttaatctgttttgagttgacttttgtgtttgatgagaagtctgggtctagtttcgttcttctaaatatggctatccaatttcccagcaccatttgttgaatagggtgtcctttccccggtgtatgtttttgttgactttgttgaagatcattttggttgtaggtatgcagctttatttctgggttctctattctgttccattgattgatgtgtctgtttttataccagtaccatgctgttttggttacaatagcctggtagtattatttgaagtcaggcaatattgatcaaagcttattctgaatgacatatataaggttcttcatcaccacctcttttgcctcattactctgtttcttggccagtctctctcgtttttgttttttttgttttgttttgttttgtttttgagactctctctctttgtcacccaggctggagtgcagtggcacagtctcagctcactgcaacctccgcctcttaggttcaagaaattctcctgcctcagccttccaagtagctgggattacaggcgcctgccaccatgcccagataatttttgtatttttagtagatacggggtttcaccatgttggccaggctggtctcgaactcctgatcttaggtgatccgcctgcctcggcctcccagagtgctgggattacaggtgcgagccactgtgctggcctctctagttctttttacaagtcatttgcctttggacttttaagatctaaaaagtatcacattgcttatgggtatttttttgagattgtataatttaactaggaaacatgattttaggagtcatagtgtaatgattaggtgtggagactcttgactgtcagcctgtgtttgtatctctgcaccatgacttaatacttttacgaattttttttttttttggagacagtcttgctctgtcgccagactggagtgcagtggcgtgatcttggctcactgcaatctccgcctccggggttcaagcaattctcctgcctcagcctcctgagtaggtgggactacaggcacgtgccaccatgcccagctaattttttttgtatttttagtagaggcggggtttcaccatgttggccaggatggtctcgatctcctgatctcgtgatctgcccgcctcggcctcccaagtgctgggattacaggcgtgagccaccacacctagtctttaccaaattattaatctctccaagctgtaccctcctcatcttttaaaggagttgaaattaaacctttcttatgaagtagtgagagagaactaaatgagaaacaccatgttaaaatagtgcagttctgattttttgtagctcgtaatttcgtttgtattgatactgatttctgtatctgggaattaggttactgaacatgtattgctacttgagttgctttgtgctcgaattatatcagtagataagaaaataaataattaaaatttattgttttatgggatgggaaaaggaaagtcattattttaagcaagatatcaaatgcttaatctgtttgtgatatttgggggtttttagctattaaacacctttatttttgaaaattctgcagaaaaaaattattcaacagatactcggtttcagctgtgtatcagggaaacatgcagaatgacatggtttcctgcacagtcaaacttgcattcagttggggcaagaaaaaaataatgaaacattaaaaaaaaaaaaagataagtgatattaacacaaagggcttccctaaagaaaaaacagaaggctacctaggatgactaggcaatgccttttaaatatggaactgaagcatgttgaaggaactggccatctaagatggctggtgttgtgtaaaggccctggggcaggaaaaggtgtggcctgctgaagtaacaccgggaagatgagtgtggtgggtggaggattgttgagggctgggagccagaaataaaatgaggggttttgcgcacacgcgtgcgtgtgtgtgtgtgtgtgtgtttacttgacttttgcaactggctgaagaacagattatagatatggagacaagagttggaaacagggtgtaatcccatctagagactgttgtgggcttgtcttcagtgatgacagtagagaatgaagagatgggtttggggtgtaatttagagataggacctaccaggtatgctggtaagtgaggtgtggaaggaagaggaaaaggaactgaaatcaccagggtttttgtccaagtgcttaggtaaatagaggtgccatttgtttaaagagagcagacagacaatggtgggacacatttgagagggaaatctgaattgcaattagttgaggaatgagtggaatgtgagaaagtggacacatgttcaatagctatggctgtgatgagaagacagcagatggttcctcaaagaggaattaggatgaagtcaaaggtgggaggtgtgtttttgttttagagtgaaatataggacatagttaactactgacccaggataattacacagaggggtaaagatgttggtggagaagagggaggataaccaaatccagtttggtttgagtgtgaggcaacaataaaggtaatggtccccagaacacaagcagaagaaaggatagttttaagtgaggtaagtttatgaggaaaataggtttcatttattcagagtgttgtctgtattgagaggagggagcataggagtctgtaagaagtgacttggaatattagcgctttgggcattttaccaactttgtatagtgtacaagattttaactttctagctcctaacctctctttcccccgtttcagttatataaggtatcaaagggaaactgtgaacttgttccatcggagttgatggtttgaaataccatcccttccccagcatgttttcagaatttggtgtctcttcttaccagttgccttccctgacctcctgctaattctcccttaccttcatacctcatttttctattgtactctgaaacatattatatgagtttcctgttgctactgtagtaagttaccacaaacttattggtgtagaacaacacagattaactgtcttctagtactgtaggttagaagtgtgacacagggctcactgtactaaaatcagggagccggcattcctttttggagactccggggaagaatttttttcctgatcctgtcctaccataccttggctggtagcccctttctgcatcttcaaaggcaacagcataacatctctcatcctggttttgtctcctcctcctcacacctgtttctctgaccctctcatctgcctcctcctactactattaaggattcatgtcattacactggacccacctggataatccagaatgaggtctctgtcttaaagtcagctgattagcaaccttaattttatctataaccgcaatttccctttgccttgtaacctatttataggttccagggatcaaaccagagggcatctttgggggaccattacctactacatatatgttgtaatttatactgttactcatctttgtattcccagcatagtagttcctgaaatgttgtatacatgaatcagtaaatgtatagagaatgcttatttattaaatgttcctttttttcccctccaccctccctttttagtgacgggtcagtcttacgagaatatggtaactgagatcatgtcaatgggctatgaacgagagcaagtaattgcagccctgagagccagtttcaacaaccctgacagagcagtggagtatcttttaatggtgagaaatatgttttactttactccattctgttgtttaagattaaaatctcaaagaaacagattttaaaggaccagttcacttgtcactgatatatgctagatgatatacataatgcttttttttttctagtatgtttgtattttgtgttaataaaatgtaaccttttttaatctaatggtccaacattgtagtagctttttaggtgccactatgcgtgaattattcagaacaaaaatttcttttttctttttttttttttttttttgagacggagtctcgctctgtcgcccagactggagtgcagtggcatgatctctgctcaccacaagctccacctcccaggttcacgcctttctcctgcctcagcctcctaagtagctgggaccacaggcgcctgccaccatgctcggctaatttttttgtatttttagtaagatgggatttcaccatgttagccaggatggtcttgatctcctgacctcgtgatccgcccgcctcagcctcccaaagtgctgggattacaggtgtgagccaccgtgcctggccaaaatttcaagcttgagaatccgggccaaattcttttgcttatactgtgtatatttctgtaataagttgccagctttttaaaaactgggaaatttcacataaaagtacagatttctggtttaactggacaactttgatcccagatttttgcaagggattaaggaaaatattttagatcgtggaatctaattcattatcctctgattcactctgttaccaacgtaacatcatgcatttaatgaatgatgttactacctggttccgttggcatttgaatttgtttttatagtcagtaggagttgagggactttttgaataaagtattcttttttttactggtaatgggagtttttgagaaataggttgttgtggacatcaactgaaacccttggtattaagatgaaagtctgctagttttacagatgtgacacaggctaaagtaattgaattaacttttttaaaatctcagacttctataattgtctggtgttttggagtattatcaaagtctgaattgccctaaatatcatcttaaagttgcctgattctaacccttttgggaattacatccacagtttaacccattcctttgtgtctaggttgtacttctgttaaaaactcctttcaggtagctagctagtttcagaagagtcagttataagcctcataactgtactctgcctccaccatttatttgcctatgcctttgcatgtgaagttcacaaaacctttttcttagcatattattttatctttttaaattcactttttcattatcttcttgagtagtgtctttaaatgctggcagtttatccagtttgtttggaattgtggaattaataattgttgtgaatttgtttggtgaggagtgtgtaccctaaacagattgtataaaagtattagcttttatggagtggctttcatttacacctgatttagaattctgtataagttcaacagtatcagttattttgatctaatagatgtggagttttgaggtataaaaatacagaatcattgttaccaaatgctaaaactgctgtagagcatcaaatgcaaataaatagatgatacatgagttcatcaaaaacaatttataactaaaatgttttttatatatttgctctttgtttcatagactgaaggggaaaagttgcttttaactgttactagttaagagataggttaaggtgaacggatggaaagaagaaatgttgagcatttatataagaggctatgtaatgtgtgagaatagaggtcgatctatagcaataaagatgaactttttagtttaataaaagagaatttgatggacgccctggatcctaaatttgtatgtagtttgttagcacttaaataactgcccatctgagttaagggtttgcgttggttaactcattcaaaaacattggttttaatgcctggagtgacatctaatccatgcagccattttcctgctgtgttactcttcatcctttatatgttgttgcttttggcttctggtttattagggaatggaagcatttatcatcttattcaattgtaatacttggttctttattctcttcaaaatctataagaacttgataaagactttttaaaaattttaaatgacaagtctatcaatcatgtgcatcaaaataggtgtcccaaaagagtttagtgcatgcagttttaagctcttaataactttaaaagataagtactataaacttacaaaaggcatcacctaaaaactaaatggtttcaatttcttttatatcgattttatgaattttgaaaaattaaattttttgagatactttatctcattttttgagatactttaagtatctcatttatgagatactttgacactttaagaaacacttcactgaaaagtacctcaaatttatgagatactttctgagtgacactttctcagtaccatggatcagtaggggagatcctcctgcctggccactgtgtacctggtctgtatccattagatattttttcccccaggagtcatttcagaactgtcaagtgtgcatcaaaacctctttttggattatcttaagctagagttgcaaactcaatcctttttatcactgagtaacagctgataaagatttctaagaagttaaaaagtcaactgaactaataggtagcacaaaaacctttggttgtgttcagttttaagaaggtacatgtatcaatatttttcaaatttgatgctaattacgtgtgcctggtaggtgtcttattgaacaacacagagaatatttccatcatcatggtaagttctgttggacagtgctgctttgcattattatagcaatgtgggtttttctataatgcacccaggtcatttctaatctaatttgaatccatgcagcttaataatcctttacttttaattgaagcagacatctgtttgatgcttttgaaaatcaaacaagatgttaaatagactataaatcttttactctgtataatatttaattttgcatgatgggatatcttaaagcttggaaattctattacagggaatccctggagatagagaaagtcaggctgtggttgacccccctcaagcagctagtactggggctcctcagtcttcagcagtggctgcagctgcagcaactacgacagcaacaactacaacaacaagttctggaggtaaagcggaatcttctggatggggagggaatggccctgaatttttagtgtaaaataatttaacctgaaatacttcagaaatgacgttcattcccagagcagtcgaataattcgttaagttctctcttcactaatgtttgagaaaggcccaaaagaaactttcccaagtggatgtaaaaggtatccttgctgatattaaacatcagtgttgcagttttgccgaagggcatattctgttttatttgttttaaggaaaagatgctttccagtttgtatttagtgttactttctgatgccattcagagtggtttgctcactttgtctcttactctctccataaatgttacaaagtgtatgtaatttcaaagccagcaggattttagtaattatacagccaaggaaatgaaaccgtgagaggtttaaaaccttgtatctagaggagaaagcaaagcttgaattgaagtctctttactggggtgctgaccataccccacacattgctataggtctgactacagagcaaagcctggaacctgcggtcagcttaggaattacgcagtgttctccttcgttcgttcttctgtatattaataaagtaatttaaactgttgatcttgaaaaggccattcttccatgcatttcctagctctgataatgatagtcacctctggttgacaaaggtcactcagtgctttgtgtacagtctcccaaggacaggccctttgtttgttgtgattcagcatatgggagtggaaagagatgaccacagctctgctttggatttggggtcctgttcctttcagcacttattaggtgacatagtctctaagtctcgttgccttcacctgtaaagctggtattatatatggaagaacaaaaaacccatgtgctgtggtcatttcaattggaatgattgtcttcctgaataggaaattacaacatacatctaaaaattctcttttattcattagtaacctcaaaaacaattcctgtatgtacgatttttggtttcctatagcataaccagacaagtaccagcaccctgaaaaagccagaagttctgtattttatattttatttggcattattaacatttattattgtgaatggattttagactgaagagtttagatatattagtactagattgccatacagcttatttatccgagtttttgtagttcacaaatgtttgaaaattaatggtaataaccggaagtcttccttaatgtaagtttggattaaagtttctcctgatttgcaaaacctgacctcagactttaaatatctttttcttctttggtttcttgaattcctaggaattcaagctcagattgtgttcttttaggggttttcattgtttataaagtaagtgagtttttgtttttgttgtggtgtatatttttcttaggaacttttaagcaacaggaacaacttttagtactttttattttgatagaacacacacaggagacaagtttctagtattattttataacgttgagtgccaagggcaattataggaaagtttggttcatattacagtcagcgttctgcactccctgcctttgctaataggagtaatttttgccgtataaaacttgcaagttggtacagttggaagatttcatcattatttacttcattttattacatctgagaactcaaatcattttttctttgatagtgtttgctgtctaaatgtattatttaaccactgtttgtgtatgtatttactgcttttgtttagaaatgtttatgtgtattttaggacatccccttgaatttttacggaatcagcctcagtttcaacagatgagacaaattattcagcagaatccttccttgcttccagcgttactacagcagataggtcgagagaatcctcaattacttcaggtgactaatcagtgtcagtttcacaagtgatttagagtgtgtcacaatttgaaaaagtccatgaacggtccttcccctcctcaaatacaactctgtatttgagaatgtgaatgttttcttccaagctacacttagatattgtaatctagataggtgtactaaaaaaacagttgggatatggaggttgggttaaattaagttgaccaaatagtagtaagtttgggaaacattttatatttcctttttggagattcccactacacattaatatgttaaagaatttgggaagctgtttaacagagaaactgcctaactttaaatcacttttcacaagcttattactcagttcctttttcttaggaacttttaagcaacaggaacaacttactcttagaaaaaatagctgtggggcttctttagtgatcagatcaccaagtatttgaattttatacagcattttaatgcccactagtgtggaaggtaaaaaatatatgcaagtattaagaataagttctattcttatagtcccacagtagttttttttgtttgttttttgtttgttttgtttttttaagcacaggaggctcagagcacttaagaatttgaatttcttcactgtttactttgcccaaaagtactgaatttctttactattgtataagaaatcacatccttccaaagactgaataatccagaatcactaaattacgtttgcaaaagtgtagccttttctcttagtaatatttagaatttctctgttcctgcagatacttaatatcagtgtattatttttctctgtccttcatatcaccacagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaagggtgagtttaagtaaaactttaaaaaaattagttcttggctgggctcatgcctgtaattccagcactttgggaggccaaggcaggtggatcacctgaggtcaggagttcaagaccagcctggccaacgtggtgaaaccccatctctactaaaaatacaaaaattagctggcgtggtggcacatacctgtaatctcagctacttgggaggctgaggcaggagaattgcttggacctgggaggtggaggttgctgtgagccgagattgtgccactgcactccagcctgggcaacagagtgagactctgtctcaaaaaaaaaaaaaaaaaaaaaaaaaaaattccttagtcacactagccccatttcaaatgctcagaagtcacatattaataataaggtttttctataatttctttcaatagtgtcctgtagttttcagtgtagaagttgtgtaatacttttgttaaaattatttcgaagtatttttattctttttgatgctgttataaatggatttttctcttaatttcattttcagactgttcattgctaactatataaaaatacaatttaattgtgtatattgatcttttatcataaaaccttcttgaactgttatttattcattaagtagtttgtgcatgtgttcattaggattttccatatacaaggtcatgtcatctgcacatggagacagttttacttcttttccaatatggataccttttatttctttgtcttatttaactgccctatctggagcctccagtatattattagactagcaagaaccaacaacatccttgtctggttcttgatcttaagggaaagcattcagtctttcatcactaagtatgatattatctatgggttttttgtggatgccctttatcagattgaagaaattctcttctgttactagtttgttcatcacgaaaaggtgttggattttgtcaaattttttttctttctttattaagatgatcatgtgatttttgtcctttagtatgctttattacattgattgattttgtatgttgaaccaaccttgcatttctgagataaattttactggttacagcatatgatcttttttatatgttgctggatttagcctgcttgtattttgttgaggatttttgcatctgttcataagtcatattggtctgtagtttttttgtgatgtttttgtctgaatttggtgtctgggtaatactggcctcttagggtgagttgggaattattctctcctgttgtctggaagtatttattaagaattggtgtgggctaacacggtgaaaccccgtctctactaaaaatacaaaaaaaattagccaggcgtgatggtgggcgcctgtagtcccagctactcgggagactgaggcaggagaatggcgtgaacccgggaggcggagcttgcagtgagccgagattgcgccactgcactcccgcctgggccacagagcgagactctgtctcaaaaaaaaaaaaaaaaatgcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgaatagttgatagaattcaccagtagtctggtcctgggctttttttggggggaagttttgtgattattgattcagtctcttgttacttgtctattcaacttttgtatttcttttttttttttttttttttttttgagacagagtctcgctctgttgcccaggctggattgcagtggcgtgatctccgctcattgcaagctccacctcctgggttcacaccattctcctgcctcagcctcccgagtagctgggaccacaggcacccgccaccatgcccggctaattttgttttgtatttttttagtagagacggggtttcaacatgttagccagggatggtctcgatctcatgacttcgtgatccacccgcctcggcctcctaaagtgctgggattacaggcgtgagccactgcacccggccaacttttctatttcttttagagtcagttttggtggtttttgacttggaatttgtctattttatctaagctgtctaatttgttggcgtgcaattgtacatatttccttataatcattttatttcctcttttgataaagtaataatgttcctgcatttattcctgatttcagtcatttgagtcctaagatatttttgttttttcccttcagtttagctaaaggttttaattttgttcattttgtggtggttgttgttaatgacaaaaataactttgggttttgttgattctccctattgtttttctagtcttttgttttgttttgttttaagtctctctaatgtttatttccctcttgcttgcttctagtttgttcttccttttttaggttaggtttagtttagttctttgtttagttttagtttaagattaaattattatctatctttgttagcatagatgtttatagctataatattccttctgcgtttatgctatagtagcatcccataagttttagtatgttgtatttttgctttctttcatctcaaaatgttttttaatttcccatttggtttctaatttaattcattcgttatttaggattgtgttaatttccacaagtttatgaatttcccacattttctcctttcgatttctaaattcattccattataatcagagaatatactttcaatacttttcaacttattgaggttcgttttgtggcctaacatggtatttctgaagaatgttctatgtatactgaagaagaatatagtgtagttcttattaagtggtctataaatatctgatagatctagtttgtagtcaagtcttcttccttagctgttttatctattattgaaggtggagctgtagttgtctctattattgttaattgccaatttctacctttaattctcagtttttattttatgtattttgtggctctgttatatataattgttgtgtcttcctgaaccctttttatcataaaatgccttttgtctatagtaacaatttttatcttaaatctgtttcctctgatatagccattctagctcttttttggttaccatttgcatagtatatacctttttctatcattttactttcaacctacttgtgtctttgaatctaaattgtgtgttttgtagaagcaggcagttggattgtaccctttacttcacctatcctagctttaatctggataaaacccagataacaaactgattttttagtttcttctgctttcatagatgaatagttattcgtgatgaattgggatttttgcccaaattttaagggttatttccaaatataatctgacacagcagtctttaacctttttggcaccagggaccagttacgtagaagacctttttttctaccaacataggtggggtgggcgcagtgattttgggatgaaactgttccacctccgatcatcaggcgttagttaggttaggaagtggggtggggcggtggttttgggatgaaactgtttcatctcacatcatcaggcatttgttaggctatcatacggagcacagaccctagatccctctcatgcacagttcacagtagggttcatgctcatatgagaatctaatgccgccactgatacaacaggagacggagctcaggtggtaattcgagtgatggggagtggctgtaaatacagatgaagcttcacttgttcgcccactgctcacctcctcccgtgcggcccagttccttgctcacccactgctcacctgctcctgggcagcccagttcctaacaggccaatggctggtgccagttcacggtcttggggtttgggacctgtgatctaactcaaggtgattgagacaattgaggagggtgacatttggctgagtttttaaaggcttttaaaaggagtgagtattgtcacaagtgatttttaatataatagactaggaaaatgaaattaagtagctggtattaccatttaaaatgctgtaactgttaagcagataaaaatagaacattatcttcaaaatgtaccatgtattactaataattggtcacctgtttttctagtatggagtgttgaataaagcaaggagattgagagtgatgtttgatccaaatgaaagacatgagttgacattaataaataaaacataatttgcttttaatttagaaataggtgaggtggttaaactatactgcaggtactctcatccttatcttcactcttaatatactaaaagccatttgatttacatatttctgtagagtcatttatttttaaaccatagcagttagcagctaatttttaattaggccaaagagtatttgcatagtatctattaagctttaactagaaacaaagacttttttaggtgattagtaaaggaaagggtctagattccatctaatcccttgggttgggcagtaaatccatattgatagagatgaattcatgtaaaattctcaagagcttttttgggttgcagtatgtttttgagtaatgatttatctttagtgctatgctggaatctataatatgtaaataaaattaaatgtgccataattggtgtgttggatttatatttttttcctttttcttccagttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaaccaaaaatcagcttttgcaggtctttatttcttctgtaaaacagtaggtaacttttcctaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtatttaaagaaataatttggattgcttttgttttttgtttcctttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactggaaacaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaatacatccaacattgcacttctcattttttaaatgattctgtcacgtagaatcagaattgaaagttgacaatgcttctgtcactgatacttctttttacttcagtaattggtgagtgtatcatataggaggcccaggcactagattgactttattgggtctcctggttcttttctcaacacagagatgggatacttgctgggatgttaaggttagtgaggtcttctagggaatgcataaaatttccattgttccatacttcttgtctgaagcagccagccaaagcctgctgcaaaatgttctaccgaaagtaagcaattggagggaatgagtgttcctgacccagtcagttctggtggattctccagccatgaagttcagttggcctcccccatccattttccccatttttccccctaagccaagggctggcaaactacagcttcatgagccaaatctggcatatacctgttatgtggtccatgaactaagagtgatctttacatttttaaatggtttcaattgtatatgttttttatcacctcaaaagtttcaacttacatttcagtgtccttaaaagtgttattgaaacacagccatcctcatttgtttacatattgtctatagctacttttgtgctacagaagtttgctgttggatagctgcagcagactgtggcctgcaaagcctaaataatcactatctggccctttacagcaaaggtttggtacccctgttgaaaactgactagtctaccctaagttatatgatgctttttattcctctcctgacattcttggactcttgacttcaggtcttagctgtagtctggctt

SEQ ID NO: 12153 - DNA, 23569 bp, Human
  misc_feature (1)...(23569): n = A,T,C or G
agcctcctccccatctcccacttgatggagtgcctctgatgccatctgatttgttcgggatgacacccgtcaccatgcaggacaacccagctgaccagaagcagagagaaactgtgggggcagtggcccacctttagtttggacagtctgcaggtgcaatgagctgacttcataatcatcacagagtgtaacaattacaggccagcctccccccttgatttgaggctactgctgccaggctagctatgtggctggccagaccaagggccagtgtgactgtgaagcagcatcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatggtgagagatgggcgtgggatgtagaggatggtggtgtggccctgagagataggcagtattggaaagtgtctgctggggagggaaactttgtccgtagaagctaaggctctctatcctgaaaccataggctgcagactccactgtgcccagtcggttagtgaaagggaaagcccacatggttcataggggttcatggctcacatatgatcagacttcactgctagaattctaaatgtgccacacccacactcccaagtactttcctgtgtggagtgacaatggtggcagttgcagtgggatacagagatgggccacacatgatctctgctctcagagaaaccaccttacagtaggaaaacatgtacacagcttcaggggtggggaggggggctgttagaaagcactggctttgcagagtcagatgtggatgtgaagtccagccctgtgccgcctagctgggtgacctttggcaagtgatttaacctcactgaacctcagtttcttcattggtgaaacagggataaaaaatagcgcctccctcacagatttgtgatgagataaccatgtaaagttttatttcttcctatggatgaggcaaagcaaaggacatttaaaaataccaaatcatatctttttgtgtgtgttctatataaccaaggtttcttgcccttaaaaaaaataaaaaataaaataaaaaatagaggccgggcacggtggctcacacctgtaatccccgcacttcgggagaccaaggcaggaggattgtttgagcccagtagttcgagacctgtgtgggcaacatggtgtaaccccattttgtagaggcgaaacctctacaaaaaatacaaaaattagctgggcaaggtggcacgtgactgtagtcccagctactcaggaggctgaggcaggaggatcgcttgaacccaggaggtcgaggctgcaaagctgagatctcaccagggcactccagcctgggcggccgatcgagaccctgtctcaaccaaaacaaaacaaacttttgaaaaatagacgcaggtgccctctggatgctttgctgcttcttgacacctgtcgtataatctgtaatgatgtgatttctgcgattccttttcattgtctgtctttcccttgctcacagtaagctccctgggggtaagggcgggtcgtcttgtgtcgcattttgtctccagcggagatccgttccgtttggaacggaagctggcgcacagaaggctctttagaaggtcggtgtgtgtgttgcggcagaaggtagaggccgaatgtggccgcgggtggcgtgttgagcgcggagggggtcgtgggactcgggaacctgtgcaggcggtggagaggggcgcagcggctctgccccgtgcggcccgcagatggcgctgcaggccaggtcctcgccgcgcgccagcctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacaggtgaccgggtgtgcgcgtgccagggagccgcgcgggcctcgcacaacctgggcaggccccgagggctggcgcactgccctggcatacctgcagggcgcttcccctccattcctagagggccgcgcttctggagaggctcaggaagggtgggcgtggggagccaagctctaaaacagggtagagattcctactgtgtgcagggcaccgcgccggctcctgcagctttgttatttcacactggcctcctgagacggcctgccggggggtagaattgacaccccatttgacagatgaggaaaaaccaagtgtgggaggccccagtcctctctgccaatccgctatacgtgttttgttttcagtggtggacctggtttctgcagacctggaagaggtagctcagaaatgtggcttgtcttacaaggtgagctcctgatctccacattccaaacctgagtgtctttttaaaaagtccatcccaagccagctgggcgcggtggctcatgcctgtaatcccagcactttgggaggccgaggcgggtgggtcacttggagtcagaagtcaggagttcgagaccatccaggccaacatggtgaaaccctgtccctactaaaaatacaaaaattagctgggtgtggtggcccacgcctacaatcccagctactcgggaggctgaggaaggagaatcatttgagcccgggaggcagaggttgcagtgagccgagatcgtgctactgcactccaatctgggcgacagagtgagaccctgtctgaaacaacaacaataacaaaagtccatcccaagccaaagggagcagagggttctcagatattgagaagtagggtgaatgacaccctgggatgccagcttctacgggcaatttgttgctgagcagtctggggccctttggcaggccctggttgccctgaggcgggtgctgctggctcagttctcggctttccccgtgaatggcgctgatctctacgaggaactgaagacctccactgccatcctgtccactggcattggcaggtttgtgtgtgtacttggggaagaaggagagaggcaggaggatggggcctcctctcagctctgcttttgatgcttgagtctagacgggaggggttttttttttaaccaataatggatgggaaggaaaggggtcaggacatctgaattcttatcctataacagggttatggggtatctcagccttggcactattgatatttagggacaggtaattatttgttggggggtggaggctgtcctgtgcagtgtaggatgtttagcagcatctctggcctctgcccactagatgccagtagcaccagccctgctccagttgtaaccatcaaaaatgtctcctgacatggctaaatgtcccctgggaggcacaattgcctctggttgagaagcattgtcctataacacaagctgtcagtatctcattattttcaccatcttctctggccctacttcttattttacttaaggatatggcaagagagaacatttactgagtgcctactatgtgcaggcattacctgtatgttctaggtaatctcttcagtgactctaccagttagagataattaaccctacttgagtttagcctaagaggagcaagtggcaaaggtgaggctcaagcgcgggagtatgtggcccagaacttattcaccacatctgcagcagtagagaacaggagagttcagagaaagaaggagttgcggtccagatgcagtgctcatacctgtaatcccagcactttgggaggctgaggcggcagatcactggaggccgggagtttgagacctgcctggcctgcttgcccgcccaaaatgatgaaaccccgtctctactaaacatacaaaaattagtcgggcgtggtggcgggcgcctgtagtcccagctacttgggaggctgcagcaggagaattgcttgaatgtgggaggtggaggttgcagtaggccaagatcgcaccactgcactccagccttggtggcagagcgagactctctcaaaaaaaaggagcagttatgtcccgccacgttgtttggtgggttggggaagagttgcaaagacgacagacgtttgctggccaagtgagtcttgacctttttcctggtctgtttgttcagaaattgatgaataactgccaccataaaggtctttggattggtgtggccctttctgtttccttaacacattctcttggcagggttcatgcagtgtggtgcttgctttccctggttgggggtctgagtctgtgatccatcaagcactggctaagggcctgctgggtgcttggtatgtgcagatgatacatacacgaatgaggcaaggcccctgcccttaaggcctctagttgggtgtaggggaaaatcaagtgaatacaagagagctgtaagcaccgagggaggcaacggtaaggagggagtggtgaacaggaagccgattggccttgggcttagggagtttataaatccaacagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacggtacattatttcatttattcgtcacaaccaccaatgagcatgttactgtttaaatcatcattctaggccgggcgcagtggctcacgcctgtgatcacagcactttgggaggctgaggtgggcggatcatgaggtcaggaaatcgagactgtcctggctaacacggtaaaaccccgtctctactaaaagtacaaaatattagctgggcgtggtggcgggcgcctgtagtcccagctactcggaaggctgaggcaggagaatagcatgaacccgggaagcggagcttgcagtgagcggagatcgcaccactgcactccagcctgggcaacagggcaagactccatctcaaaaaaataaaataaaataaaataaaataaaaataaatcatcattctataggtgaagaaattgggactcaggttaaatgacttgttcaagattgtgcagttagcaaacggcagaccagttatttgagttcatgcttgtcacactcctaagtctaagaacgcggctcttaactcatctgcccggctgtctccctggaggcgggaggccattgtgaaagcagggttatagacagtggggtagaggtgtgcagggtggaagggtggcagaggccaagcagggccctggcagtgctggcctggggtatgtgagtccagtctagaacagtgggagacatgttgaagaggaactgtgacaagacctactaccaggaggaatgtattgtgaagaatcaaagctgactcaccaggtttctagcctttctttctttctttcttttttttttttgtcggagtttggaatgtattgtgaagaatcaaagctgactcaccaggtttctagcctttctttctttctttctttctttctttctttctttctttctttctttctttctttctttctttctttcctttcttccttttctttcttccttccttccttccttccttccttccttccttccttcctttccttctttccttctttctttcttttttttgacggagtttcactctgttgccaggctggagtgcagtggcgtgatctcggctcactgcaacctccgcctccagggttcaagtgattctcctgactcagcctcccgagtagctgggactacaggtgcgtgccatcaacgcccagctaattttttgtatttttagtagagatggactttcgccatgttggccaggatggtctcgatcttctgacctcgtgatccgcccgccttggccttccaaagtgctgggattacaggcgtgagctaccatgcccagtctctagcctttcttaccgtgtgctgtggacagttaatggtgtaactttaaaacttgggaggaggggagttctgtagtcagaagtttgagaaatgcctgactaatccaaattaaacaggtttctctgttgtaggccgcctcagaacctttagtgctgaggtgcaatgattccttacagggtgttatagcatgtaacgtactttgggaaaagctatgttgatgagggagattgattattccttataggccagagctaggtctgttcatcccacagtcccctcattttagaataagactgtcaggaaatatgaggcattgaagtggtgtgtgaatggatgactgaaagaatggctaaaaggcagttcagagggaaaggcagaggataagtcccagaaatcacctgtattctaggcagtggtaaaacccaggtgtacttctgcttcatggggcaagacaggggtctctccctgttgacatgcggagttaaaggtgatggggacatattggtaggaaggttctctgggcagtcggagaggcacggaatggaaactcaggtgagaagttggctggaaggtggatttgggaataccttatacagactgatctccacagccaaggatgtggttgattcttgactagagtcaacaccagtgcttcaaccccagctgcacgttagaatcatctgggaaacttgagatattcatgctctggtcccaactctatatattctaatttaattagtctaggtcagtggttcccaaacttgtgtgcccattggagtcacctgaggactcttttaaacattacgaagtccaagtctcccccagaccaattaatctcattcactgtgagtgggacacaggcatcagtattttttaattttttaatttgttttttagagacagggtcttgctctgttgcccaggcaggagtgcagtggtgcacaatcatagttcactgcagccttgaactcctggactcaggcagtctccctgcctcagcctcccaagtagctgggactacaggtgctcaccaccatgcctggctaattaaaaaaaattttttttttttgtagagacaggggtcttgctgtgttgccaaggctggtctcaaattcctgggctcaagcaatcctacctctgtctcccaaagtgttgagatgacaggtatgagccaccatgcctggccaggcatcagtatttttttgaagctcccaggtgaatccaatgtgcagacaactttgggtactgctgacataggcattttttaaaaaactcccctgattttattttatttaattaattaattttatttttttgagacggaatcttgctctgtcgcccaggctggggtgcagtggcgcgatctcggctcactgcaagctccacctcccgggttcatgccattctcctgcttcagcctcccaagtagctgggactacaggcgcccgccaccacgcccagctaattttttgtatttttagtagagacggagtttcaccgtgttagccgggatggtctcgatctcctgacctcgtgatccacccgcctcggcctcccaaagtgctaggattacaggcgagagccactgcgtccagccaactcccctgattttaatgtgcaggcaggattgagactaactactctagtctaatggttctgaaacttgagcaggcttcaaaatcacttggaggccttgttgaaactcaagtttcaagtgtgggctgcattcccagagtttctgattcagtaggtcttggggagcggagctgtgaatttgcatttctagctagtccttaaaggttgctgatgcacctggtctggggaccacactggggttcctctgatctcaatgggaagaatggaatcaggagtggtagaggctggatacttattaaacagagatggggtgagcacaattatctcaagaagccacagggctagagtggtaaccagagtgttttgactggcaggaacctgtgggtataatcatggggagtccctggaattaaaatggttgggggccaggcacggtggctcatgcctataatcccagcactttgggaggccaaggcgagtgggtcacctgaggtcaggagtttgagaccagcctggccaacatggcgaaaccccatctctactaaaaatacaaaaattagccaggcgtggtggtgggtgcctataatcccagctactcgggaggctgaggcaggagaattgtttgaacccgagaggcggaggttgcagtgagccgagagcacaccactgcactccagcctggtgacagagcgagactccgtctcaaaaagaaaaaaaaaatggatgggatgcttactaaagtgctgttcggcatatacagagaggtcatgggaggtcatcaagaaccatctcaaggactggaacctaggaaggtgattgtagggctaggaaaggtacgcatgtgatcaggcattggtacaggccgtggcatagaagaaacttcagcctagagatagggcagggcatggagggtaggtggtgacctgtttcatgtggttgagggagagaacctggtttaggaattggcatgtcatgaggtttatcccaagtctttcacagccagtgttgatgatacagaagcgaaataaaagtgatagcacctttctgttactcatttttctggaatgattattgggtgcctcctgtgtttcaggcactgtgctagtgctggggatgcgacagggatcggacccagtccttgccccatggtgctctcagctagatgagcaagacaaacaaaaacaagcaaataacaagataattacaaactcctaggactagtgaggatacaagaccaacacatacaaatcaactgcatttctctatactcacagtgaacatgtcaaaactaaaataaaaaacactaccatttattggccggccgcagtggctcatgcctgtaatcccagcactttggaaggtcgaggcaagtggatcacctgaggtcaggagttcgagaccagcctggccaatatgatgaaacctggtctttactagaaatacaaaaattagctgggcgtggtggtgggtggttgtaatcccagccacttgggaggctgagacgggagaatcacttgaatctgggagatgcaggttacagtgagcggatattgtgccactgcacttcaacctgggtgacagagtgaaactgtctcaaaaaaacaaaacaaacaaaatggctgggcgtggtggttcacgcctgtaatcccagcactttgggaggctgaggtgggcagatcacaaggtcaggagatcgagaccatcctggctaacacagagaaaccccatctctactgaaaatacaaaaattagctgggcgtggcagtgtgtgcctgtagtcccagctgctggggaggctgaggcacgagaatgacgtgaacctgggaggcagagcttgcagtgagccaagattgcgccactgcactccagcctgggcgacagagcgagactccgtctcaaaaaaacaagcaaataaacaaacaaacaaaaacacaatgccatttatagttgtttcagagaaatgaaatacttgggtataagtctaacaaagcatgtgtagaatctgtatgctgaaaatttttaaattgctgatgaaagagatcaaagatgactcggataaatggatgacatgtactttgttcatggattgggagactgaacataatgaagatttcaattgtccccaagttgatctgtaatttaacgcagttcctattaaaatcccagcaagttttttttttctatagacatagacaagcttattctaataattacgggaagaccagttttacctagattagctaaaacaatttggaaaaaggatagctggaggaatcagtctacccagggttaagacttgctatatagctacataattaagcctagtgtggtattgaccaagggacagatggacacagatcagtggaacagaatagataacccagaaatagacctccacaagtatacacaactaatttttttttttttgagacagagtcttgctctgtcacccaggatggagggtactgctgctattacagctcactgcagccttgacctccctgggctcaggcaatccttccaccccaagcctcccgagtagctgggactacaggtgtgggacaccatgcctggttatttgtatttgtatttttttttttttagacggagtttctctctctctcttttttttttttttgagatggagtttcgctcttgttgcctgacctggagtgcaatggcgtgatctcggctcaccgcaacctccgcctcccgggttcaagcgattctcctacaggcacatgccaccaggcctggctaacttttttgtatttttagtagagacggggtttctccatgttggtcaggctggtctcgaactcctgacctcaggtgatccacccgcctcggactcccaaagtgctgggattacaggtgtgagtcaacgcgcctggcctgagtttctctctttttgcccagactggagtgcaatggcgtgatctcggctcactgcaacccccgcctcccgggtttgattcacctgcctcgacctcacgggtagctgggattacaggtgcatgccaccatgcccagctaatcttgtatttttaatagagatggggtttcaccatgttggccaggctggtcttgaactcctgacctcaggtgatcgcccgcctcggcctcccaaagtgctgggatcactggcgtgagccaccgcgcccagcctgtttgtattttttttatagagacagggtttcattatgttgcccaggctggcctcaaactcctgggctcaagcaatgctcccgcctcagcctcccaaaatgctgggattacacacaattgatttttgacaagggtacagaaacaatgtgttggaggaaagacagcctttgaacaaagggcgctggagctattggacatcataggctaaaaatatacaataatcaacctaaaccttataccttatacaaaaattgaaaatggatcatagacttaaatgtaaaaccaaattgtctaatttttagaacaaaacaggagaaaatctaggcaaagagttcttagatttgatgccaaaagtatgatccatgaaaaaatttttgattaatggggcctaatcaaaatttaaaacttttgctgtgcaaaacagaatgaaaagagaagtacagaatgggaaacatagttacaagccatgtattcaacaaaggacttgtatctagaatgaagaaagaattcttaaaacccaacaataaaaaatcaaacaattcaattagaaaatgggcaagggctggctcacacctgtaatcccagcactttgagaggctgaggtggtcagattgcttgagcccaggagttcaaaactggcctgggcaacgtggcaaaaaccctgtctctaccaaaaaaatacaaaaattagctgggtgtggtggcacatgcctgtagtcccagctacttgggggagctgatgtgggaggatcacctcagcctgggaggtcaagattgcagtgagctgtgaccatgccactgaattctagcctgggtgacacagtgagacgtgagaccctatctcaaaaaaaaaaaaaaaaaaagccaggcgtggtggcttacgcctgtaatcccagcacttcgggaggccaaggcaggttgatcacctgaggtcgggagtttgagatcagcctgaccaacatgaagaaacctcgtctctactaaaaatacaaaattagccaggcgtggtggtgcatgcctgtaatcctagctactcgggaggctgaggcaggagaattgcttgaacctgagaggtggaggttgtggtgagccgagatcacgccattgcactccatcctgggcaacaagagtgaaactccgtttcaaaaaaaaaaaaagttcaacactattaactattagggaaatgcaaattaaaaacacagtgagctattatttcatacctatcagaaagactaaaataaaaaaataatgataataccaaatgctgatgaagatgtggagacactggactactcatatatacattgttagcggatatgtaaaatggcatagccactctggaaaatagtttggtagtttcttataaaattaataatgcatttaccataccacccagcaattgtattcttgggcatttatcccaacgttgtaaaaacttgggtttatacaaaaacctgtaaaaaatgcttatagcagttttatttatagtagccccaaagtggaaacaaccaaatgcccttcaatggatgaatggttaaataaactgtggtacatccataccatggaatactttttagcagtaaaaaggaatgaactatccatatatgcaataactgggatggatctcaagggaatgatgctgagtaaaaaagccaatcgcagggccaggcacggtggctcatgtctgtaatccccgcactttgggaggctgtgttgggcggatcacttgaggtcaggagttccagaccagtctgcccaaaatggcaaaaccccgtctctactaaaaatacaaaaattatccaggtgtggtggtgggcgcctgtaatcccaggtactcgggaggctgagacaggagaactgcttgaacctgggaggtggaggttgcaatgagctgagattgcaccactgcactccagcctgggcgacagagcgagactccgtctcaaaaaaaaaaaaaagaaaagaaaaaaagccaatcacaaaggttacacagtgtataattctatgtacataactttgttcttgaaataacataatagagattagtggttgccagggattcgggattaggggtgaatgggaggaatgtggctataaaagggtagcaggaggaagacttatagtgatggaaatgttctgtatcttgattatagtagtcgtgtaaatctacatatgtgataaaatggcataggactagacacatcaacacacgtgcttgaatgctaggaacactggtgaaatctgaataagctctgtggatagtaccaacatcagtttgctacttgtgtgatatactatagtccttttttttttttttttttttttttttaaagagaaaagggtcttgctatgttgcctgggctagacttgaactcctggactcaagtgatcctcccaccttagcctcccaagtaactgagactacaggcccctggctagtacaatacattttgtagtacagttgttattattaaggtaaaccaggtgaagggttcatggactttttgcaacttcctgggaatctataattatctcaaagttgttttttcttgttgttgttgttgttgtttgttttgtttttttgagacagagtcttgctctgtcaccaggctggagtgcagtggcgtgatctctgctcactgtaacctccacctcctgggttcaagcgattctcctgcctcagcctcctgagtagctaggactacaggcgtgtgccaccatcaaagtttaaaaaaagcgacaaattttgggaaacgctatcaaggaaacccacaaacagctgggcgtggtgactcacgcctataattgcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcctggacaacaaagagagactccgtctcaaaaaaaaaaaaaaaaaaaaaaaaaaaaggaaacccacagggcctgagatgaaaaatgaagggagaaccttctgatggggtggcagaggcctctctggagagctgatctttaagagtggagggatgaagagagaccagagaaggcacatttgggcattccctccttaccagaagaaaacaccaggagaagcctcctggccagtgatgttcaaagacagaaccagtgcttgaaagaaatgtcttacttttcttcttggtaccttttcccctgtcttcctcctaacctcttgtgttgattttcttctcttctgccatcagtcttgataaactgcttgatgctggtctctatactggagaagtgactgaaattgtaggaggcccaggtagcggcaaaactcaggtacatgtgaggccagcagtcaggaggatttaggggtgagggtggtagatgcatagcccagggtccctgggggagcttcagcgtactaatgggttcagagcccaacagagagaagatgggtaataaggaatggggtcgggactcagcccatttgtgttgctggaatctgggcaaggtttggtggggagctcccatctggaccctctctgaagtgtcaagttcatccaatgcccccacccccaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggtaagggcaggatgctgggttccattgagattctgacacaggaaaaccccattatcccttaacattgtaagaatttgggttgaatagtcattccttgccttcaaacttgctgttctattaatacatctcgtattccttaagccacccctgttgatgccatcatcccatttgggatgctactcacactgattcttccaggaaaccctcccaactctttgcatgccctaaaccagggctggcaaacaccaagctttgtgtttccagtccatttctcacctgtgagagacatcactaatcagtcatatccctctttcctgctgagttctgagtactttacagctcagcacccaggcagccaccactgtgacaactgaccattagacaaagctcatttgccaccctggacctgagtccttgcatccaggtgcctcttccttctcagccttaccttgacccccctactccctcttatccaaagtccttgcttttcttttccaccgcttcaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgagtgaggaatacttttagctgcaagtaatagaggttgtctgacagagacttgaagcttgaggacatttaattatgtcacatgagttgggaggttggcaggtccatgctatcagggcaatagatttgtgtgtctgattttcttgttcttcccctcatggttgcaaagaggctgccaaagctccaagcatcttgtcttcacacatccacatccatattcaaggcagtaaaagatagatggttcttttctgtacctcctcccttttatcagggatgaagaatctttctccagagcccactaatagacgtccctcttccccttacatctagttggccaaaatggggttatgtgtgtatcttggactaagacctgggcccaccatccctgaagtcagatttctgcccagtcgctgaacacattcagagtcatgttaatgggaaggatttagaatggcatttgggttggcactttgctactcatgttgggtgcttagacaggatttggtgcactgatttataaatgactagatgtggaggataccttaaagatagaatagtttatctcaaacttttcctctcaccccaaagcatgacgtgttcacacgggcatccccacgactatatataaagtcaatgatttttacaaactttagaacatataatagttgaacaagctgggagtggtggcccacacctgtaatcctaatgactccagaggctgagacgggaggattgcttgagcctagcagttggaggttgcagtgagctatgatcataccactgtaccttagcctggtcagcagagctagaccccgtctttaaaaaaaaatgttgaacaaatacttacctcagaagtcatagctggttatgacccaccagcttgttgagacatgaagctgagtagtgcttacctcacttttagagatgagaagagtgaaggccggagaagtgaagtgagttgaccaaagttgaccaaatatttagggcaagaactaaccttatagcccaaacctctcaattccagatcagaagactgtattttttactgtaggaccattagatgatatatcttctattattgcataataagttaccaaaaccttagtggcttaagacatagtatttcttatctcacagtttctaggggttaagaatctgagactaggagcggtggctcacgcctaaaatcccaatgctttggaaggccaaggcaggaggatcacttgagcccaggagttcaggaccagcctgggcagcatagcaagaccctgtcttaaaaaaaaaaaaaagaaaaagaaagaagaaaagaaaaagaaccagaatcaggatataagaagtaagggagaagagaaaagaagcatcaaaaacagtttaagtccagggaaaccaggaggattctcctgcttgtgtaaagacagaaaattatggttagaaagatggcacaggctaggcttggtggctcatgcctgtaatcctggcattttgggaggccaaagtggccagatcacttgaggccggatttcgagaccagcctggccaacacggtaaaaccccgtctctgctaaaaatacaaaaattagcacccatagtgtgcacccaatgtgtgcacccatagtcacagctacttaggaagctgaggcatgagaatcgtttgaaccgaggaggcagaggttgcagttagctgagatcatgccactgcactccagcctgggtgacagagcaagacttagggaatttatttggaggcattttagatacggaagatgaggcctagaggcatgatctagaaggagacagtgaagtaaagagaaggctaaactcttcagcaaaggaagttaggaatttgagggtggtagttagcaggacaagggaaagaaaggagggagtcagaaaaggaaaagaagggccttaccaccatggtgggaggctggacacaggagagagatggctgctgagagatccatgaccagaggcctcaggactctctgcggagctttctgaaatttgatgactttaatgtagtttttagttattttattttattttttttgagacagagtcttgctctgtcgcccaggctggaatgcagcggtgtgatctcagttcactgcaacccccgcctcccagtttcaagcgattctcctgcctcagcctcctgagtagctgggattacaggtgtgcaccaccacgcccagctaatttttgtatgtttagtggagacggggtttcaccatgttggccaggctggtctcgaactcctgacctcaagtgatccaccgccttggcctcccaaagtgctgggattacaggcgtgagccactgcgcccagccactttagtgtagttttgatgtcctgtgatttaaaccctttctttctacccaagtcttcattgaagtctgttacacatgccaatgggacgagggagacattgctgctgatgacattctgtgatgcccgtgcagcttgctgtatttgggatgggggggctatttcttactagttttagatagaaaagcaagcttgtcctgtaatgtgtcctagaggctgacaggttcatgagtgcttcccccacattccttcaggtgactggttcttcaggaactgtgaaggtggtggttgtggactcggtcactgcggtggtttccccacttctgggaggtcagcagagggaaggtgagtgatgtggcagagcctggggccagtggaatgtgacctcgcctcccagctctggagtctggtctctggccagccccatccctggttccccactgccctccctctctgcttctcctcctcctgcaggcttggccttgatgatgcagctggcccgagagctgaagaccctggcccgggaccttggcatggcagtggtggtgaggaagcaggcttggccaatgaacttgatttctagttattgcgagctctttatttcccttaaatgtcagcttctgaaccccaaagtggccctttaggaaagggacatatcccagcttccctgggtcagctacagctttgcaccataaatagctaagggaatcaggaatcgtcttgttgtttttttgttgttttgttttgtttctacattttttctttttagtcaggtttattgaggtataatttacatagagtaactttctccttgtttgaagtttgactaatggatatagttgtatccagtcttgtgaccccaccaaaaggtcccccaggcccaggcaaccactgatctgttttccatcccaatagtttggccttttccagagcttcatataaatggatctttttgctattgaagtaactttttctgcttatgaggtagtttttttaaagtctgcatgcttctcatagaaaggatagaaaataaatatgattcaaatttgtcatcaatctccacatccacagaaaccatattaatatttttacatatctccatacaatactttttctgcatatttacttatacttttagccaactttctttctttcttttttttttcttttgagatagggtttcgctctgtttcccaggctggagtgcaggggcacaatcacagctcactgcagctcgaccttccaggctcaagcaatccacccgcctcagcctcccaaagtgttggtattacaggtgtgagcccacacttaaccagctttctaactaaactaacctcatgaaaaaataaaaaaaaataggccaggtgcgctggtttatgcgtgtaatcccagcactttgagaagccaaggctggtggatcacttgagcccaggagttcgagactagcctgggcaacatggcaaaaccccacctctacaaaaaatacaaaaactaggtggccttggtggcaggagtaattgcttgagcctgggagatcgaggctgcagtgagctgtgatcatgccactgcactccagcctgggcaacagagcaaaacctcatctcaaaaacaaacaaaccaaaacaacaacataaaaaataccatctgagtccatttcctatgttttaaaatagattttttagaaatgtaatttttagcagctatatattttttccagtttcttttattgtggtaaaatacatgtaacataaaatttactatcttaaccactttaaggtatacagttcggtggtgttaaatacattcataacgctgtacaaccatcaccaccatccatctctataactcttcaccttgtaaaactgaaactctgtacccattaaaaataactcattttccccttccccagcccctgacaaccaccattctactttctgtatctatgctttttgactactctaggaacctcatatacatggaatcatatggtatttactttttgtgactggagtatttcacttagcataatgtccagaaggttcatccaccttgtagcatgtgtcagactttccttccttttaaaggctgagtgtctgggcgtggtggcccacacttgtaatcccagcactttgggaggctgaggctggcggactgcatgagctcaagagtttgagaccagcctggaaagcatggtgacatgtgccccatcgccttctggttcgggtcaaacctgaggcatcgagatttagtggaaagagcggggcacaagtcaggaggcccaggttctagttccagacctgccattaggttttgtaaccttggggaagttatttctctgtgctaggcctctgttttcctctccgtaaaatgaagcggtagtaatcgatgtcctctatactagcattatggatctgtaagtctgtttctgctgcaggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacaggtgagccagccccaggaagatgccagtaatcttgggccctggagggtggtttccatacccacagatgtcttcgagaagaactctttagaggctgaaaccttgcaactaaagaagctacccacttgggttgcttaactccactgactccttacttcttcttccagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatcaggattggttactggccacatcttttaaaggaaggtcatctttcttggttagagagcctgttgtgtaattaatcagttatgtcttggctgcaggaaaggagggtccgagttacactcagaaagtaatgacatttagaggtgatgaatgcaacagggatagaatcatggaggattgggaaggagtggcaaactggcaccagggtgttggattcaggacagggttggtaagcctaagcctgggggaatcctagcgcttgctttcacagaagacctcaggagaaattaatcttcagtatctttataccatgggtgattggcacattcctgcaaccacagtaagatgcaatacatgaagctggaaattgcaaattcttgccactcaaggtactatttgggcatcttcagcccacagcagacatgaccaatcgggcacaagcactcttttttgtggaagtcaaagtgtttttagaagtttttctcaatatagcactccagggggccactaccagtcagttggagttggtattcaaggtggagtctggttgccgtctctgccctgttcccattatgtagtgagttcaggtacttaatacctaactgaggaccctaggactgcagtttgagatcatctggggccaggcacagtggctcacacctataatggtagcactttgggagcctgaggcgggaggatcacttgagcccaggagtttaacagtttaaaatcagcctgggcaacatgatgagacatcgtttctacaaaaaaattttttaaattagctaggcattgtgatgtgcacctgtggtccctgctacttgggagcctgaggcaggagaatcgcttgaaccttggaggttgtggctgcagtgagccctgatcgcaccactacaccccagcctgggtaacagagcaagaccctgtctcaaggaaaaaaaaaatcatctggcccatcctgttacttaacagagaaggtacctgaggctcaaaaaggatgactgacagtcctagtggcagaatggaggtgggatctggaacccacaacttgattcctaggactcttttttttttaattcccacattggctgggtgtggtggctcacgcctgtaatcccagcactttgggaggctgaggtgggtggatcacctaaggtcaggagttccagaccagcctgaccaacatggtgaaaccccgtctgtactaaaaatacaaaaattagccaggcatggtggcccatttcctgtaatcccagctactcaggaggctgaggcagaatcgcttgaacctgggaggcggaggttgcagggagctgagatggcgccactgcactccagcctgagcgacagagtgagactccgtctcaaaaaaaaaaaaaaaatgcaaaaattagccaggcgtcgtggcg

SEQ ID NO: 12154 - DNA, 41804 bp, Human
  misc_feature (1)...(41804): n = A,T,C or G
atctagctggactagtgaaaaaaggagaggacacaaattaccaaaatcagaaatgaaaggacacaacaaagaaaacaacagagtgagagaaaatatttgcaaaccatatatccaataaggggttactatcctattctaaatatgtgaagaaagcaaacaactcatagcaaaatcagatcacacgactaaaaagggggcaaagggcaccaggtgcactggtttacacctgtaatcccagtgctttggaaggctgagacaggagaattgcttgaggccaggagttgtgaaaagcctggacaacatagaaagaccttgtctctacaaaaaaattttagattagccaggtgtggtgacatatgcttgtagtcccagctacctgggaagctgaggtgggaggatcacttgagcccaggagttagaggttgcagtgagccatgattgcagcactgcagtacagtctgggcaacagcttgatagcttgagaccctgactcttaaaaaaaaaaatcatttatcaaaagatgacatacaaatgatcaacaggttcataaaaatgctcaatattggctgggcacagtggctcacacctgtaatcccagcactttgggaggctgaggtgagcagatcacctgaggttgggagttcgagaccagcctgaccaacatggagaaaccctgtctctactaaaaattccccagaggctggggaataaggggctgggggagagaatggggagatgaagatgttggtctcagggtacaaagttaacagttaaacaggaggaatacaattttgagatttattgcacagcatagtgactatagttaataataatttattgtatatttcaaaatttctaagagagtaagttgaaaatatctcgccacaaaaagaatgataagtgggctaggtgcagtggctcatacctgtaatcctagcactttgggaggctgaggcaagaggatcacttgaggcgaggagttcaagaccagcctgggcaacatagcaagaccctgtcgctacaaaaacttttttttttttttttgagacggagcctcgctctgtcgcccaggctggagtgcagtggggcgatctcggctcactgcaggctccgtcccccggggttcacgccattctcctacctcagcctcccgagtagctgggactacaggcgcccgccaccacgcccggctaattttttgtatttttagtagagacagggtttccccatgttgcccaggctggtctcgaactcctgacctcgtgatcagcccgcctcggcgtcccaaagtggtgggattacaggcctgagccaccacgcccggccccaggggacattctagaggggacttcaccccccaagccgcacttctccatttccctgcggtcgtcgctaaccgaaggcgccatccggtgacgactggatgtgcgcggcggtggtgagaggccgcgagaaccaccaggtccaccgctgcctcggcccgggcggaatctgggaaggtctctgacaaccattcatcctcagattttcccaattgtgcatgggtgggcgggccccgcatcctaatgggcactgggcatgtgaagtgtgaaccacccgggcctaactagcccctgaaggcctgacgaaaccgccaggcccaccagggggcagcagagatccgacggccgcggaccgagggaagctggcgggaagtaggaggcagagggcgcgcagggaagcggcagggcgagcggctcagaacgtaaaagccagcaccgcgcctccaggttgctttacggctgccgcagaaggctttgcggctcttttcccctccgacttgatttacggttccttctctggtctgtgtttttttttttcccctccggcgctgggcgtgggttcggaccttcttcccagagacgctcgcgcacccttcccattctcctctgcgcggcctccatctaagatctcttccccttgtccatagcctagatcgagctccctgtgtgcaccgcgcgctgcccgaggcgcgtaagtgggggaggagagcggcttcccccggggtggttctagccgtgggtgtggagcgtgggaaggctcagcttccgggtcgagaacctggggctgcggtggacctgatcctgaggtctcagcgtagagatgctgagtccagaggcctgttctagttcaccagtgcagtgaggggctcagtatccgggcctcccgagaggtgggtaggaaggcggggtacaggaaacttggcaccaacgcgccgggaccccaccgcggtgcggacagccaggtgtccgtggtggcgcttccttggagatgctgcctgcagacaggcgtggggaatctgaagtttgtgttaatagctaaacgaagttgagttgcagggagcgggggacgctgggaagaaatgattgatttaaaaggaatttgacgccgggcatggtggcggcatgcccccatgttccctggaggtcaagcctgcagtgagccgagatcgcacccgtaccacgacactccgtcccgggcgacagagcgagaccctgtcacgggggaaaaaataaaaataaaaatttgacgctcactttagctgagtattgagccttgttataacattgagatagaggtctggcgcggcgtctcacacctgtaatcccagaactttggaaggccgatgcgggaggatcgcttgaggccaggagttctacgccagcctggctaacatagcgaaaccccatctctactaaaaatacaaaactaggcaggcctggtggcgggcgcctgtaatccccgctactcgggaggcggaggcatgagaatcgcttgaacccagtaggcaggtgtgccggtaagccgacatcgcaccactgcactccagcctgggggacagagcgagaatccatccaaaaaaaaaaaagttataattcacgtacaattaaattcactccctttttttaaaaaaagtggagacatagtctcgctctgttgcccaggctggagtacagtggcgccgtctcggctcactgcaacgtccgcctcctgggttcaagcgattctttgcttcagcctctcaagtagctggaattacaggcgcataccaccacacccagctactttgtatttttcaccatgttggttaggctggtctcgaactcctcgcccttccaaagttcagggattacaggtgtgaaccaccacacccagtctaaattcacccttttaaagtgtgcaattcagtggttttaatatattcacaaggttgtgcaatcaccactattatctaattccagaacatttttatcatccctaaaagaaaccttaaaaccattagcagacacccattatttcctcctactcccagcagcactaatctatgaatttacccattctcagtactgtattatacaatagttgttcttttgtgtttggtttatttcacttcatgattcaaagtccatctatgttgtatgtagcatgtatcaacttcattttttaaataactgaattatttattgtgtggatataccacattttgtttctccatttttgatggatactggtgattttctaggctttctaggtctagtcctccacagaactcgcagtctgaggcacagacatttaaaacttaagtttttggaaactagcatttaactcttgggttgggtcaggtaattcagtggcctcaggtctggtatcgtttagggcagttttttttttgttttttttttttttgagatgaagtttcactcttgttgcccagggtggagtgcaatggcgtatctgggctcactgcaacctcacctcctgggttcaagcgcttctcctatctcagcctcctcggtaactgggcttacaggcgcatgccactatgcccggctaatttttggtatttttagtagagacagggtttcaccatgttggccatgctggtctcgaactcctgacctcaggtgatccacccacctcggcctcccaaagtgctgggattacaggtgtgagccaccgcgcctgggtgggagttttgtttttttgtttgtctgttgttttttggggggacagagtttctctcagcctcctcggtaactgggcttacaggcgcatgccactatgccgggctaatttttggtatttttagtagagacagggtttcaccgtgttggcaatgctggtctcaaactcctgacctcaggtgatccacccgcctcggcctcccaaagtgctgggattacaggtgtgagccaccacacctgggcgggagttttgtttttttgtttgtctgttgttttttggggggacagagtttcgctcttgttgcccaggctggactgcagtggcgagatcttgactcactgccacttctgcctcctggattcaagcgattctcctgcctcagcctcccgagtagctgggattacaggtgtgcaccaccacacccggctaattttgtatttttagtagagaaggggtttctccatgttggttacgctggtctcgaactccctacctcaggtgatcctcccgccttggcctcccaaagtgttgggattacaggcgtgagccactgcgcccctctgggagtgttttttaaagtgttctattctcagttcaccacttaccaggccgttaattatcgtggtatcaagcagagaaatgtttgtgtgctggtcttctcagggaggcagaaaccgtcagagattgctgttgtgtaatgtacaccaaaacgtgttatcttgtagtataaacggtgtagttgcagatgagtgtatgaaaaatgtaactgagctagctgtgggagagactagttgtgaaaaattttgagtcacccactgtatgctttcccagctatgttcaaataaggtgacactctgccttcctgtttcagctctaaaactgttcataagtgttattttggctgtatacgtagtgccatgtttttttgtatttttgtgcttttggtgattttgctgtttatagtggcctccaagaatagaagtgctgtctagcatttccaagttgaaggctgtgatatatcttatagagaaaagataagcttttagattagctttgttcaggcatcacttttgttgttggctgtgagttcatgttactgcatcaacaatatatattaaataagatatctttaaacagaagcacacataaaacaaggttatgtattggcctgttgagtaaccctgtatttcccctgggagcagtggctcagtatttgctagttcagtgttcatgatggctttacaggacataactaccctgaataatgagaactgactgtctcagtagtgcttcaagggcagaaagcctagtggatatttttccatctctgcagcttttagcatttcttcactcaaggcactcatttttaatattgaactggcagttttgatgtggagagaagctaaaataaggctaaaatgctcttcatactatgtgctgagtggggactgtgctgagtgttggggattcagtgattagtgtatggccccgcagttctctaatggctgagtgtgggagtgcagagaaatgatcagtgtgagggaattaatcctatgttcccaccgtgtttttttgttttttttgagacggagtttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctaatttttgtatctttagtagagaagaggtttcatcatgttagccgggctggtcttgaactcctgacctcaggtgatctgtctgcattggccttccaaagtgctgagattacagatgtgagccaccgtgcctggccactttttttctacttttgctaatttttttaaagtttcatgaacattatagtactgtgttcataaatgaaaataaaagaaacttgctccagtcttgttcatcaagccgttcttgaccttcacagtcagaatctcacccatcaccttgtcacatctccctcttgatctgtatatccagagtccacctgacatgcttcttcagccctccacatataataagaaatggttttgtgagccgagattgtgccattgcactgcagcttgggcaacagtgtgagactcctcaaaaaaaaaaaaaaagaaagaaaaatgcttttaggtgataaggaaatggagaagaataaaacatctttgccagtctttacctttttaatatcttgaattcatgatttcttgccatagccactatcctagtccaggctctctcccttctacccctgagttttttttttttttttttttaccatgtttttatttcctctgggaaaacacctatcagaattttgggatcatatgacagatacatatttaatttctttctttcttttttgagacagggtcttcctctgttgcccaggctggagtgtagtggtatgatcatggctcactgcagccttgaccccttcctcgcccccgctcaagtgatcctcccaccacagcttcctgagtagctgggactgccggcatgctccaccatgcccgactaacgttttgctgcttgtagagacagccatgttccctaggcttgtcttgaactcctgagcctcaagcgatccttccacttcagcctcaagtgctgggattacaggcgtgagccaccactcctggctacttaatttctttctttctttttttttgagacagtctcgttctgtcacccaggctggagtgcagtggggtgatctcttctcactgcagcctctaccttccaggctgaagcaagccttccacctcagccccctgagtagctaggactacgggaacattccaccaggcccagctaatttttgtattttttgtagagatggagtttcatgatgttggccaggctggtcttgaactcctcacctcatgcaatccgcctgcctcagcctcccaaagtgctgggattacaggtgtgagcaactgcacccagcgggccccgcccagacctattttcaaaattagaaaaccgtgaggcttctggaagaagatgagaagaatatcttcatgacctgagtgtgtgcaaaggtttcttagggctcaggatgccatagagtcacttaaaaaagcaaaaaaaacccaaaaaaaaaaccacacacacaaagataaatatgattgattacatcaaaatgtaatcacagactactctaagaaaatgaatggggaaacacagggacctatttgacaaaagactgatattcaagataaataaagaactaataggccaggcgcggtggctcacgtctgtaatcctggcactttgggaggccgaggcggggggatcacttgagctcaggagttcgagaccagcctgagcaatatagtgaaaccccatctctactaaaaatacaagaattagaattagctgggcgtgatggcacgtgcctgtagtcccagttactcgggaggctgaggctggagaattgcttcagtcaggaagatggaggttgcagtgagccgagattgtgccactgcactccagcctgggcgactgaacaagacttcgtctcaaaaaaccagtagggctccaggcctgggattgggcctctgctgctctactccctggacgtgtggctccgtccttggagtcggcctttggttttcatgaagagtagtgtgcattaacagctgagtggttttatcagcctgtttcctgccaacagtgtatgagagttccagttgctttacatccttgccagcatttggtgttgtcagtcttttgagttattctgatgggtgtggtgtgtcatggtcttaattttagtcctcagtcactaatggtgtttagcactttttcctgtgcccatgacaatgtgcatcttcctttgtgaagtgcctgctcaaatcttttgcccattttacattgggttgtgtgtctttttattattgagttgtagcagttatttatataacctttatatcctggttacctgtcctctgtctggttgcctattcattttcttagagttgtctgatgaacagaagttttacattttgatgtaatcagttttctcttatattttcttttatagttactgctttctgagtcctaggaaatcttggctaccttcaggctgtgaagataatctttcatgttttcttctgtaagttttttttttttttgagacagagtcttgctctgtcgtccaggctggagtgcggtgatggcgatctccgctcactgcaacctctgcctcccaggttcaagcgattctcctgccccagcctcccgagtagctgggattacagacatgcgccaccatgcccaactaatttttgtatttttattagagacagggtttcaccaggttggccaggttggtcttgaactcttgaccttgtgatccacccgcctcggtctcccaacatgctgggattataggcgtgagccaccgtgcccggcctataaattttatagttttagttttatgtttaagcctatcacccatttctagtttaggtgaatggtgtgagatataattaaatattaatttcttttccatatagatatccagtcattccagcaccatttgttgaaaatactattgtattgcgttttggaaattaagatgactgtacaaatggtaattgatgtctgcactcccttttctgttccattgttcaatccttgtgttagtaccacacttttaattactgtagctttttagtaagtcttgaagtcatgtagttgtaggtcttccaattttgttgttttcaagcttgatgtgaatattctaaatcctctgcatttccatataaatatcagaattatctttaccagttttacagaaaagtctggtaaagttgtgattgggattgcattgaatctatggatcaatttggaaagaaatgacacctaaacagtattgagtcttcaaatatatgaacttggtgcattttccttcttatttaagccttttaaaatttctttttaggccgggtgcagtggcttatgcctgtaatcccagcactttgggagtctgcagcgggcagatcagctgaggtcaggagttcgagaccagcctggccaacatggtgaaaccccgtctctactaaaaatacaaaaattagccaggtgtggtggcaggtgcctgtagtctcagctacttgggaggctgaggcaggagaactgcttgaacttgctcaggaggtggaggttgcagtgagctgagatagtgccattgcactccagcctgggcaacaagagcaaaactctgtctcaaaaaataataataataaaaataaaaattttgggccaggtgtggcggctcacacctgtaatcccagcaatttgggaggctgagccgggtggatcacctgaggtcaggagtttgagaccagcctgaccaacatggagaaaccctgtctctacgaaaaatacaaaatttgccaggcatggtggcgcatgcctgtaatcccagctactctggaggctgaggcaggagaatcacttgaacctgggaggcagaggttgcagtgagccgagatggtgccattgcactccagcctgggcaacaagagtgaaactctgtctcaaaaaaaaaaaattcttttagttctgttttatggttttcagttcagaagtcttatacatattttgttaaattgatttctagatatgtttcttacctttattgtaaaatggagccatcatttgcatcattcattactctgtatgtaatgtgttatcattctctacctgctttcaagattttctctttatttttgttttttagcagtttgtctgtggtgtatctaggtgtcattttatttgtatttatccggagatttattcttgagatttgcagagcttcttaaatctgtaaatttatgtctgtcggccaatttgggaaatttggagctattagttttaaaaatatttcttctgttccattctctttcacttcttctgtatgtgagttcaatttcacttcaattgtatgtgagttagacattttgatattagcccacaggatcctgaggttctttcattcttttcaatcttttttttttctcgaagtttgcatttcgtgagcaggagtgacagtcattcaggatgatttttgagattcctagttcaagagtagttcctattcttttctaggtgtagtcaagtatggcttctaattctactagaaggcttttttgtcggggaggtggttctatgtcctttggctcttacattttctttgtgtctttcacagcacagttttcagagggtaccctttctctttggttttgttttgttttgttttgttttagacggagtcttgctctgtctccaggctggagtgcagtggcgcaatcttggctcactgcaacctctgctcactgctacctctgcctcccgggttcaagcaattctcctgcctcagcttcctgagtagctgggactacaggcacgcgccaccacacccaactaatttttgtatttttagtagagactgggtttcatcatgttggcaaggctgttctccatctcttgacctcgtgatccgcccgccttggcctcccaaagtgctaggattacaggcgtgagccaccgcgcccggccaacagagggtaccctttcattctttttctccttcttcccagaaggcttgcgttttcaagactacctcatcaagttctgcatgtgtttaaaagtgtctctacccgaccttcccttcctccctcccgatttaacggaattctttgttggtgttttcatacttaccgtgagttttctttttcagggtgatattttagttccatcttaggctctccattgtcctcttctctcttctttttttttttgagacagagtctcattctgtcacccaggctggagtgcagtggtgtgatctctgctcactgcaacctctgcctcccaggttcaagtgattctcctgcctcagcctcccgaatagctgggattacaggcgcacacaaccacgcccacctaatttttgtattttcagtagagacggggtttcaccatcttggccaggctggtctcaaactcctgacctcgtgatccgcctgcctcagcttcccagagtgctgggattacaggcatgagccaccgcgcccggtgcgcccagccctcttctctcttctttgcatctctcttcctatctggatccctctttgctgtccttaaagagctgagatgagagattgagaaacatctctacaagaaattgatgtttttctacttatgggtaattagaagcttgtagtattttcagtcttctaagtatgttgaagatatgagacgttggtgattttctttgtttctccggttggttggtctgtgtagtttttggacatgtgtttggatatttggatttatatagctgccataatcttggctatgcaggtagtctttcctgacacttcatcctgaaagatttgaagcctttggacaaattttacagtgggctgggtgcagtggctcacgtctgtaatcccagtgctttgggaggctgggcaggaagattgcttgagcccaggagtttgagaccagcctggacaacatagtgagacccgtgtctctacaaaaaataaaaaatatgccgtgtgtggcgttatacaactgtagtcccagctacttaggaggctgaggtgggaagatcacgagccaaggagtttgagggtacggtgagccatgatcgcctcactgcactgggtggcacagcgagactgtctcaaaaaaaaaatttacaattaatgtctgcatatccttcacctaggttcataaatttgtacttttgctttatctacttgcctttttctctctctctacacacacacacacacacacacacacacacacaattagttgaatgaattgagagtaagttgcagaaaacatgacactttactccaatattgcatcatacaaaatcatacatctagtgataggccattgtcctacagaatcacgatataattatcacactaaccagctgtggtggtgcacacctgtagtctaagctactcgggaggctgaggcagaaggatcacctgagcccaggaggttgtggctgcagtctcatattcatcccatcatcagatttctcccattgtcctaataatattctttatagcttttctttatccctgatccgaaatttcattgaagatcacacagtgcatttagttgtcatgcctcttaagtctttatttatttattatttattttttgagatggagtcttgctctgttacccaaactggagtgcagtggcatgatcttggctcatgcaacctccacccgctgggttcaagtgattatcctgcttcagcctcccgtgttgctgggactacaggtgtgtgccaccatgcccagctactttttatatttttagtagagacgggaattgtaccatgttggccaggctggtcttgaactcctgagctcagatgatccacccgccttggcctcccaaagtgctgggattacaggcgtgggccaccacacccagccttaagcctcttttaacataaaagagttcaccagccattctattttgttttgctttttgagacactgatgctttggagagtccaggccagttgctttgtagatttcaacttgtttgattgtttcctgatgattaggttggtagaaatactacctcaatgatgggaccttcttagtgcgtccatcaggaagcacatgatgtgactgtaattggtgacattaagtttgattccttaataattaaggtggtaactcccaggtttctacattgtaaaggcatcttttgccgccctcctttttattcccaagtagtttatttggagattagtcctttacacagtagaggagcggggaagggagacaggaaaggaaagtttgacaacaaagggtgagttttcaagcctgttgccacgggggaacctaattccactggagaagctcatggcttggtgatgttccacagaggggtcagaaatttagcgtatttcaacaccagctcctgtcaggcaccatttgagggctgctgccagggtggttcaattttctggtgcttacagcttgccataaacaggtgcaaagtagtctggataccaaagaaagctctcaggtaacaagatgcagatgttggcatttggaagtcagaatagggtgcactattgtggtaagagctgaagggatggctgggcgcggtggctcacacctgtagtcccagcactttgggaggatgaggcaggcggatcacctgaggtcagaagttcgagagcagcctggccaacatgacgaaaccccgtctctactaaaaatacaaaaattagccaggcgtggtggtggatgcctgtaatcccagctattcagtaggctgaggcaggagaattgcttgaatctgggaggtgtaggttgcagtgagctgagatcacaccactctgcactccagcctgggtgacagagcgagactccgtctcagaaaaaaaaaaaagctgaagggatgctgagtagagcatccgtagtgtctgctatacctgggtaccctagaacctggagaacctacagcttgaggcaagagcgtatgtgctattattttttcaagaagtgtgctctcaggaagcagaggtaggggaaaggtgagtgaagggagaaggaagattaagtcagttcaagggtgcattttgaagttggttgcccttggtgcaagtacagttggttgcttgttctcctaaagctgtctcccaggaggatgtatacataactgcattccagggcaatccatctaaaggaagggtggacggacccctcagcttctgtatctcactggaaaaaggtttgcttcatggcacattaattcccatagacttctaggttgtacatgtgtgggtaccaggtgggtcccacagacccttacacctccaaggcaagcggcaagccacgggtgggaagtgataggtacccagtatgagcaggaggtaagggaccgtggggttgtgcctgtgggcagttggttataacccagacgtgtttgatcagcccagtgacagctggagtggacaaagtgaccaagggcctcaaggacacacaaggccaagaagatttgaagtgctgtgtaagatatgcctaatgcatttggattctacctttgtttaacgaatatgcacacataaaaaacacttgaactccttgagcccaggagttcaagaccaacctgggcaacatagtgagacactcatctctaaaaaaatttaaaaaaaaattaacctggcatgatagcactcacctgtagtcctgtctactctggaggccgcagtgggaggatcacctgagccctggaggtcaaggttacagtatgctatgattgcaccactgcattccagcctgggtaacagagcaagacgctgtctcttaaatttttttttttttttttttttacttttataatggaaaaaccattgtagacagttttaggaaggaaagcagaatagtaagacatctttttcaaagtaaaagagcaaaaaaggcaaaaaatatttcacatttactttatggacaaagataagattgtccttcaataaaagactgaattttttttgtttgttttgttttgttttttgagaaagagtcttgctccattgcccaggctggaatgcagtggtgtggtctcggctcactgcaacctccgcctcccgggtacaagcaattctccagcctcagccccccgagtagctgggactacaggcacgcgccactgcatctggctaagttttgtatttttagtagagatggggtttcaccatgttgaccaggctcgtcttgaactcctgacctcaggttatccacctgcctgggcctcccaaagtgctgggattacaagtgtgagccaccgtgcccggccacaagttgctctttaaatgtgagaagtgttctggcatggtggctcacacctgaggcgggtggatcacttgaggtcaggagttcgagatcaggctggccaacatggtgaaaccccgtctctagttatttatttatttatttatttatttatttatttatttttttgagacggagtttcactcttgtttcccaggcgggagtgcaatggcgcaatctcggctcactgcaacctccgccttccgggttcaagcgattctcttgcctcagcctcctgagtagctgggattacaggcatgcaccaccacacccggctaattttgtatttttagtagagacggggtttttccatgttggtcaggctggtctcgaattcctgacctcaggtgatctgccctcctcagcctcccgaagtgctgggattacaggtgtgagccaccacgcccggccctgtctctactaaaaatgcaaaatttagccgggcatggtggcgcacacctgtaatctcagctactcaggagactgaagcagcagattcgcttgaacccaggaggtgaaggttgcagtgagctgagaccacaccactgcagggcagcctaggcgacaagagcgaaacgcttacaaaaaaaaaaaaaaaaaaagattcacaggtgatggtgatgctgctggttaaggaagtgaagtggctttttgctctgtagccttcctgaatgttggggcctcctgctcttcatttgtttcatttctattaagtctcctccctccagctatcttgttagctcctggaaagcatttcagtgattgtggcttctatttctttttgaccccacagtgtccagggtcatgctgcctatatagtagtgagcagtaagttgaggtttttaaaaactttattattattatttttgagatggagtcttgttctgtcacccaggctggagtgcagtggcacaatctcagttcactgcaacctctgcctcccaagttcaagtgattctcctgcctcagcctcccgagtagctgggactacaggcgcctgccaccacatccggctaatttttttgtatttttagtacagatggggtttcactatgttggtcaggctgatctcgaactcctgacctcaggtgatccgcctgctttggcctcccaaagtgttagggttataggtgtgagccaccacacctggccggtttttttaaactttaaaacagattcacttgatttttcttccctaccccccagcttttttgaggtatgactgacaaaaattgtatatatttagggtgtacaatgtgatgatttgatatgtgaatgcactgtgaaatgattaccacagtcaaggtaattcacgtatccaccacctcccagttaccctcttagctagtacaggttgggtattgcttctctgaaatgctttgggaccagaagtgttttggacttcagattttggaatatttgaatatatataatcagatatcttgggaaggggacccaagtctaaacatgaaattcatttgttttcagagcctaaagatgattttttttttttttttgagatggagtctcactctgtcgcccaggctggagtgccgtggcacaatctcagctcactgcaacctctgcctcccaggttcaagcgattctcctacctcagcctcccgagtagctggaattacaggctcgcactaccacacccggctaatttttgtatttttataaagacatttcaccatgttggccaggctggtctcgaactcctgacctcaggtgatccgcccgcctcagcctcccaaagtgctgggattataggtgtcagtgactgcgtctggctgataattgaatttttctcttggagaagctgaataaactgtgtgttgtgtgcctgcctttttttttgtttttttttttttttgagacagagtcagacactctgtcacccaggctggagtgcgatggggtggtcatagctcactgcagcctcaaactcctgagctcaagcgatcctcccacatcagcctcctaagtagcatagcaccacgcctggctaatttttaaattttttgtagtgatggggttttgttgtctaggctagtctcaaactcctgggctcaagcagtccttctgccttggcctcccaaggtggtaggattataggtttgagccaccatgcctggccattacctgtgttttgactataacacatcatgttggcactcaaaacgttttggattttggagcattttgaattttggatttttggattagcaatgttccacctatagtacattttttgtttgctttcccataaagaattttttgtaattttgattttatagttctaaatgtaatatattcttattgtaaaaatcacctttaatagcaccgccagaatagcaaacatgttaacagaaaggtagaagtagaccttaaagaatcttcagcagcttgagagaccacagctaaccactgaggaactctgttctggattggagcagtgcttagaagcttataaataactcttagggtattgcatagggattcttttttttttttttttcctgaaatggagtctcgctctgtcgcccaggctggagtgcagggtgtgatctcagatcactgcaacctccgcctcctgggttcaagcaattctttgcctcagcctcccgagtagctgggattacaggcgcctgccaccatgcccagctaatttttttggatttttagtagagagggggtttcaccatgttagccaggatggtctccatctcctgaccttgtgatccacccacctcggcctcccaaagtgctgggattacaggcatgagccactgtgcctggccgcataaggattctttatgtgatttttcagtagaggctcttgccttttactttaaacattctttgagggttgttttttttttccgctttttatttatatagaggtcaaccagaatcaagatgtctgggactgaggaagcaattcttggaggacgtgacagccatcctgctgctggcggcggctcagtgttatgctttggacaggtaactgtggttccttcatgccgggaaagaatgaggtgaagtgagtaaagttagggcaaggcagtttgtagagcatcgtagtacatgtgtgagcagtacctagtacgtttacctagtacgtgtgtgagcagtacctagtacgttgacgcggtgcgtgcgggggcagtacctagtacgtttacatagtacatgtgtgagctatttgttattggtttttcctttagatgcattttttgggagtcttgtgaactctggagggcattttggaatgttagctatcaaaagactgatagtactggggattagatttagattttaaattttttgtggggggggatagataacatatttgtatgacatcaaattcaaaatgaaactgtgaaaatctccctatttcctattgcccctgtgtgcatgccacccagttctatttcttttttttttcgagactgagtcttgctttgtcacccaggctgcagtgcagtggtgcgatctcagctcactgcaacttccaccctctggattcaagcaattctcctgcctcagcctcccaagtagctgggataacaggcatgcaccaccatggccagctaatttttatatttttagtagagatggggtttaaccatgttggccaggctggtctcgaactcctgacctcaggtgatccgcctgcctcggcctcccaaagtgtttggattacaggcgtgagccaccacgcccgggcttaatttttttgtatttttagtagagatgtggtttcaccatgttggccagggtagtcttgaactcctgacctcgtgatctgcctgcctcggcctcctaaatgctggaattacaggcatgagccaccgcgcctggctccagttgtctttcttggaggcatggaaagttactgggggtcctattccttgtagggacattgtgtgcacagaaaagagtttcttgctttgtccacccaaactccatctttgtctttagcagagagttgtgagtattcatctcatccgagcagggcaagggggacaaaacccaaatcagcaagcagtagtgtgtttctgtttgtgcaggatgggaaattgttgtattggagaaggcgtcaatctctggaaaggacaaatggaagcaaggcttcctacccccgtgctctttccgtacttgcttcctgtgctgacgtcatttacagatctggaggcagaacattttagcttcctaagcttcagaaacatttataaggatggtagcagcagctaaggcagcagttctcaaaatgcagttctcaaaaaccctggggtttctgaagatctttcagagtccagaaggtcaaaattatcttcataataatactatttgcctctttcacactcattgtctcatgagtgaatggtagagttttcagagagtgcatgatatgtggtgatgtcactgctatgatgcctaatggcatgcatgccttaaaagtttctcagttttgattcctaataggatacatagaacccacataaacaaaggttctggggggtctttttaagagtataaagtctccataaaggatggagactcaatgatgtgaggaatggtggaagtgtgaatttaattttcttttttggggttgcagtgccagtacacagcagaagagtaccaggccatccagaaggccctgaggcagaggctgggcccagaatacataagtagccgcatggctggcggaggccagaaggtaggagaattcgtgtgcctggaaagcaggcatccataccgcagactccgatggtcttgccagttccctctctgggtcctcagggattcggaagtctgctgttaactgttcctggaggtctcccagtgcccctgggaggggatgggttccagacttcattctcatccgaaggggcctgggcatggtcttgacactcgcataaccgccgtcttaagatttttacatcatctttttttttttttatttttaaagacagggtcttgctctgtcacctaggctggagtccgaccagtggtgtcatctcagctcactgcagcctccacctcccaggctcaagcgatcctcctgcctcagcttcctgactagctgggactacaggcacacgccaccacacctggttaattttttaatgttctgtagagacgacatctcgccatgttgcccaggctgatctcgaactgctgggctcaagtgatcctcccacctcggcctcccaaagtgctgggattacaggtgtgggccaccatgcccagcctttacaccattaaaaaaaaaatgttccttttgccatttgctttttttttttaattaaacactttttaaagaacttatgattgacacataataattgcatatcatttgcttctaattttaacttctgtgtatatttttggtcttccataaaatatgtcaaacagatttgtactttttgcaaactgaattttagcaactgctgggtgagttcctcctcccaacagaccattcgttctcgcgggctccatctagaagatttttgaaataaattcattgagaattttcttgaaaaaaaaattttttttaacagactggttctcactctgtcacttaggctggagtgcagtggcacgatcctagcttactgcagccttgagctcctgggctcaagtgatcctcccacctcagcctcccgagaagaatgtttaaggacagtttatcgaaaaaagtagatgaggaataaattatgtcaattttgattcacatttaagtgtggtaaggaattaacacagcttttccttaaaaacatttgtttttctaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttgtggcccagcggtcagtgtcctcttcaacttgctctctttcccactcctagattttgttgacctcaacaatggcaagttctacgtgggagtctgtgcatttgtgagggtccagctgaaggtgaggggatggagtagacctgctgcccggaaggatcagtgggtggtaggagaaggtgagcaggtagggaagtaggtagctggacggggacccaggctccagagttgtgtctcagccagcgttccctagagtggtggaattcaaatactcttgctcatgtgctccctaaaagaatggaaaaactgttctcttgcacatgttcaagctgacacctaaaagttttcaccatatataaaaattgttgcaaaggatgtattttttggcatatggtaaaatctgacattttaaaatacaataattttaccatcactgataagtgtttggaaactcaactttaggcaaagcaggtccttttgttataacattgatgaaaacaaaaatatgttttgttaataagttgtttcacttcaagtcacagttatttaaggtgttaagtgagcacttaccgtaaatctgttgaatcttgttaaatattccagtggactctaaatactatagaggataagatctatcatttatttgaagaaatacaatgaacaagcttttttttaatcattagaaattttacattgttctttctttatctgaactcatatttctattctatttccccactggttttaatcctaatacatatttatggttgaaagtttggctaggcggggtggctcattcgtgtaaccccagcactttgggaggcccaggtggaaggactgcttgagcccagggatttgagaccagcctgggcaacatagcgaaagcccgtctctactaaaaatacaaaaaattagctgggcatggtggtgtatgcttgtagtcctagctactcaagaggctgaggtgggaggatcacctgagcccaggaagtcgaggctgtggtgagctgtgattgcgccactgaactcctgggtggaaaaaaagaaaagttttatcggtagccttactgtgcttctctgcctttgcctgtgtataaaaataaaaatttttggtaaattttcagtgcacttaaggctctaaatattaaaatatttcttttggatttagttatattatagctactgttaacacacaattgaccagacaattgtgtttatggtgaagagaaaacataaatacagcaaaattttgatacttagaaaaattaaagatatgaaatcttgccacaaaaataaaaaatttaaaatataaaatttatggaaaatgtatatcttaatgagatggatggtgctgttttttcttttcagttagtttatatatccatatatccataactgaatattacttacttcttttttttttttgagatggagttttgctcttgttgcccaggctggagggcaatggttcaatctcagctcaccgcaacctccacctcctgggttcaagcgattctcctgcctcagcctcccaagtagctgggattacaggcatgcgccaccccgcccgcctaattttttgtgtgtgttttcagtagagacgcggtttctccatgttggtcaggctggtctggaactcacaacctcaggtgatccacccgccttggcctccaaaagtgctgggattacaggcgtgagccaccgcacccggcctacttatttcttgaatgaacaattcagcattaattctattctgacttatttttctaaatagtactaaaaaatcttgtatctatgagtgagtagctgagaatggaaagaattgtgttatagtgtcactcatttatttgagtgctttctgagttattttttaaaaatcacagagcgctgtcatcaaacattgtatttaattctcaatcagcgaatgatgtgctcaggtccaccttctcttttggtgagaggcaggagctggacgccacctgatttacaaagggtttgctctcccgtccttacagaccattagatccagtgttcaaatcatccctttgtttcatatcccagaggtttttttttttccaagacgtagtctcactctatcacccaggctggagtgcagtggtgcaatctcggctcactgcaacctctgcctcccaggttcaagtgattctcctgcctcagtctcctgagtagctgggattacaggtgcccaccaccacacccggctaatttttgtatttttagtagagatagggtttcaccatgttgaccaggctggtcttgaactcctgacctcaagtgatccacctcccttgacctcccaaagggctgggattacagcgtgagccaccacgcccggcccggccatcccagaggttttttttaccttagggtgatgcacactgataggatttggggtgagtttctaatgtgccctttgtgtgttgggaagttgggaagggaggatcgtcttgacaccttgaccacaggcacatgtccaggcagcccaggtctaggaagcagcactcgcgatggattctcacccagccttctgcccgtgcccctgtagcaaggccgccaggtgggagagtccggctttgaaccctgctgcttgaggaacaggggagttgtggcacgcctgccgctctcgtgtttgagttcaaactccttttctgcccccaggatggttcatatcatgaagatgttggttatggtgttagtgagggcctcaagtccaaggctttatctttggagaaggcaaggaaggaggcggtgacagacgggctgaagcgagccctcaggtgagcgcggggctgggagtctaacctgcgtcatttcagctcttgcttcagagcagatttcgattttttttggaagaggtaacacatccacatggttcaaaaatccaagcagcgtggaaggtaattctcacccctgccctggttcctgtctgccgttttcccactttcgttagtattttttcaatgtttctgtttcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggtagcatagttaacttagttacacagtcacgcagatgtccgtgttagtccatttatgttgctatacaggaataccagaggctgggtaatttataaataaaggaggtttgattggcttatgattctgtggactgtactggaagcctggtgccagcatccacttctgctgaggcctcaggaagcttctaatcatggcagaaggtgaagagggaacgtggagagagagggagcaagagagagaaggaaggagtcccaggcttatttatttattttattgttgtttttcattttttgagacagggtcttgctctgttgcacaggctggggtgcagtggtgccgtcatcgctcagtgcagccttgaactcctgggctgaagtgatcttcccgcctcagcctcccgagtagctgggatcacaggcacatgacaccacccccagttaattaaaaaaaaatttttttttttttggagagacagggtctccctttgttgcctaggctggtctcaaactcctgggctcaagtcatcctcctgccttgtgcctcccaaagtgccgggatcacaggcatgagccatcatgcccagcccccacactcaaaaccaccagatctctcatgagctgagtgagaactcactcaacaccaaggggatggcactaagctgtttatgaggaatccagccccaggatccagtacctcccaccaggccgcaccccccggcattggaggtcacgtttcaacatgaaatttggaggggataaacatccaaaccatatccgtgtctttgagaattgaagtgaattgaaccagaaaaacctatgagttctgtgggggagtccgtagatcccaagttaagaactctggtcatgggaggttgtgcccttgagcccccggtccccaagtgtgtgttgcctactcctgctgggaaattggagcagcctttggggggaaaaaaaagaaaaactctctgcagtttgttctccatgtcaggaggtggctggtgggttttgtgaatggcgccgtaatcttttcatactcatcttctctgtgagggcagggacttgtgtcttgtcctcactgcagtattctcagaaactaacacagtgcaggaacatgctagatgcttaccagacatcaatggggaatgcatgttagggtccacttcctctgctgctcctgagaagcaacctgtacaaaagttgtaattctattctctgatattcatgtgtaacaattcttaaccctgtttcacctttttttctcttgcccttaggagttttgggaatgcacttggaaactgtattctggacaaagactacctgagatcactaaataagcttccacgccaggtatatcagacatggatgagtggagtgaagataatgcggcaaactcttgtgtgtcatgggttgagtatttggaggatgcaaggagaaaaagtgaggactcagctctttagagggtcgggaatgttgatttcagatttcgaatgttagagacagcaggaactaatcccaacattttccttttttctaaagtacatcatgtgggccggggaccgtggctcacgcctggaatcccagcactttgggaggtggaggcaggtggatcacaaggtcaggagatcgagaccatcctggctaacacggtgaaaccccgtctctactaaaaatacaaaaaattagccgggcgaggtggtgggcgcctgtagtcccagctactcgggaggctgaggcaggagaatggcgtgaacccgggaggcagagcttgcagtgagccgagatggcaccactgcactccaacctgggcgacagagccagactccgtctccaaaaaaaaaaaaaaaaaaatcacaccatttgacaagaatgtgaggtctagagaatttgtgtacgtgtaggtagtgaactgtggttgggggtagtctgtgaagcctcaaagcaagcacacagccctctgcagcaccactgtccttcccagacactcccagcctcgctgttgagccttctttcttttccttagttctggtgtcattacatgtctgatgtcattacaatgtcatttacatgtccattatttctgtcaatacctataacgtgatctgagcctttgcctttggagaatggggtctgtggtggggcagccctggagtcacactgccttgccatgagtggcttctggagtgttcctcctgcctcatctgctctccgaggtccctgccatgtcgctccccagggcagcattcccatcctgtgcctgagggattcttgtcctcatggagccccacaaggtgtgtgtcactgggcatctgtaaaaactcctttaaaaaaatcatttttaaacattattggattcagtttgctaatattttgttagacttttttttttgagacggagtctcgctctgtcgcccaggctgaagtgcagtggtgtgatcttggctcactgcaacctctgcctcctgggttccagcgatgctcctgcctcagcctcctgagtagctgggattacaggtgtgtaccaccacgcctggctaatttttgtatttttttagtagagacggggtttcaccatcttggtcaggctggtctcgaattcctgacctcatgattcgcctgcctcggcctcccaaagtgctgagattacaggcgtgagcccccgcgcccggcctttgttaggcatttttgcatctatgtttatgagagatattagtcaagttttctttttctttttttttttttgagatagtctcactctgtcgcccaggctggagtgcagtagtgtgatctcagctcactgcaacctctgcctcccgggttcatgccattctcctgcctcagcctcccaagtcgctgggactacaggtgccagccaccaccatgcccagctaatttttttatttttagtagatggggtttcgtcctgttggccaggctggtcttgaactcctgacctcaagtaatccgcctgcctcggcctccgaaagttttgggatgacaggcgtgagccaccgcacccggccttttctttttttaaattgtagtaaaacacatcacattttaactatttttagtgtgtggtcgagtagtgttaagtgtattcccattgttgtgaaattgatctgcagaactaagaccctgcacccgtaaaacaagaactccgcatttccccctttcccagacccttgtaactacttccactttctttcctttttttttttttttaatttattttatgaaagatgaggtcttgctctgtcagccaggctggaatgcaggagtgccatcataattcactgcatccttgcactcctgggcccaagggatcctcctggatcctcctgcctcagcctctcaggtggctgggactacaggtatgtgccagtgcacctagctaatttattttttaaacaattattactattttttttgtagagacagaatttctcagggctggtcatgaactgctgggctcatgtgatcctcctgcctcggcctcccaaagcgctgggattgcagcgtgggccactgtacctggagccagctaattaactttttttgggggcttttttttttaagaggtgagttcttgctatgttgctgaggctggtcttgatctttttttcttttttaaaaaattaggttaggcgctgtggctcctgcctataatcctagcactttgggaggccgaggtggttagatcacttgagcctaggagtttgagaccaccctggccaacatggtgaaaccctgtctctactaaaaaatacaaaaatcagctgggcatggtggtcagcctgcctgtaatcccggtggtcagcctgcctgtaatcccagctcttctggaggctgaggcatgagaatcgcttgaacctgggaggtggaggctgcagtgagccaagattgcactactgcactccagcctgggagacagagtgagattctgtctcaaaataataataataaaatataaaaataaaatacttttttgtgtgtggtcatggagttttgctattgcccaggctagtctcaaactcctggctacaagcgatcctcccactcagcctccttaagtgctgagattataggtatatgtgtctactttctgtttctgtgaatttgtctactctggatacctcatataaatggaatcacataatttttgctttttgtgactggcttatttcacttagctagcattaatgcctttaagattcatccatgtagtagtgtgtatcagaattcccttctttttgtggctgaatattctgttgtatatatagaccacattttgtttatgcattcatttggtgatggggatttgggttgctttcaacctcttggctattgtgaataatgctgctatgaacgagggtgtgtaactctctttgagatcttgctttcaattcttttagacatattctgaaggggattgctgggtcatggtaatcctatttttaatttttcgaggagctgccacactgattttcatacagttgccccattttaccattccaccaacagggcacatgagttcagatttttctaaatcctaaccagcacttgttattttctgagtttttggttttttttttttttttttttttttaagccaacctaatgggcgtgatattttattggggttatgatttgcataccccctgatgattagtgatgttgaccatattttcttttttgagacagaatctcactctgttacccaggctggagtgcagtggcacaatcttggttcactgcaacctctgcctctgggttcaaacaattctcctgtctcagcctcccaagtagctgggactataggcgcctgccaccatgccgggctaatttttgtatttttagtagagatggggtttcaccatgttggtcaggctggtctcgaactcctgacctcaggtgatccgcccgccttggcctcccaaagtgatgggattacaggtgtgagcccccgcacccagccaaccatattttcatatgcttgttggccatctgtttatcgtctttggagagatgtctattcaagtcctttgtcattttattttgttttattattttaatttaatttcttttattcatctcatctcatctcatctcatgacaagatctcgccctgtcacccaggctggaatgcagtggtctgatcatggcttggctccctggagcctcgacatcctgggcttgagtgatcctcccacgcaggctggagggcagtcgtgtgatctcggctcactgcagcctctatatcccagactcaaatgatcctcctgccttagcctcccaagtagctgggactacaggcatttgccaccatgccaggctaatttttttattttttgtacagaatacaaaaaattttaccgtgttgcccaggctggtctcaaactcctggcctcaagtgatccacctgccttggcctcccaaaatgctgggataacaggcgtgagaaacccatatggcccaactcctacttttattgagctttttcgtattgtttttgtattctctctttcacttatgtttgctgtcatctttttagaatttcctttcttctagctttgggtgtaactttttttttctagttctttgaggtatagcgtagatttgagatcttttttttttaactatgtgtgtaacttccctcttacgacttctttccctgcaccccagaagtttggtaggttgtgttgtagtatcatttgtctctgggaattcttctaagttggcttgttacatttcctttgactttaagagtgtggtgtttaatttctactgatttgtggattttccagttttctttttgctgttgatttctagtttcattccattgtgattgaaaagatactttatatgatttcaatcttgaatttgttaggacttgttttgtggcctaacatgtagtctgtcttggagaatgttccatgtgtacttgagaagaatgtattttctgctattggtgggtggaatgttatgtatatgactgttaggtccagttggcctatagtattgttcaaatactctatcgccttattcatcttttgtttggttgttttatctattattgaaagttgagtagtgaagtctcctactattattgtgttgcttttatttcaccttacaatcctctcaaagtttgcttcatatatttaggacctctggtgtttggtgcataaatatttataattgttatatcttcttggtgaattgacattcttttttttttttttgagacggagtctcactctgtcgcccaggctggagtgcagtggcggtgcgatctcagctcactgcaggctctgcctcctgggttcacaccattctcctgcctcagcctcctgagtagctgggactacaggcgcccgccacctacgcccggctaattttttgtatttttagtagagacggggtttcaccatgttagccaggatggtctcgatatcctgacctcgtgatctgcccacctcggcctcccaaaatgctgggattataggtgtgagccactgcacctggctgacattcttatcattatataatactctcgtctcctataacaattttttttttttttttgagacggagtcttgctctgccgcccaggctagagtgcagtggtgcgatcttggctcactgcatcctttgcctcctgggttcaagcagttctcctgcctcagcctcctgagtagctggaactacaggtgcgtgctaccatgcccggctaattttttttttttttgagacagagtttttgctcttgttgcccaggctggggtgcaattgtgtgatctcggctcactgccatctctgcctcccaggttcaggcaattcttctacctcagcctcccaactagctaggactacaggtgtgtgccaccacacccagctaattttttgtattttgtagagagggggtttcaccatgttggtcaggctgatcttggactcttaacctcagatgatccgcccacctcggcctcccaaggtgttgggattacaggcgtgagccaccacgctgagcccagatttttttttttttttttagacagagtcttgctctgtcgcccaggctggagtgcagtggcgctatcttggctcactgcaacctccgcctcccgggttcaagcgattctcgtgcctcagcctcctgagtagctgggactacaggcgcccaccaccacacccaactaatgtttcgtattttttagtagagcggggttttgctgtgttggccaggctggtctcaaactcctgggctcaagtgatcaatccacctgccttggcctcccaaagttctgggattacaggtgtgagccactgagcctggccccaaatttctctttttttgttgttgagacggaatttcactcttgtcaccgaggctggagtgcaatgttgtgatcactgcaacctctgcctcgtgggttcaagcgattctccagcctcagcctcccaagtaactgggattacaggcgcccgccaccatgcccggctaatttttatacttttagtagaaatggggtttcgccatgttggccagggtgatctcaaactcctgacctcaagtgatccacctgcctcagcctcccaacgtgttgggattacaggcatgagccaccatttcctaagtgagcacagctgtttacctcccagatagagaatcagacctttaccagcagcccagaagccccattttgccctcttccagtcactgccttgctttccttttttcaaaagtaactactatcctgtcttctattctgacttccatggattattttttcctgtttttgaactttatatatgtaaagttcacaaatggaattgtactgtaagtggaattgtacagttcatattttaagaaaattgaccgaagtatgaaaaagaacatatagacaggttagacgagtgcacgtatcatccatgctcagcttgatgaattttccaaccaaacacatccacacagccaacatctgaatcaagacactgccagtaccgagaaggcccagctgtgttccttgcagtcactgccatcccctgccctccttcccactctgagcaaaccgcttttaacaacacagattggccgggtgtggtggctcactcctgtaatcccaccacttgagaggccaaggaagaaggattgcttgagcccaagagttggagaccagccaggacaacatagtgggaccctgtctgtacgaaataaaaataaaaataaaaataaaaattagctgggcctggtggtggcgcctgtagtcccagctgcttgggaggctgggctgggagaatcatttgagcctaggaggcccaggctgcagtgagctgtgattacgccactgcactccagcctgggccacagagcgagaccctctctcaaaaaacaaaacaaaaaacaaagaaagccaccaatttgtttttattgttatgtacttttttggaatcctacagtttgaactctttgtatcttacttgaattcagcatggttgtgagattcattcatggtacgagcagcagtttcattgctgtataattttcttttgcatgagtatgtggcaatttatttttctagtcttttcttagtagacattttggtttttgtagcttgtggctgtttcgattagagatgctgttagcattcttttgctgtacagttgcactcatttttgttgggaattattgggggagaagataggtacgtgtttagttttagtaggttcttcccgttttcctgtatggttgtattaattcacaccccacgtggcattgcgtaagttccaattgttctgtatctttgacagcacttggtatcgccagtctttcatatttttcaaagctcgtttcttttttttgagacacagtcttgctctgtcgcccaggctggagtgcggtggtgcgatctccgcccactgcaacctctgcctcccaggtttaagtgattctcctgcctcagcctcccgagtagctgggattgttggtgtgtgccaccatgcccagctaattttttttttttttttttgtatttttagtagagacaggctgttactcaggagttccttcgattttttttttttgtatttttgtatttttgccattttggccaggctggtcttgaacccctggactcaagtgatctgcttcggcttgccaaagtgctgggattacaggcatgagccaacgtgcctggccaaagctcatttctttttaaactactcatttatctttcaatgtagacatgaaatctgcactataattttcattttcaggtcaaaatgtaatcatcttaatccctcatattcaaacaattattccatcagcatcagttttatgaattgagagatgttttcccaagtaaaaatgttctggatttctgtaggaatccgtgtggaaatgaaaccatttgccctgtgccacgcagcacaggactgtcccttctcatgttgatgagatgcagagcagccccgttctggaagattccttgcagccttggctggcagccggcgtccgtgcctcccaagggttcttccctctgtcgtttgaagggttcttcgtgatgccacagcgtgcccgaggctccctcagtgacgagcgcgatttgcaggggtggccctggcagaaagggttgggaaggtacagacctccacagagactgtgtgtgctcatttccgtggaaaaaggacaaggaggcagcaaagacagacccagcagcccaggaaagattcaaatgcgattttacagaacatctgccctaagtcaaaaccaaagaaggattcctttttatcaaaacttcactaacacagaacatgaaattgtttggctcctcctgctcatggagttacaggacctagaaggcgtgatggatggaggatgtcaaatgcgattttccaggaatcgcaatctgtgagtcagggagaagcagcggagggcaagagccagttgaaggaatttgtttttcttctttccttctagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccggtatgcggcctaagtcccctcctttcctctgcggcccctcctgtgtcacggggctgcctccactcaggcctccagagccagccagccgtgcgtgtcctcccagcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgagggtgagcgaggggtgggagcagggccctgggaggcgtctgcaggaggaagtgtagccgcagggtcttctgattctctgcggtaaccctgggccggctccaaaccaggcctcgctgggacttctctcaagctacacgcaggagagatgagcccaggaaattcagatatttaaatctgctatacattttcccgtttctaaagacaatgatttcttttttcccccgtggaactaagtgggccttgataaaatcttctagaattagaaatttcagggtaaagaacttttttttgcttcgaatgctttggccatctctacattagaaagccttggccgggcacggtggctcatgtccgtaatcccagcactttgggaggccaaggtgggcggatcacgtgaggtcaggagtttgagaccagcctggccatcatggcgaaaccccgtctctattaaaaatacataaaaattagccaggtgtggtggtgcatgcctgtggtcccccctactcgggaggctgaggcagaattgcttgaatccagaaggcagaggttgcagtgaaccaagatcgtgccactgcactccagcctgggcaacagagtgagaccctgtctcaaaacaaaaacaaaacaaaaaaaaaacaagccttgtgtttctgagatatcttcgaatacaaggcaaaattgggattgagaataacgggaacttttggcagattatttatcaactttagtttatttcagagtccagattgagtgggaatagtgatacagatgccttctttctttcttctctgtctccccacctgttctctcctgcccatccagcggtaggtagtccttactcagagagtggaaacagagaaagggcttgtctcagacccatcgagcttttgcccagtttttccctacaaattgtgaagcagattcacagaggacttgcttcatggttggttcattcatatgcccctcagcaccgacaggctgaaattaacataaaaaccaaaacagaaccacttcctgtcctgtggatatccttactgttgagttattgcaggtgtttagcttcttaaccattgcagaagctcccgggtagattgtggaggaagctgccctccaggcctttcctgccccttggcagacaacccgagccattgttattttaatccatttcacacatcagattttggctgaagattttgtttgttggtttgttttcagacagggtcttgctctgtcacccagcctggagtgcagtggcgggatcagggttcactgcagctttgaccttcctgagctcaagtgatcctccttcctcagcctcctgagtggctgggactacaagtgcatgctaccacacccgctgatattttattttttgtagaggtggcgtctcgaattcctggtttcaagcgatcctcccaccttggcctcccaaagtgctggggttacaggtgtgagccactgtgcctggtcagattttagtttaagattttgtttgagcaagggttatggctgtaacaagcgagccagacactggattagatggcctgtgagaaaccttttacttttgctgtgaaaggagaaagaaacttgtttttcccactggtgagaagaattcaaaccacagacagatctgtaggtaggactgggactcgggaagctgaagttctttttactggcagaagcagcgcagccctaagcggtgttgtgcttcggagagtgttccctctaacaagaggggagtggacccacgctctgaaatcccatgcagtgatgtgatgatgacttgtcctttctctcctctgtgaaccgtagcagcgcctccggcccctcctgtgacgcacagcactcctgtaactgtctcagaaccactcctggagaaagacttccttgcaggagtgactcaagaattaatcagtaaataccttgaaatgcttgtaagctactgtgctgtatgtttctagtagccacagaataccttttaggcgacataaaaatcctcattttcgtgtggttttgttgagggggttctggctgatagcatatgtccagttcctctttggtcctaaccaaagggaagtgtacttttagggggaggggagagaaattccaaaaactttcagaaggtactgaagacatggaatttctgagggccagtttttccagtgctttctgtgagaatacttcattatttgctgatgacgcacttttccttgacctctgtagagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggtagcagagaggtgtttaggcacaaaaattaaggggagatcctagctttaattctgggaatttttgaggaaggatgacatttcatttaaagtttgatagaatcgggaacttctattagggaatggtactgcaagtagaacagaattgatttaagagccagaacgtttcctttgggctcctgacttcaggtgcagcccttttcagctcctgataatagcaggaagcggaaacgactgcatggagagctgtccctcccagcagcaggtctgtcatgagcacgaggccacttggtctaggagaatcatctgccttcctcctaacagtaattctcattcttgggcttagtctaaattaggatcattaatataatccagaaatcattagctgtcagtttattttaaaattatggcagctacatttaagccattttgtcttccataggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccagccaatttaataatttttttagacgtattattttgggctgggctgtggctaatcttgaagcagtgacttcctattttttggctcagacccatttgggaagctgtgaacctgagataaggaagtctgaaagtactagccggcagccgaccgtttctattcctttcgaagttaaggagacagcaaaggagctcccaggaattagggatccagttataaattgcacttaactcaaaatagtgccaatgagaatgtgaaggaatcttctggaaatgaaaccccacagctcaacaaaagcaagtttggtttatttgaatggtttcattaaataagtctacaaaggtaacaaactgaagcacaaagcgcaatcttacaagaagcgcaacacccagagttagtgcaaaatgtacaattaacggctgctgagaaacccccaaagtttgaatttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccctttctcagctactcagccccttgttggttctatccttactctctccacaagaaatacaagcagagaataaataaatcattttaaagcaggggtggaagcccttgcccttttcctttctaccttttaaaaaccttcagctctcatttgcatatttagggccgtagaccaacttacttacttattaagggaagcagggcccttaaggaatgaacagggtacaggagcctccagcctctttctgtggtagtggtggtggtggtggtgattcccagaatatgccattgacgtgggtaaaaggttggaaatattttcagtttcccaactaagagtcaagaagcaccccaaaattaagagtcctagcttctttctttgtcttcagagataacaaagatcctaaacatagccagttaggacagtatttccggaaagctctgaaaataattaataactacccattacaaggaggcatagcactgaataacactgattggttgcagttattacttacggggagtattatttatttgaaaatgtgaacatattagttgtacttctagaaataaaggtggcacaatagattatgatcctgcaaccatttggacatcataaaggaaatgagtaggaataagtattctttcctagaatgattaattcagatgtggaaagatagatagattaactttccacaaaatgtagtaccccaagctgagaaatgcatggtacatgtgcaacaagaggaaagcaatccaaacagtttttctgagagcaattttctccatctgtgacttttcactatcaggttccccaacttgaaaactagccccccacccccttctctttatgttcagtttcttctaggtcacgtctgttcaagcctagctca

SEQ ID NO: 12155 - DNA, 7288 bp, Human
cacccatcctcaggacgtcccccagcatgggtctgtgggggccaaaggaaaacttcccctttgccttctgaaggtttgctgaaaaatcaactgatgaaaggcagattaatagaataaattgattcatttatattttagagacaaggtcttgctctgtccagagaggctgaagtacagtttcatgatcagagctcactgcacctttgaactcctgggctcaagcaatcctcctgcctcggctttaacaggaaatatttattaacatacatgagagagaaccacaaagtgattaccccaacccctcagtgggatacagaagcttatccaccatcttgagtttatacaaatatgggggctcagatagtggcaagacaggttatggaagggagggaagaggaggcctggttggcaaagggagtcttgttaggtagatgacacctcacaggtagcagccctcagaaagaactgagggtaaatgtttctttcagatctgtaaaggtgtcagcctctcagttaatctttcctagagttagacaagggagagcctcggagaaagcctggctacatcaatgcagatttcctctacagatgcaaatctctccacaaaaagacagctttttggttattctatttccaaccattctgaacagccaccttgaaatgtgtcaaagaagtattttttggggtgaaatattttggtttccttcaagttcttgggctgggaaacatctttgggtgcatcttttctctctaaccccatctaaagctttcagggaacacggatcccatctctttctgcttaagggcggctgagtagctcacagctggggagtgaagtaccctaagtagtggtgggatttcagacacctggaagtggttaatggaagccgagtttctttctggtgcccccagagcacactgtaaaggaaattctcagctctaagtggagaatcctggttaggggtgcgtaagtaggggacaaaagccttgtgctcggcactggacatcagttgcttttcatgtttcttcatttaatcctcaaaacaactccttaagacagagtttctgatccccatcttacagataaagaaacagaagttcagagagagccatgaagttacatgagatcctctacttcaggtgatccctgcggtgtgggaaccagaggcatggtgttggtggttactgacgtgcaaagtctcagagcttcttcatccttgctccagcgtacccaggagtcgagccggtatttggacagttttccttgagtttctgctcaccttatgaattccatcatgccgttctgccacacccgaaggctcccccactccccatgagaatctatcccacggagaatggggcacgaggaatggtcaggaaaggcagatgcaggatacacactggacatctttgctgtcgatcaaggttgcaggcgccagagtcctccctaaaggagagaccttccttctcagtgtggctcagggagtgggaggcaggatcaggtgtagggacctcgaggtctcatttggtttgagaatgtctgtatttaggggaagaaatcccaggatgagtgtctcagggacgctggggaatggtcccccgtaaaggacccaagacagggcagccctgcctgggtaggagtggggcacagaaagtccttgggggagcagagcagcggagaagaggcccgggccggccgaggctgcggaatgctcaggcccgagccagagggaggtgggaccgagggctgcgcgcctgggcgagccgcctgcagccgcggccagggtcagggtcatgagggctggatcgaggggaaggaggggggtgggatggggagggagggcgcgggagggcatcccgccccagaggccggtcccactggggaggggaggagccagagttgctggagggggtccaggaggtgggggtgggaggaggtgggggccgccccgcgagaagaagagcgggaagaggcggacagcgaggccaagatttcagctgcgggacggtcaggggagacctccaggcgcagggaaggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaaggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacggtgagtagcatggcccgggcaggagcggggagggtcgtaccccaggagaccagcgcattcccacgaagggggacagaagtgcttgggctctgagccccagccctttggagaaaaggccactgtccagcctgctggaatgtgactgcgtgagggaggtgcggatcacaccagggcttgctctgcaccctcagctggctaccggccatcctctgcctgcctgtctgtccgcagcccttcccagctggaatatttgtgaggctggaatttaagctgcagcagacaagctgccggaagagggactggaagaaacccgagtgcaaagtcaggcccaatggggtgagtgaaggggtgtgagagcaatgggcgcatgctgggtgtgagtgcatggacttggggtttggggtgtggggcacatgcctgggtgtgcatgcatgaattgggaggtccattaagaagccctgaggttagagaccccactgcgaagagcctccttagaggtggagtggctcagcctgagcccaaggttgtgagagtggctggtgggagctggggcctggcagacaggaagatggtttggttacccctggacttatcttcatcagagcagggctcacctcggtctgagttcctctctcaagcatcagggcctgggtggaaggagccggctgtgtgggtgtgtctggtgcccccctagcctagcaggactccagtcatcagtcacggtgggggcaaaccttccaccgtgggggtgatgcctgggctgggagtgcagtgactgtgttctagttcccgctctgtgagcacggcctgggctctgtattacaggttctgcaaaggccccagttccctctgtcggctcaaggagggcactggactatagcaatgattcatcaacctcaaaatcaaatcttacaagaaaataaatagaataggtgacagctgagccactctggaggcgttgggtgggaagaacccatcggaggaggattcttgccttcacacgagcacaagcagacacatccatgcatacatcacacacccatccacccacactcctgcatacaaaccacatacatgcgtgtttatgcatgtgccacacaacccatctgggaaggactcctgcctgcacacacatgaaagttccatagtttgaaaactgcatgggtctgacttctgacattctagggtggctgtgcctgaaacctgctggcctgcatgacctcttgctcctgggctcgagggcctagttggggatctggtcccatgatgggcagccctggctcccaccctcatgatgcccaggcctccctcacccttttcctctgctcaccccatgctccccgctcccccacagaggaaacggaaatgcctggcctgcatcaaactgggctctgaggacaaagttctgggccggttggtccactgccccatagagacccaagttctgcgggtaagaaggggcaagggtgcacaggtggtgacagggctgggaagatggatggaagctgagcctatgggctggtctcgaggctaaagcttggccaagcaggagggagggcagtgggggctagaaagcgctgtgcctgtttggacattctccaagggatgtggaggggatgtggaggatgctggcagccctccactggcactgcccacccctcctacactgcctgaacagttttgggcactggcaggaggctgaggagcaccaggagacccagtgcctcagggtgcagcgggctggtgaggacccccacagcttctacttccctggacagttcgccttctccaaggccctgccccgcagctaagccagcactggtaggcaccagggggctgagagcaccgtctggatgaggccagccctgggaatgctgaggggctgggctgggctttgggagcctgggaggggacaggtcagaagcctgggaggaaagctgggactggggctgaagcaacctccctcacccccaaacctgtttccccttttgtctagagatgcgtggtgcctccaggaccgctgcgggtggtaaccagtggaagaccccagcccccagggagaggaacccgttctatccccagccatgataataaagctgctctcccagctgcctctcagctccttgtgttgcacgacttcctccttagcgtagctcagaggcggccagagagggcagggggacaggacccttcctctgggaccccttcctgtgggcagggtgagcagagcctcctgtgctccagagccagaggtgcccccatgaaatgccaggcagggatgcaaatgaaaacagaagcatttaatagatgtgtggacaagaacgggcagagaaggtgctgcggggagggggtaagtgcaggagcagtctggagaggcacatttgcaaggcaggggagtcccacttccaggagtgctctgggccactcagcctgcctactgtctcccaacagctgagacgggaggctggcccatccctacctttctcgcctgtagcctcaggaggaagtaattccttccactaagttgcaggctggagcagcccagagtggcagcagctgcggacacaggctcacggatgtgggagcccttacacctgctcacagcccttcagtctgtccttgcagcatgtggagggatggtggggaggggctgctctcaggatagggataaagcaatagcccagtgtgcagggccagtgaccagtgtgaagcaactaagacgagtgtgggggcagagaggggaactgggggcagcgaggccacctgccaggctgtcctgggccataggccacgttcagaagacgaaggaagaggtggggcccgcagagctgagtacctgctccgcctgggccaggctgtcgctggcctggcggtccaggtcccagcactcctgcagtgtgtcctggaactgccggcaggcctcctccaggatggagctgctccggctgggccaggactcccagtagcctggctccacccagggctgggcctcggtggctctggggcctggactggagctgggacgcaaggagctgtccaggtctcggcacagctggtagaactcactaccacgcccaatcacacgctcaccgtcgatgactttcaggccaggcagcagctcccggactgcagcccagtaggaggggttggcacagagcgggttgctgagccgggccaaagggtctcggagccgcaggtactccaggcacggtagcccagccagacactgcagctggcccggggtggccagtaggttgcctgcggcattgagactctgcaagttctcacaggtggccagtggctccaggcccgtcagccgattgttggagacattgagcacagctagctggcgcaaggaggccagcgggcccaggtgggtgagcgcgttgcctgataggtccagccactccaggcccaggcactctcccaggcagcccaggtcagccagtcccaagccacgcagcttcagtagcaggatggactccagggagaactcgcctgtgcgtgacttcagcagctggggtgtgatctgcagtccgccagcctctcccggcttctccgctggagggtccatgagatggaagtcggttgggatggcctgggccctggcaggactgtcacagggttccactgggggtcagctggtgctcgccctggctctacccaggccagtgccaggaggcctggttccgatgccctgctcgaagccagccagtccctgaggagagacagtcagtcagcaggcagcactttctgtgtcttacgcagcaggtgacggcagggagtctgaccctgcttttaccatgaaaaccaacaatctcagccaggcaagacctgaagaccaagctgggacacaggccacaaaagccatctgagtgacagggatggggtgcaggcccaacccaaggggagcagcccagactggccctggctggttagggccatgctggatggattcaggcccaatattaccagttcttcctgtcaaatccaaactaggggcaaaacattattttactttttccgtaaccactcacgatccatccctattagttttggggtgttttttaaaccgttatttttgaataggcaataggtaaccacca

SEQ ID NO: 12156 - DNA, 35840 bp, Human
acaaaatttaatgaagtgaggagaatgcttctcagggagaatgcccatagtccaaacccactctcttgtttttataaagcaggcactcatcactatattaagtcttcaaaaatataatttctatgcacagattattctcagatctcaaataaagtttatatcaagtcttcttaggtgatagtggggtacagtgcaaaaggtttctgagccagcacacctgggatcaagttttgtttctgtcactttttctttgaccatgcactcaatttcttttgtgcctcatttaacttatgaaaggggcatgcttctgtgagccttacagggctcttataagaattatgcataatgattcacatgaaagcacatggttaactgaaagaaaatacctttatataattgccagtaattattattacactagattcctatcccctcaagactacacttttattttctttgatcagaacaggccaggccaatggaccaaagtgggcggcaaccttggggcaggtggccccaagaggcagccccagtccagcctcaggagggaagacagcctgattggggggtggcagtgtgtgtaggaggccttagaagctctgtgaagttggtctgccatgacttgaatctccacaagaagactccactttaaaatagggcattttaaataaacttctatttttcacttcaattcactgtttaagtcttaaaatattgaaaatctgagttaactggagtgaaatgaaaggcgtggcagataaagcaaagtgagacaaaaagagactcttatgaacatcaaaatatgaggtacagagcttgggcagacataaatacaaaaattattaatattaacaaaaagcagtaggaaagtggaaatattataatgaaagaaaaggaaaccgatatcaatgctagctttagagatgaaataggcctggagaactctgtggcaggcagagagcgatgctaaaataataaaacaagccacaaagcacaatatacaatactaacgaaatatatcctttaatggcacacaaagtggcttttctctactgcttgaaactttagcaggtagaaaagtgagaatgtttcaagagacttctaaaaggttgcttacagtactggcaaaaagcgaatattcaaaatgccacatttaagcgtaaggacattttcaaaaagagcctactgtaggtgacatttaaaataccgcctcccaaataaccagccagccagggacttgtagaggacccgaagtgtgtcatgcgcataaacgatcccgagagtgggccgcgggcaccacgcaaactttctcttgtggcaagcccctagaacaaagcgcccatctcactggggatgaggagatcagcgcgaccctggaatgagacagactctgggctaaagctcccctcccaacatagggcgtcccaccctgccccacagactcttctcccaggtcaggtccgccagtccaagtctagccccggcatcccgaaggcagccccttagggtcccagcagccctagctctgtctcgcaggccaccgcccccaacccagagcttcattcattgaccccggcggaggggcgagacccagccgggcgatgggtgtgcgcggctcgaggcgggggccccggagcaggtgcttactctgcgtgtccgttaaggagatcatggctgcagtggtggggacagcggcgacagcacctcggaaagcccagggtgggaagctgagtcgggagaaatgaagccgggaaacagcccaggcgagagccgccacgtcttccggaaacacgcagccaccctcactgccgctttaagagcgcttcctattggcgaaacctgcttccaatctcaaccaataactcgtaatgttgttcggtgacgctcatggtgaccacaccccttgaccaattagagaagggagttatctgtgattggctgaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagactgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttggtaaatactactggggatgcttcttccaccccctgcttcacagtagcggaagggcgggcgttattaatattaaattactattgcctctaaatgcaggtggcggggagagagaggatttagcctatggtatctcagtggcgtttcctccaacattgatgactggctgtcaccctgtaacattcttcctgtggatgcctagcttatactgctgagtgacagacctgctgtagttcaatttctggatacattttatgttgagatatcttttgctgttaaatcacatcattttgggaaggagcagtcttttaaccgcataatcaaaggagtcatttaaaatcgtgggggagaattggatatagactgtgtcttttcataagggtagaaacagcccctgctaccttagcaaacctgagccctcactacatcaaggcattttcctgggctgtgcggatacaaaggtgaagagattgaaccccagccctgctaaaggaccttacagtctatggaaggaatgttacattttcattacgtgaagagatgtttgtatagatcaagaattagaaatccttggtttactctcctatttagccttcttttaatggtgtggttattccacattctttagcaaggcaaaaaagagtcagcctatctttccggcctagtggtggcttcagaattctgtgtagaaagggcgtaaggtcagcagtctaaggataggtgttgcagaagtgacttttggagagcatcttagttttagaaaatgtccatattagagagatagaagaggtgtttttaggattatggggaatttaaagtttctactctccagccccattttccacttgtccatatgcatgcttaggttttagtcattcatagatacttagaaatcattacaaaccattttcccctccccccacctctaacttagaaaatctagcttttctgtagaataccagtttctcttttaagattgggcttatattgtaattctttaacgcaagggctcaataaaatgttagatgattaattttattatttatgttgatgtattttgcttaatctggtacatttgaatctatccaacttatttataagattgccatcctcccagttttacaggtagggaaagaggcttggaggaacagcatatgcaactttgcctaacatagtaatttagtcacatagcaattggtgctagacctgttgaatgtttgctgttttttgttacatcactttgtatcttgtggatgtttgctgagtgtcattgctactgtatttgtcatgtatacgtttatgtgactttggacacttctctgaaatctagagagttagtcgttctgagtgttgtgggttattaagctgaaatatagagttttccataaaaaattagtgtcaaaagaaccatgtggttcttatttgaaaggtcactgcaatatataatttactttctaacattttctgtgcttaggaatgacagattactgttgagtgaacatcattaatagtactatttttaaaaacttgttgtcactgttgtgcttttatttttagaaagaaatttggattattttagaaacaaatttggaaagaaaaagaatggcgtccgtttcaggttagtagcaatgattacattttcttcttccttctgttctatttctgtttgtatgatatttgaaaaagtttgttttaaaaattctgattatagaaatgatttttttcagcttttttattgaagtaaaatacacattacaaactttgccatgctaaccattattaagtgaataattcattggcattaaatgcatttagactgttgtgcagtcgtcaccactatccatctccagagctttttcatctatccagactaaaattctatactcattaatccgtaactttccattacttctcttctcctaatccctgatagccactattctactttctgtttcttgactattttaggtacctcatataaatggaatcatataacatttgtccttttgtgtctaatttttaccttatttgtgtccaaataaaggcaatagcggaatcatgcttttgcctatttctcttactgctgagtatacactgaccccttccccaaaagagcaggtacaaattatctttattcgtctttgggtgatgctcatttctcttcttgctgaatcatgtcctccttggtaatactgtaatgtatcggagagggaccaaataaaaggaaaaacccaaacttggtttatatacaaattttaaaaagcaagaaagacttatagctattacagttcttgtttttcaattggtcatgtgatcatagcttgtactttataactgccttcttcaactacccattctgtattccttggttctcagttggtaatgggtctttgcttggtggggactacttgccttagtagtttcctatatttggttattatagttttcaattaactttaatcacaaggtaagggaatactgagaggtgcactagaggatcttctgctttccagacatactcttccttatccctatagtgtagtagctatctgatttccccttaatagtcaggatcacttaccccagcaagtatagtaatcgccttctttgcctgttcatttgttggcatgaggaacccaaagtggccaagtggcagtcaacttccagtttaatggaactattgctttttcccctggtacaagcatttctttcttggtaaccaagacctctaggccagcaagagtccgatgtttcaaggatgggaagcaaaaatttcactagcggatcactaagggtaatagaagagccactcccatttccaccgctgattcccgtgaatcgtggcaatgggagaaacagcactattcactgatgtatagcatgccatatcctggaggctactagtccagcccttaaagtgctgatacccagctggcagcataattgagtctgcaaaatgccactccattattttctcaggctagctgctgcaggttgttggtgaacatagttagaccagttaatatcttgaacattagccttctgttgtgctttgtttgctgtaaatgagttctttggtcagaagtaatttggtggggaatacgatgacaatcagtaggaattccgtgaattcctggatggtggacatgatagagcactgcaggcaggtatggtaaattcatatccggagtaagcatctgtatcagtgagaacaaagtgctgcctctttcattatagacggttccaatgcggtcactttgccatcaagcatctgtctgtccccacagagaatggtgcctccattggaactcaaggttggtatgagctgtttgcaggttgagcacttagctctggatgtagccagatgggtcttcgtgagtggcagtccatgttgcagaaggcactttgttcttgacttcgttgtgcaaggacaagtgtggtcaatgtccaggtcatcttgtctacctgattaattatgattatactttgtggaagttgtttttaatgagcattcacatgggacacaaataccttcacactctgaccattcagagaggtctatacatatatctcttcctcagacctcattgccaccagttttcctatttgctaccttccaagttgctaaccatcctgctaatcattaaccattgcttataatagtgtggatgtattcctctggcaaaatgaataactatgtggactgcttactgctgactgggagaattttccatctccaatgtttttcaggatcactctggagagatgctagagtgctttagttgttcactttcaggtagtgacaatatatcatgcagaatcttttgtaaattaggtctgcatttttttttcccttagtaacactgaatcccaccatgaggttatagctacaggttgaggaggaggaggcaaaggggagcatggtgcatgagcattcagacttcttgttcacgccttcacttagaacctgctcactttggcacataccacttccattgtgatgatggaggcctgcctgatgaattgatgggtcggatgacacctggttgatgataggcagcacaggtcacatagtaacttagtctcttgtaagacccaggagcaacccagaagttgtttctgaaagggtaatagttctctgtagataatggcaaagagctttgctctaaaatccttatcatctttgttgtgactcatctataggccaaaggtgtcatataacatctgcattcatcacaaacttacagcaccatcaaatctgttgggtcatatggctcaatggtaagagaagattgtatcatggcgttacctcttgttcgaggtcctactcaaaaccggcaagttttggggttacttggtaaattaggtgtatgttgcctcccaaatccaagtagtccattaggctctgtgctgctctcttagtaataggaggggccagatatagaaacttatccttcactttagaagagatatctcaacatgccccataccctttgactctcaccaaggtgtcaggcctctgaatttttatgggatttatcttctatcctctggcaagtgtctctcttagcagtttgtctatagtagctgctactgctgcttcttgctcagcaggtcagacaagcatgatatcatcaatgcagagagctagtgtaatgtctggtggaatgaaaagggaatcaggatccctgcagcctagattagggctagagagtagatatagctctgaggtgggagaataaagatacattgctggctcagcaaactgcttttactgtgctatactattcccctatgctataataacaggtacatgggtatggagaataaaacattcagcagatcaatagctgaagccagatgccagggcatgtgttctgtcttattaatgaaattacagctggaaccatggctgctgttggagccacagccttattaattttggcataatccattctcaatctccagaatccattgtcttctgcatacaccacataggtgagttgaatgcgacatggaagtcatcattaccctcatatctttcatgccgttgatgtaggcagtaatctctgcaatccctccaggaatgcagtaatatttttagtttgctgtattggttggtaaaggcagttttgctggcttccgtttgatctttcctataataataatccttagttactttgccaggagaccaatgggtggattctgccacttgctgaatatatctgttctcagtatacattctgaaactgaggaaataaccacacagcagattagaaggcccactgtatatcactagcagccgctggacttgaacctgctgctgccccatgccaatgagatcaccaaccctgcccttacactgactttcttaaatacagaaaatatgtctactgcttcatttctaccttttaaatctctggaaaccaaagctgcattgatcacctcacttaagtcgagtctatactctgactggtggatcaccatggcattttggttttctaagaattagcatcagttcagagctaatgtccagtagtttctgagaagtgatttctctttttctttcttttttttttggacggagtctcactctgtcacccaggctggagtacagtggtgtgatctcagctcactccaagctccgctcccgggttcacaccattctcctgcctcagcctcccaagtagctaggactacaggcgcccgccaccacgcctggctaattttttgtatttttagtagagacggggtttcaccatgttagccaggatggtctcgatctcctgatctcgtgatccacccgcctcggcctcccaaagtgctgggattacaggcgtgagccaccgtgcccggccgatttctctttttttctaatgcacagttaccctaataaacttcctggtgaagagtagtaggaagattcattacatacatttttagctgtgtggttgagtccttccccaacaggctccaacctctgccttattcaagggcctctggttctataaggtggttcaattctggaaattcgtcgaaggatggtctctctgttgtgtttctggttctgtttaccagaatcagagctttctattctgcgtgttacaaatcaagtaatctatttccgtttcagggacttcacagtcaactagtcaatccaagatcttgtcggtcagaccattctgattgctgcctcagctctgttgcccttcatggcaaccacatctactttatttttcgtcataaattcaattgccaatggttagcccccataccttggaatccatcattgtcgttgaatcaggtggtctacttggaagatgatatttcccactgtcattcctagcttacagagaacagccaggggagccccagcatccctgaagagctccgctgatgctggcgctctgctcatgactgtatttttcacagtcttggtgaaagaagtgtcctctggattctcctgggggacagcaagggagtggattatcaatctatttgatcttccactctggcactgctctctctctaagcctctgaataccttcctttagagcatacccaggaaattccagagctccagcctcactggactctatacctgttttattccatcccaattttctgacattcatctttgaggccaggtttcaggcaatgagccaagcaaattactagagccactcctggccactatctaggacattaaatccagaatttcttagtgagcccgtatcaataaacttagcttaattcgacattgtattccgtaaaccctgtttcagtacctttatgatctattcccatatacattctctaggtttctgatgtagtttggatatgtgtctcctcctaatctcatgttgaaatgtgacctccagtgttggaggtgggcctagtgggaggtgtttgggtcatggagcaggatccctcatgaatggtttggtgccctccctatggtaatgactgagttcttgctctgttagttcacatgagagctggttgtttcaaggagcctggcactgcctcttctctttcttactctatctcccactgtgtgacacacctgcccccctttgccttctgtcatgattggaagcttcctggggtcctcacaagaagcagatgccagcgctatgctccttgtatagcctacagaaccataagcaaaataaacttcttttcttttataaattacccagcctcggatacgcctttatatcaatgcaaaatggatgaacacagtttctattgatatattttggcacatgcagctcttttggtgcatatcatgtcttttgacaggttacatctttgtgttttatcctctaggacttctggatcttaaagcactgaaagatggtagaggctgattcttaggaggcttagcagtcccatacaaggcaacaaggaccattgtggggacttcagttaggaggacattgtttcagaaaggggaggcagggtagaagagacttggcataatttagtggtttaaggtaacctgcttcgttggaatctgcccttatgttcccctccaaatttcagtctccttcccagtcagtgtgctgactttatcataaaagtccctgcaaggttgggaattcagtttgtattgaaattcagccatctgcaggatttagacttacagctatttttccaaaatattggccctgtacctatagaggataaggtttttttttaaggacaatcatagaaactttgaggtcccttaatgcagatcctacatttttcccctgagttctttgcacacttagaagcaaccagtcaaccccattattctcaccaaaacatttgtaacagcaaacactttgtcacccacagccttgccttctctagttatttttctactggtgtctatggatgatgatttaaataacttttttcactgcatgatgacatagaatagttatgttccctttatcagtggaaacagggttattaatgccttgaaatctaatcagatcagaaagccagttctatgtggcccagaaacaattcagagaacctgttaagtttctgttcttccggatcaaaattctgtattggttagggttcagtcaggtaagctgaaccattatgagtgctgtaagttttattatggggattaaaacttatgtgatcatgggagctggttaagcagctatccctgagtcagcttctggtcctgaagtcagcagtaccagcagtgagaaaggaagatgggtgtgaagtatgggagggtatggatgagctggaagctgcaaggataagttgaaattcatgaggacaaagttaggatgctggtgccctgctgaaaagctggtgcacttgtcacagaaggttggccagcaacatgaccaagaagccaaagaatctgtgggccaagttgttccaccaagatttagcaggagctgggggaactggcttctgccccacgtccacaaagtgaggcagcagtttcctaatatcatgagtgagctccagaagcacctggccataggccaaccatcccaatgtaaaactggctgctgctttatttctgccttgtaaatctcatgcagagttcacttgtggccaaacctaacccaaagtcatgtagggaagggttgatacaagggatgatggcagttggtacaataaaaaggtaccccaacatcctattttaaatcacagccataaattatatctcatgaagaagcacattaaacctgtatactgattaatgcaggcaggtatatgagaatgcaccaagaacatctttaagatttttctagcttccatcgatgtggtatcaaaaagcatctcactttttgactttaatacttagattgattagaatcatacactggggtttctttatagattagttacaaaggagataaaatgccaattccaatagtacacttgatttctcttacttgttacatcctcttgtttataattaccaactccttttaccaccaagtgagcccaaataggaataccttcataaagtaatagcaaagtaattagggaattagcttccttttgcttcaaagtctgatactttacttaaatgatttaggagattgttagaccacttctctacaacataataaaaataattatcatgtattaaatatttgtgtaccaggtactgcgtctagaactcctaatatattatctcactagctcttcataaaaatactatgaaagttagatattgtccccattttacaggaagggaaatggggatgcaggtgagtatcttgtctgaggtcactcagcaggtaaaaggaggacctgagatttaacttaggtctatatgactcaaaaacatgctcataaccattctgctatactacttcaagtttgtctgtaattgatatggcgggcaacacccagaaatcaatctggaaacctaaagttgtaatttactctgtctaatcattgtatccgcgctgcctcccatagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaaggttaacttttttttttttttttttgctagttttatttcttctcatattttaaaaaactagaatgaattcttgatgggacagtgctttccagtaggcttagaggtgaaactggccatttctccagtggaatgggaaacttgcaggtggatcattctttccctgtgttctgtagtcttcaaattaaacttttattattcagacatttttttccagttattgttacagcaacattgatcatgtttagaaaatgagatacttcctttacctacattaacaaacagttaagaaaaaaaattcaaactccttgccaaaggttagatcattttcctgccctagtgaacaaacctttcatgattcaagaccttatcaaacatcaagtttatcaattataaatagaataatagaataattagaataactctagaagggattgtgctttttgtggatgttgcttttcaatgattcacgtctgaacaagatatttacaccaaaaattccagataattgttaactttgttcatgatatttgagtactttatgatgctgtgaattccctgatcaacattcagacaattttttaaatacctgatcaaacaccttcctttcttgtgtgggttaattctcaactggcaaatgtttacatttgttactttttttttgtttttgagatagggtcttgctttgttgcccaggctggagtgcagtggcacaaccacaactcactgcagcctcaaactcccagcctcaagcaatcctccctcctcagcctccttagtagctgggactacaggtgcacagaaccacacctggctactttaaaaaaaatttttttatagggatagagtcttgccatcgcttgagctcaggctggtctcgaactcctgagctcaagtaatcctcctgcttaggcctcccaaaactgttgagattataggcatgagccaccatgcctactatgtcttataatacatcatttaacttgtttttgctttgcttagctagtgagttaatctcaaaactattatcataaaagtttaatggtctataagtattagaagtcttatatatgtttgtctcattcttatcaaacttctataatagtcttacatgtttgtctgattcttaactttcttttcctagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggtatgtactaaaaaaattaattttgagttgaagaagtgctttgtcatcatacctttttaattcttttaaaaaataatttataatcatacatatataaaaatcaagtgcatttttgtttgatttcttctatattaatagaaatttaaagtttcacttaaaggaggaattttatttattttttattttagattcaggggtatatgtgcaggtttgttacatgggtatattgtgtgatgctgagatttggacttctaatgatccatcgtccaagtagtaaacatagtacctgctaggtagtttttcagcccttgccctcctctctccctaaaggaggagttttaaaaacttctgagattaatccttttatctggttcctgaaacataaatttaaaaacatattgtactgaacattcaaaatcctctcttctagcttttcgaaaccctatctaaattattgttaaccatattcaccctacagtgctatagaacacttgaacagaagatacaaggggcaaaaaaacccaaaaatgttgtaggagaagcagctctggaagaagaatcagtagacctgaattctagtcccagatctttactgagtgtctgccatggtgctaggcactgggagacacagtagtgagcaaaatgggcgtggtcttagttttcacagaactcatagtgtagagtagcactttctcagactttagtgtacataagaatcacctgagaatttgattatgtgcagattctgattttatgtgagaccaaagatcctgcatttctaacaagttcgctagtgctactgatattactgattgggtagtagcaagggatcagcaagctttttcttgaaagggtagatagtaaataatataggcttgtggtccatatggtctccttggcagctcttcaaccctgccattgtagcacaaaagcagccacagataatgtgtaaacacatgggtgtagctgtgttccattaaaataacttacaaaaataggcaaccagcccttactttgttgatccctggtttagagaatacaggtaattgcaagcaattgcaataagaattttgggataaaggttttaatagggaattaagtctgtacaaagatctggtctaggggctgtcagggaaagctgttctgaggaagtggcatttaagctaaagtttaaagggcgagtaggcagaagggacagggaaggaagagtgttcattcagaaaagcaatacttgagatccaaaagcaagagagaacattcacattatgatgtattcagtaacctggaggaatttctatgtggcagtcagtggtaagacatgtggaaagagtcttatttttaaaacttttccttattttagcaagaagccattgaagagttttacacaggtaagagactcattatttcatggtttagaaggataattctagcagttagatgaattccagatacatctggaagatagattcaatgggacttggtatttattgcttggggggaaaggagaaagaagagtcaagaatgatactcaaattttaggcttggacaaatggtgaggttcttcactgaaatggggtacattggcgaaagaactcttgggaatggagaggggaaagatgatgaatttatttgggacatgttgaatttacgatgcctttaagacatccaggtggaattgtcctatgagtaggaggatgtttgtgtctaaagcctggtgttagaggtctgagttgggggttgttagtgtggagatggccactgaagccattggaatgaatttcagagcagcataagaagaaaagaaggcctagaacagaaaccagaacaccaagagtttagggataaacagagaaaaagggcttgcagacaaggctgagaaagagtagcaacatataggataaccaggattgtatgatgttattagaaggctagggaagggtgtgtttgaatgagggagtagttaatagtgatgtctgttagcaaaatgtcaaatacgtaaggatgtaagtttcaatgagtttaatgacaaaggactcatctatgaccttagctagagcaattttattgaaatggttgggtggagaccaaatagcaatggtttgaagcaggtaggaattgaggaagtggaactggtgagtatgggattctctttggaaaagaatgactatgaagggaagaagagagtgggccataaatgagatgttatcttagtctattccagctgctgtaacagaatactttatatcagttaattaacaaacaacagaagtttactgcttgcagttctggaggctgggaagtccaagatcaagatgctaatagatttcggtgtctagagagggggtgtttctcatagatggcaccttcttgctacaccctcacatggcggcaaagaaagggcactcccttcaactttttgtaaaatggcattaatcccacttatgaaagcagagccctcattacttaatcacttctgtggggataccaactttcagaccatagtgggtgttttccaagatgagagggacttgaccatgtttaaatgtaatgagtaggtgctagtaaggaaaagtgaaaataataggagagagaataattgactgggaaaaatccctaataaggtcttaatttgattatgttttttaaacatgtctgctctttgccaaaggttgttttaagaaacaaactacagaaacgtaaagccatatataattttaactgtagaatagcttttgtactttaaacagtttcaattataaggaagggggcatattactataacttcattcagacagtaaactgttcactgatttctactcagcataaatgaatctcgtacaaaaagtaaaagaatgcttatgcaactatcatgtttaattatacacactactgtataattaaaaatctggtttttttggaaagctttatagtgatttttccctgatgaaactgtttagtgtttgaactgatatatgttgtcttactgaaattaccaatagtgattatttaaaacgatagcaaattaaacatttgaaatgataaaaatctgtctttatttttataaggatagagttctgtttagttgtatgtttgtttatttggcttctacttaccttgtttggtcatttattcatatctaattaatgagagtaagaagtaagctttactaaagctgcattaaaaattaatctgaattgatggccagtgcccacaagttaagaaggtgaatgggccgggcgtggtagctcatgcctgtaatcctagcactttgggaggccaaggtgggcagattgcctgagctcaggagtttgagaccagcctgggcaacacagtgaaaccctgtccctactaaaatacaaaagaaattagccaggcatggcagcaggtgcctgtagtcccagctactcgggaggctgaggcaggagaattgcttgaacccgggaggcagaggttgcaatgagccaacatcgcaccactgcactctagcctgggcaagagagtgagactccatctctaaaaaaaaaaaaaaaaaaaaaaaaaaaaaaggtgaatggtttgcatctgattctgagggtggtgtaaagtttaaggtagattttttttttttctcttttaggttttacactcgtcatttgcccattgatctctcttatggaagaccaattaatggttttaaaacaattaggaatttcagcaaccatgttaaatgcttctagttctaaggtatgtttcagtggcttttttttttttaatgtaaactattcactgaaataggagctttacctgcagttgagttgcttataaaattataaactgttaactatttatatcaggagttacaaactactgctcttggccagttctggcccactgtctatttttgtatgtcccatgagttaagaatggtttttatatttttaaatggctaaaaaaaatctaaaaagaatattttgtgaaatgggaaaattatttgcaattcaagtttcagtatccataaataaagttttattgaaacaccaccatgctcatttgttgacatgttgtctatggctgcttttacagtataatggcacagtggagtagttgtgatagagaccttatagcccataaaacctaatatttttgtctgatactttacaggaaacatttgctgacctgttttgtattatccattctaaaatagtaagggagaattgctaattatgcagtgtaattaaatatgaaatatgaattattaagaagttaccctatacctgtggaatttcttgtatttaggaatggactgtcttaccctcatctgtagaataaagcatttcccagctattcttttttaaaaagcatattactgaaatcttcaaaaggagagagaatagcataaaaactgccatgtagccatttcccccttcaacagttatcaacatacggctaatctttttttttaatctgtatacctccagttttccctacccctttcctcttagtttatttattcagaacaaattccagacatcatattttaattgtaaattcttcagtacgtatctctaactttaaagaaaagtgctatgccatcatcacatctaagaagtttaatcaattctttagaattataaaaaaaattcagatttctatctcatttttatgtttttttttaaaaaaaatatagcccagataatattcatgcattgtattgtatttggttgatatacccataggttctctttatatcttttatatttcccatgcaaattctttgttgaagaaactgggttaactgtcctgtatctttctacattttcctgattgcgtccttgtggtgttctttctttctctctttcttttcttttctttctttttctttttttttttttcagttctggggtacatatgcaggatgtgcaggtttgttacataggtaactggatccttttagttagatctaaaagcctgattgtatttggaatttttctttaacttttttttttttttttgcaagagtatacttactgtggtatcactcaagtggtacatagtacctggttatctttttgtgatgctaagcgtcagtgggttcaagtgatgtctgcctgatctctggttatcagtttttcatctaatggttttagcagccactgagtggcaccgtgagagccatgatttcattagggaggtgcaaaatggtgatatctaattctgtcactctttcttcatgtattagttatactttttctacaaaaataaactttttcctcattaactctgcatgatgaaaatgcttgatttttttttccctttctttatgagttttcagaaagagttggttttctagcattctccaaaggtggtcaacaagatttttaaggttttctttccccaagtatcactataaacttacaagctttgacgtataatatgattcacctttggaatcatatatatatatatatcaatatgtatatatgtaatgctgaaatagtcctgtccttgggcagtgagagcctctttaagttggttcctgaatcctttctcttaaccccattgcttctgttccttgctttcttttgcagtaagataatccatgttcattttatgcatttcctgcccagacctagagtcagccatacctctaagaagccctggttcctttagtttacccatatatttttgttttatttaaactccatgtcattctattataactgctccttcctccaacaaaatcaatctgtggagaaaactgccttctaataatgtactttcttaaaattgaaaaagaacataatagtaatagaaagtaatttagaaagttgcagataattacaagttcatgatatatccctactcttgaaagttggagagagaaaaaaagaacatctgtatcctagaatatatctaggagttaacaaactgattctttgctgggatgatgaaagtagtttgactgtctctttctatctcattcactggcatgtttttatacttttttggtcctctttagattagaaggaaaaaaaatgacatctaatatgctaagtattgtatagaattgtatgagtactaagaatctaataactgttaccttttaagatttattattattatcttaatttaatgagtgatactttgtgaaaccccatggtctttatatttaaataaagagattaaaagatttgatggtatcatttgagaagttaataaataataaattttgttcacatacataaagggattataaatataatgttaaaattaataaaacccacctttataaccataacaattgcatctagctcacattttagaatatattatgaacaatttaggattatgccttcatagaataaatgctcttcattggagtatctgtttgtgttcttttttgtcaagtgagttttttttagtcatcaacaatgtagacgttagtaaataactagaatgctatttacacagctgccatgatgtttcgtactgagacatggtttcagttttaatgaactaaacatctgctcctagaagagccaaaggctattattgctttggagaaatgaacgttttcatttaccacctagtatttcagtctgctagcttagttttactatcattgtgtctatttttttcttttaataggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctggtatgtatgttttatctagaaaactttttgatgtcatagaccgtgtccttactcagcttggcatgatggaaatctctgcttctattaaaatcatcctcaagtagttacacattgaatatccgttatccagaatgttcggaaccaaaagggttttaaattttggatttttttggatttgggatgatcaacctgtattacttattttatcttgcctcattatgaggaggactgagaggcagaatgtttagtttcattccccactgtagtctgtagtttaattgcccttgtcaattatggacaaatatggacacatatgtttactagccaatagtggacatctttgtggcatttatgacatctaggtattccttcacatttgttgaagaatttgcatctgtttcaaagttgtcatctttagtcatcattctgagggtcttttcagcacccacatacaactcctcagcatgaaactttgatgagatatttttagtgacctttttcttcaccccaccacctaatcctacagtcatagcctaaagtaagttactcagaattgttatatgcaaaaaaatcttaaattcaaaaatccgactccctggcttcaacctgttttccttctgaagcttttcacacattaggatttgctggatccctcttttaatccctgcttatttatccaggctcctgtccctacatagcaatcactctgtttcccgtccagacactgtgctgttgccccttacttctgttatatttgccctggactgcctggccattctgccagtctgcttcaggcgttgtgcctgagatgctggattcatctagactttggctttccccattcctgctgcttggctactaaacattgtcaaaaaaacaaaaattgcataactccattcagcttttcattatcctcagccgtccttatacttgtccctatttcaactcctttatacatttcttccaacaaatgtctcctatcattaactttctattcaggccctaacttgtacttagcagatgctttctgcttcacagaaaatagatgccatcaggtatgaacagctcctctttctactttcaaacattagtaatctttttttttttttcttttgttaaggcagaaaagaccactgctttataaggctaaccatgaccactcccgtttcatcctttcctgccttcttaagatcttgcactgccaaattcctcactccttcaccttcaggctcttttgtcctctccctaaaaacagaaactaaaacacccttctgaccttttaatgttactgtcctctttctgttctttctgtcaccatcagacttctcagcttaccatctccatttttcacctttaacccattctgaactcattgaatcatgcttctgccaccaccatactactgaaacaggtcatcggtgacccacccccagatgagaccacttcatcaagtggtctcatcttcattcctcttcccacttcacttcagtaacattttatatattcacctctcaccttgccacattctactcccttggttactgtacagcagtgctgttcagtgtcttcccttccattctcacctccttcgctcttcctgtcttctttttaaatattagtgttccctagggttctgacctcagtctttaccctttcttacgtttctccagggatagtgagcttgtagcccgaagactgcattctctacctacagaattattatgggcattgtttttatttatttatatattttaaatagatttaaatgccttaaacgggatgtatacgcctttctattaagggcccctcttttcttaaccagatagcgccacatagttgttacctggtggccactgaagttacctgatttgtgactcttgccctattttcaacctaaatggtttgatcccttatgattatcacccttgcttaagtattaccatgacttatgttgtctctgtggatctgctgccaaagtgtaaaacattattcccatatctaattagctaactgctaaactttaaatttatactcctaattgtttatcagaaatgtgtatctaaattagcatgaccaaaactaaattcccccaaaagaactgctctttttcttctcaactgggaatattttccccataactctactcgacattctaaccaaaaactttttgttttcttcgcctttcctttctccgttctcctctctactcccaagcaatttccccttcagtcttctctgtcttagaaaatcatccactcactcacatgtttgctgaagccaaaattttagcagttatctttatcatttaggttccagtcaggagacagttatttgaacagagagaattttttagaaagaattgtgaactaggtaaaaagtagctaaatagataactgaaaaagtaaaaagaaaacgaagatatcatggagttaaaaactggaagaagcaacaaccacctgtagggctgggagaacaggaagaaaagattggaacaaataagacttagaaacttaatgaagagggcttgtggaactgagctccctggtgctggagtctcttggtagaggcagaggtggggtacgtctgtgataaagctggttctccaaaggctgagaaaagtgccaactgtatttagttgctcttaaggaaagaagtgctgctgcagggatgagaagccttgcaggggtgacagtcacaggaacacaagcaagcccacaggaagcagttagggaggaagcagccatggtgtcttccatccagggccagcaggcaaagctgatgcgtagtgtgcagagtccttggtgcagcatcccaaagcacagtatagaagggtggggttagagatgacaaaaaaaaaatggatgacacaccgtccttgatttaccctccctttgcagatccagtccaccactaagtgttgtcagctctgcctctagaatgaatctcaagtttgtctactctctgtgcacctacgtcttacatacagttgagctcccttccactggtctactgcagcagcttcctaagtagtctttgattccgttcttacactttttgttcattctccacagagcaaccagtgatattttctaaatacacatcaaatcatgttacttccctacctaaactacccagtagctactgtgtacttagaataaaacccagcgttcttaactggggcccatagggtaatatgtgatctgcccccatctgtctacctgatttcctactcttcctctcttcttaagccccagcatactgggcttatcattatgagcacttaccactctctaatggcatatttattggtttactctttgtattgtcttgtttctttgcttgaattatagacacatttgcatagcatttttgtcttgttcatcactttatcttcagtgcctagggaaatgcttggcacacaattaaaaaggtgttcaacatttatctattgatgaatgggtaaatccagcactgtctccctcttccctgccacctccatatcccagtagtcactaggacctgtaggttcatgtatgtctctttactctttttgatttatcctgaatgtcatgtctcattttatattctgtattatttgttttctggtctgttactgccatcttttaactggttttccttcagtgttttgtctattccagtctgtattttgcactgtcaccaaaagatgatttatgaagcataggtctttaaaaattacatgatgggctcggtgcggtggctcacgcctgtaatcccagcactttgggaggccgaggcgggcggatcacctgaggtcaggaattcaagaccagcctggccaacgtggtgaaaccccgtctctactaaaaatataaaaattagccaggtgtggtggtgtatgcctgtaatcccagctactcgaaaggctaaggcgggagaatggcgtgaacccgggaggtggagcttgcagtgagccaagatcgtgtcactgcactccaacctgggtgacagagtgagactccatctcaaaaaaaaaaaaaaaaaaaattacatgatgattcctcatttcctgtaggataaagtctcagcttagaatcaactggttgaattgttcatagcttttcttaaacctgccttgtacataacagtgtcagtcagggttcaggcagagaagcagagtcacgatgaatgttatgggataacggttttactgtaggaagtagatcttgaacaattgtgggaggaactggggaagtgcaggtctgaagaggggagttggaggattagagaaaagtaatggattgatacctaagcactggtgcaggaggacgaggcggagcttgtagggaaatctgcagctggcatgtacagtggcaaaggggacccctaaagggaagttcgtggaaaggtctctggtaagctacttcctgtgagtagctatcgcctctgtgggtctgctgttgattggcaggacctgcagttgggaggaacagctgaatgaggaatggaaaagaactaggatgacctagaactggctgagcacttctgcatctgtccatcatcctctctgcgtgtaaagaccttgaaggagtgatgttagctggttcacttctgccaccaaatcttgcacaagtccctcttttgggtcagctctaacttggaacaggaaagagattctgggagatgtaattcacagcttaatggattggacagtaaatccatccaccacaagactctgtgacttagccccagtgaactgcttgctgttatctgaacatactaatttcatgtcagtgtatttgcagtgtatatgctgtttcctctgcgtgatgttcgtctcttcctagtgaacttctgctcattctcttaagacacaactcaagtattatctccttgaaatcttcacttcccaagcagctgctctgtcctctttgttttcatagtagtcctctacttagcatgtaagcaatttctaccacatttttttcagtttcctccaaatagtttaagtgacaatttatctagtgatgtagatgcttataacaagtttgagcctagaatggtttccgagaaataggttatatacaaagcagtgccgcccttaccaagatttttttggtctgatgacactaggtggtagcaggggtttgtctgatggcctgttttatcttttgttagttgtaataaattaaaacactgtggctatacccactgtctcttgagtccaccgtgaccaagagtaatgtctgaaataaacgtaataaagcctgcccatcaaagaggctaacacagaactgcaaatttactgctatagatggctgtggaaacaaaatcatagtagtcatcgattatctgcataatgttaaaagatataatttactctaactcttaaaggatagaaaaagggccactttgtttgttttttcagattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggtatgtaatttttatgtcaattccttacttttgtgaagaattacgcagaggggatctgcctttttattatgtttatttacatgagcagttaagtacttacaaaaatttttaacattaggaggtaattataagtagattctgtgattagggcttcattcatgtatcttttgctacataaacctttgttagattaaatggaagacacctgctaggtgatactttttataaaacatatgagtaagtcatatatctttgttaaatttctgtatgttcttttttgtataaagatggagagaaaggatggagtgatactaaggaccctaataacatctctgttcaaattaattactaagtgatagaagtattcatatgccattaaagatttgccaattctatttgaattttatttgataaacttgaaaatcaaataacctaacagctgtcttttctttctttctaaacccttttaagaatagatttaatatttttctgagttttcattaaagagttatttatgttacggtttgtttttataaaagtagcatcgcaaaataaaaaagtctgcatccttgcaagttattcactgctcacgtgcttgctcttctctggtaaattaaaaaaataaagatcaagaagagtctgggaggaggaacagatgagtcagatgggttgaatcctgtgagtaagtgaaagagtaataggaaaaaaaacactatggtcatgaaagaactgcatcctgaaagttgtacgtagacagccacttggatggtactcattcatttactttttaataagttaagttttttttaggttcggcagaagccctcaaacactgaagattttattgaggatattgtaaagctcattaatgggagatacaaagggcaatcaggtaatgtaaaaacaaaccaactttggagacagagataactttcaaaaagtgacttcatatcatattgataattatactgataactgaataacaccaaaaaaaattaatgtatagcagaagatacttgaaaatacgtgataaaattaattcacttgatcttagaaattgggtgtgacatttgcttatgccatagattatgagtcgtcaaattgcctgatttatttttgcttatttacacttgctttagaatagacctgatgacttaatgttaattatcaacagcacatatttagtatgtatccactgtgtacaaaatagtggattaagcaactgatattctaaagggatagaaaatatactcccttacagtaaaggacacgttaaagcaataaataaatccagtagtacatactgaatagattaagcacagatcgagttgtgagtatatatacatggttttctgggtttaatgactaagcaaatgttactgaagcaaagaatttgtgtgaaagtagcattttaaactgttctatagattttcaggaggtagtcctgggtaaaaggagttctagggtcaaatgaatttgagaaaggttgcaggtatttattctgcctggatgttcacagggtgtatcagcaaactagaagctctgaccatccctgaaaataaagagagacacccatttaactttgttgaatgcaatgttctccaaattaatttgcatgcaaattaatctaaattaacccaaaattaatctggagaacactgcattcatagcacatttgttagcatcttacagacatcagtttgagaaatactgtttagtgggagataaagttaaagagagaaaagagataacaggaacaaaaactgatggctcaggctcatttctgctttaaaggaagctggtgctcaaatctggaattataccaaaatgtcaatatatgcacaaggccttgaaatttttcataattctttttttccttctgtgcattgtattaatcaatgtcctgaatgtgtgtgttgaaaactatcttccaggaatatgccatatctatctaacaaatgcacatattttactgcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggttaggtctatatcttccatagaagcctaatttacctttaaaatatttaaacttgatttaattaactgataaaatgttaaaatatttcaggtagtagtggcaactgttgcatttggtatgggaattgataagccagatgtgaggtttgttatccatcattcaatgagtaaatccatggaaaattattaccaagagagtggacgtgcaggtatgtaggactcaaatccagaagtaaatttttagaaagcttttccaaaaaatacatgataaatgcttaataagtctgtatgttttatctttattggatagtatttttagaacaatgtatttttagcagtttgacacttacttgcatatggagaaatttttacttatgttctgttatctgaattgtttctttttatgtgtgttaagataatttgatgttcatctttgcctcctgaatttttaattagtgatttcaaatctataacttaactggattatagacacattttttaacttagtagagctgattattgatgtctctttagagttttttttaatttgagggtacccattacaaattaacttccacatctctaaaatttctagatgtagtataaaacattgcctgctaattttaccatatgtcatttttgcatattttgaatttgtaaatgtaattctgcaatctcaaggtttctcacaccacaggtcgagatgacatgaaagcagactgtattttgtactacggctttggagatatattcagaataagttcaatggtggtgatggaaaatgtgggacagcagaagctttatgagatggtatcatactgtcaaaacataagcaagtaagccacatacctttttataacttttatcaattaaagcaaatatgaaagtatatgacatcgtttttaagttcttactaaatacattggtggaacaccaaagtgcagatccataaaagcagatgttggagggtaggaaccagcacatcaacctgtatgatctgccttagttcaagaaaagatgccctatctttgagataatcctccaaaactacttgtttaattgaaggtttttgagacacattgatagcaacttgaaggctttttttctctggcactgctgtacagttacatgatttaataattttgaaaaggtctatggttaagataggcattttgagagtcaagctcagtaacgtgccaccttgccagctcatgtgtcaatgaaataccaagtttctccttaagaagtaagtttaaatctacttagggtggctttagactagatagcttcctgaaagctttctgtcatagttatctttgtgcttttattgcctatcacataagaagtgctcagaaatgtcgaggtggtaaatagcagccagacagtgatagaaatgttctttctttccaatagatactacaataatctagttaaaagaaatgagaaaatgaaaatgtcttccaaaggccagtagagtctcatgaagcatattttaaggtttcaactcaaatattgctactttattaaaatataagaaactattttactgtcaagaatattctcctaatagttgcaaaacattgaatttaaaaatggaactcagacaattttttaaacagtgtttatcaagaatatgtggggaaaaaagtcctatgtcgggggcacagtggccccccaaagatgttcacgtcctaattcctaacctgtatgttacctcacatggcaaaaggaaagtagcattgcacatggaattaagactgttcattagctgaccttaaaatagggagattattttagattgtgtgatgtgagaagaacctgacactctgattttgatccagtgaaacccatagtacacttctaaatctaaaccacagaaatgtaagaataaatgtgtttaaagccactaagtttatggtaatattatggcagttataggaagctaatacagtatataactatgtaagctgaaatagagattcttaaaactttattatatcctttaataatttgtatctttaaatgtgtttgcagatgtcgtcgtgtgttgatggctcaacattttgatgaagtatggaactcagaagcatgtaacaaaatgtgcgataactgctgtaaagacagtggtgagtttgttgttttgtaaacctttataggctaatacagtcataatgcctagtgacagagatacgttctgagaaatgcatcactaggtgattttgtcattgtgcaaacatcaaagtgtacttacataaacctagatggtatagtctcctaggttatatggtatagcctattgatcctaggctaccaatctgtacagcgtgttactgtactgcatactgcaggcagctgtaacacatggttaagtatttgtgtatctaaacatagagtaagtacagtaaaaatatggtattataacctgggtgacagcgagactccgtctcaaaaaaaaatatatggtattatataatctcttgggaccactggcatatacgtggtccatcaccgaccaaaatattatgtggcacaaaactgtatatacagctgggacatgagagaagtattagacttccaaatggatttaaaagattaaagtgtgaatcagattttccagaattaaaactatcaacatgaagttttgaaacaaaggtgaataaaaggaaaagtcttatgtgtatgcacacattttatattgctatactgaggatgtgaaatttttaataaatgaaggaaaatatttgaatttttctgaatagaaatgctattctataagaaaagggaaaccatgtgataatctctaatactttatagtcactaattgaaaagaaaatttagtgcaaaatagagactatagagaatcacttttgatccagttaatggctagtcatcggagatttacttaaaattcttttaaatgtagatcagcaggatttgttttctgagcattggtcacaaccctgctgatcaaaacaggatctggtcaaaacaagatatagcaaagaaactggcccaaacaagttagaactagaaaatataatgtatttgcatgatgtaagacactcccactagcaccatgacagtttacaaatgccgtgacaatgcccgaaaattacatggttctaggaactccctaaccttttctagaagattcatgaataatcttccccttatttagcatataactaaggagcagctataaataccgctagtgagcaatgtacagtgccactctgcctttggggtagccctgctctgtctatggagccgccattttcctatactctattgctaataaacttgctttgctttcactttactctgttggcttgctctcagattgtttcttgcatgaaactgggaaccctcctgggctgagtcccaattttcggatttgcctgcagcattttggcactatattttaactttttttcatccgtgtgttgtatttcaagatctggactagccagtacctcatggtaagaccttactgagttctgatgccttgttaggtggaagccactgtatttttaactttgcagacagagaaatttatgagtttattagactatcttataaaataacaagagtgttatatataaatcagagtactggtctcttaataattgggttatcagttgaggacattcttgttgctaaatcagagttcactcaggagcctatactagaacagacagggtctcctataaaacacacctcttagtaacttagtaatcatgtctggcagacactttctgatttctagagtatatggcagggcttctgataaccaatttttttttatatatatcactgtaaaccccacaatgcttacagagaccataacttggtctagtgacagagacttgaggaatagcctagtcttaattcagaatacatttaaaaatcaatgtttagggtggctcacattgataaccagctttaaaccagtttaactacttaagatagcctatctttgccctcatttctaaatcctaattacctgctaccatatttgttttattacagcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaagtatgtacaaactcattcattattctttcaggttgtctttatggttttttttaaaaattgcaacagaataaacggttttgcagttattttgtgtgaacttttaaatgctatagaaagtaatttacctaaaacactcaaactttaatcactataaataaaaaaaagtaacgaaaatattttctttaaaggctttatttgcattcttgtaaattttattatttcaagtcaatgtgttaagaattactgcgcatatagttatttcttttataaatttgttttccgtgattccttcaaaagctttcttattgttggcctttattttctgcagagaagactacagttttacagcttatgctaccatttcgtatttgaaaataggacctaaagctaatcttctgaacaatgaggcacatgctattactatgcaagtgacaaagtccacgcagaactctttcagggtaaatggctattaattttcagttttatatattttaaaaagtatattaaagcctatgggatgcttttctgtcatattcccctaggtccagttgaacatgagaaaagtcagttttctgattagatttctgggtatggaagagagaaaatatagttttctgtaaagatgtaagtgaaagaatttagactggccttttaacataaactaggggtttccagtttcttggaatgggaggactccgtttgaatatctaattttgttatgcactctgctcttatttggttgtgattactaatagttgagaagtctgtttctgctgttccagtggttagaaaccactgttttaaaccaaatactatcaagtctgcaaaagcatgtcaagtcaagtgccattgtgtctaaggacatttgaggtctttagaacttctctcacaacgtagccccttttattcaaaatagagctcatatttgaatagaaatttgtagataaaaaactagacccctgtatacttaaaaagccaactgatacagaaagaatattttgaaatatttaatctcatgagaaaactgaatagctggatttttaccaaggtgcttgctttgttatttttttttttttgtaggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagtccatataattgtcttaagttttttatgcctttatatacttagctatattttttcttttgacataactatctttttgaaagcaatattacactgacagaggctcactgagtgatactttaagttaaatatgtagatcagggatgtccaatcttttggcttccctgagccacattggaagaagaattgtcttgggccgcacataaaacatgctaacactgacgatagctgataagcttaaaaaaaaattgcaagaaaaatctcaagttttaagaaagtttacaaatttgtgttgggctgcattcaaagctgtcctgggctgcatttgacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccacagccatattttgacatttcacaaagaatggttctaatctactagagtacatttggctaaatagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaacttagaatttatgtttttatatttttccactaatatcattatcacttctgtaattttcagtgtggtcatcattaactcaatacagtcattcattttattgacttgtgatttttctggtgtcatttggaactttatatgattcctgaagaaattccatttttagtcaaaataatcttctatatcaatatttggatctagcagatcttctccatatgatgaaagattcatttggtttaagattaggttttcaaatgtttcttctaaatcggtttcaccaattaagacagctcccatcattcgtccattttgcatgacgactttgatgtattctcgtcctttggtacatctcagcattaattcatgatctgaacctaagccctgtgcattgtattttcccagcagtacaacctatatttagagataaaaaggttattgtcatgagtatcataaagaaaatgtaatgggtagttattttgtgtcaagtttgaatagccgcagaaaacttatgccacaaaatttcataactaaaaatgttattggggagagtcccaaagaaaatgtttcaacagcatgcgttaattctacagatgacactatcacacactctacactgacattaaaaaattctggtgaatatagtcaaatgttaatgtttaatattttaacactaaaaatatctagtgaatataggtaggtgattctaccaatctatatgaacattaaaactatacagtaaatatataaatatgtaggatgtggatacattaaaccatgtggagtcgtggtttaaagatttggcaaggaactgaattagagctttcatggaaaagtttcttaatttccctgaggcttttgaatatgtttctccttctctgtaaattagggaaaaaaaaaaacccaaaacaacctttgtcaatgtgaagaggactgaataagataatagatacaggaaagctcttggtttatttttgagtacaacagcagttagttcccctcacaaagaaaggatgaatcacaagtaaaagttaaaaatgcaccaacaagtaacagatctagagagaaatttttttccctcttaactaaaatagaatagtggtaaggtggataattatcagatgattagggattaagactagcaataataccaggtattggtttg

SEQ ID NO: 12157 - DNA, 6623 bp, Human
caagataaatatgtaatgataccaagtatacccgactcttccctactatatcctttgttaacggaagaatatttctgaatctcttatttatagaaaaaaataggaatcattctctggttgtaatcattttaaaaggtataactactttttgtaaaagcagaaaaaatttggattaatttaacaaatgcatatgaaccagtgagaataaacaatgttaacatttgtcatctttgtttaatatcgttagtttttgtttttattttttgagacagttccctgttctatcacccaggctggagtgcagtggcacaactcactgcaacctccacttcccaagctcaaacaatcccccaccttagcctcttaagtagctgagactacaggcatgtgccaccatatctggatatatatatatatatatatatatatatatatatatatatatatatatatatatatactttttttgtagagatggggtctcgctatgttgcccaggctggtctcgaattcctgggctcaagtgatcctctcatctcagtctcccaaagtgctgggatgacaggcttgagccaccacaccaggcccatcatcagtttttatataaagaaaaaaaaaccttaaaattgttaggcaaatactatgacaaattgtaatatatattcttacatttcagatttttattttttaaactgtataagaattgattaataaataaaatttagtattaatctgtcttttaaaaccatatataaagtttatcaaatagcttataacttcttgcaactgaatttttgtattcaatgttatggctttgatactagtccaagttgaaatatagatatctactttattcgatttaaattctgtttagtattttattatattttgttaatccatttgtcccaattcatatacttatctctctttctgtgaatattcaggttagttttttcttcctaattttgcattctgattggcttttattccctgaattataaatgactattctatgatgattctggtaaatactcaatttcaccacacaatctttgacttcatactaacaaacagttgacttcaaatggacaatttcaatgaaggctgacttcatatttagctcctttaagcttccttaggcatcagctctctacaattctcacatggagaatatgtgtattttgttagctcaaaccttgttagacatgttaaatgtttagaaatataaatttaacctaccccttgaggtaggtcttgagaggtttgtgagcctaaaaagacatggaggaaccacttattgccacaagcacattgttctaaattatttggaatcagttaattcttccccatctcctacccatgcctgacaccaaagaggagcctctaaatttacagggaatacaaggaagtctactgttctctgctcctctctgggttattagggcacatgggagccctcagttgttttctgctgagcaagagcaaagtccaccttggacttagacagcttgccaaattttttgccagaaggggacctgagttgtgaccactcccagtgtgtgccgggaaaaggctcatactggtgccagaatctcttactgtcaatgctcccaaaactcaccgcttgcccccaccccttttgcttaaatgacgtggttcttatctcagatcctgatataaagctcctacagctacctggcctgagaagccaactcagactcagccaacaggtaagtgggcattacaggagaagggcgtctctaacatgcactgtagatctaaaatcttcgggaagatacagcatgagtttctgtccaagaggttttagctgtaaggaagcctcagtgggatccaaagttgtttttcagttactgagtctgtataatccccactctcaagagaaacatttgaaggtgtgggtgtctcagaggaccttcctggtctcagaaattctgagaggaggttttaaggaaggtaataggtgctttgctctccatctctcagaacccccttctctgtgttctcctatagagattgttgatttgcctcttaagcaagagattcattgcagctcagcatggctcagaccagctcatacttcatgctgatctcctgcctgatgtttctgtctcagagccaaggtaagatctcttttccaccaaccaactctttctagccctgaagacttcactctatccccaagcatacgggtctacttgaaaaaaaaaaaaaagcagagtcactgttaagggttgttttgtggtgtttagtgatctttattgctgatctcttcacatttatatacatccacacctcattaaggagttggagctagaatttaaaatgaccccttataagcaactgctgcagttggcatgagtttatctgattaaatttatacgtgatggtggatttggggatgtctgtgtgtagacagtcactaatggggtggagaactgaagagagccttgtgttcagggaaaccaagtcaggcttgagaaagtagaaggctgagtccttcaaggtagaagagcctgagctccagacataaaagggaaactggagacttgtttctttggcctattcattctgttttttttcccctgatcaaagaaaccaaagacagaagatgtaggatgcaggagcaatagtgagcagtcatcccataatagactggattcttctgtttctataaaggaacctcagaagctcttacctcaccttcaagccttttccttaccctgagagcctcctttaattgtctcttctttttcaggccaagaggcccagacagagttgccccaggcccggatcagctgcccagaaggcaccaatgcctatcgctcctactgctactactttaatgaagaccgtgagacctgggttgatgcagatgtgagtgaggagagcagtgtgggaagggagactcatgaagggaggggaagctgccactctccagtgtgttcagtggctgcaatgagatgagactgaaccccttgctatactatcatcagccccaaactttccaatctactttatcccattattcagcacattcccagcacaaagaacctggtggtcagtgacagcatcatcacggacattactctgctgtcctttttctgacccgtcctcttggaggactcagtatatccgtcacaacttcctcctccactgagtgctccattttcttctgcaacagctctattgccagaacatgaattcgggcaacctggtgtctgtgctcacccaggccgagggtgcctttgtggcctcactgattaaggagagtggcactgatgacttcaatgtctggattggcctccatgaccccaaaaaggtaggctgcagccttctttatctcctaatgatcaggtttgagaagtaagaaggaggttcaagttctggtctcttaagtaccagcttttatcgctttccagaaatcaggctgtttacagatgctctaatgtcctgtgtagcaaggtgcactgtagatgattggagatataagtggaaggctgaatttcctaggtgttcttgtcattcatgaataaacttattctgttttcagtcaacaaagcatctttatgcaccaacttcttacctattttgttactgtcagagtcacaagagagactagattgccgactatataggaaaggagacttgtggtaaaaatctgctgctgtactgctggcatttgggaacctggtagtatactaaataatataatatatcaacaactaatggtcagccaatgctatgctggatatgagggtcctgggccacaaagacaaaaaatcaggaaccactttttaagtgagatactttgggtctctgtcaaattcataacacttatttcttggtggaatacagttaatgagttggacagttcaggaaagaagtttagagcaatagcaaaggaaaggaaacaatatttagcaaggtttattcttcctttgtgtcttagcatgtttctgagtgtgcacacaggcccagtgattccatgtatttttgagtgaccactgcctctgttctggcccttccccatctagaaccgccgctggcactggagcagtgggtccctggtctcctacaagtcctggggcattggagccccaagcagtgttaatcctggctactgtgtgagcctgacctcaagcacaggtgagaggcagagaatccatccacctgtttctgttctctcctgcttagctccagggatggaactgggactgggatagaggaaaggtgaactcctcattaaggaaatggatgtttggtttttgtcctgagtcctaaagccaggagggtcatactctttcgggtctcccagttgtaactcttctcattgacttataggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccctaaataataaaaataaacatgtttccactattgtgctgtcttactgtgtctgctatttccacagctgatgcctgggtggttgagatgagagtgattacaacaaagcttgctctggcctatccacttcttaaaagtccatccgcataccatgcatattggaattcagtatttatgaacatatgtggctttgcttatgacaaggttaacaagatggagattgaccaaaaactcacatgctggcatatctcaaagatttttgcattcagttccagatcactgtaataagggtaatgtcacagaaaagcaagttacacaggtttttttttttttgcttccctttgcatataaatgttttactgtagtctattatacgagcaatagcattatatctaaacagaaatatacatactttaatgaaatagtattttattgctaaaaaatgctaacaatcatcagcgtcttcagcaagtagtattcttttgctcgtgaatggtattgcctcaatgttgatggctgctgcctgagcagggcagtagttgctgaaggttagggtggctgtggaagtttcttaaaataagactacaatgaagttggccacattgatttgattcttcctttcatgaatgatttctttatagcatgtagtattgtttgatagcatttttcccacagtacaacttcttttaaattggagtcggcctctccaaaccctgctgcttctttatcaactaagtttatatgttgttctaaaccctatgttgtcattttaacaatgttcacagcacctttgtcaagagtggattccatttcaggaaaccactttctctgctcatccataagaagctgctccttatcctttcaagttttatcataagattgcagcggttcagacacctcttcatgctgcatttctaattttagttctcttgatatttccactacattcacagttacttccttcatggaaatcttgatcctttcaaagttatccatgaagttggaatcagcgtcttccaatctccagtgaataatgatatattgacctcctcccttaaataaaaaatgttcttaatggtatctagaatggtgtattctttccagatggttttcaatttactttgcccagatccttcagaggaatcactatgtatggcagctatagctttgtgacatgtatttgttaaataataagaattgaaaggtgaaattactttttgatccctaggctgcaaaacagattttgtattagaagcaggcatgaaaaagtcctaaatcttcttgcatatatctgtgttcctaggtgacaaggtgcatcatcaatgagcagtaatatttttgaaaaatcttttttctcatacataggtcttaacaagtaggattaaaatattcaataaactatgctataaacagatgctctcatccaggctttagtgtcgccgcctttattatcttagctagatcttctggataacttgctaaagcttctccatcagcacttgctgctttaccttgaacttttatgttatggagacagcttctttcctgaaacctcataaagcagcttctgctagcttcagacttttcttaggcagtttcctcaactctctcagccttcacagaatgttgctgactttctccaagtcagcaataaggacgtgctttttaaattatttgtgtgttcactggagtaacacttttaactttcttcaagaacttctcctttttattcacgacttggctgtttgggacaagtggcctcatttttagcctatctcagtttggacatgccttcctcactaagctcaatcatttctagctcttaatttaactcaaatgatgtgcaattcttccgttcacgcgaagaattagaggccatgggaaagttattaattggcctaatttcaatattattgtgtttctgggaatagggaggccagagaaaagggagagagctggggaagtgaccagtgagtagtcagaacacacgcatttattgattaagtttataattttatatgtttcattgaag

SEQ ID NO: 12158 - DNA, 134292 bp, Human
  misc_feature (1)...(134292): n = A,T,C or G
ttcctcctcgttgtttttttttttttcttgtacattgcaggcaatgacccttagttaatttccttgcccactttagagttttacatattgagtttccctaaagtgggaaagggcagccacattattgagcacctattgtacaattggtgttatgttagacacagcttagaattcacaatgagactttaatgtatatataattacgagtatataaccacaggtgagtagttaggttcgagtcagattcaaatccctgctcagcagcttaacaactgtgtgatcttgggcaagtcatcgctgtgatgatgatgatgatgatgatgatgatgatgatgatgaaggtgatggtgcttgtgttgggaagccatattccaggagaatgatattagcgtcatctcaggctcacctgtgtcctattgtgattgagactccagctgatgaggaggagacatagagccagtgatcacatggattggctggggagtgaacacagttaactggaaagagttcttatcttttctccactacattctttttttttaaacaaattacttcatccatccagttcaggtctctaagacataatgagcctctagcggcctcctacagagggggacaagtaagtctcggtttgcctggctcaatcctggtttatgcatgtgatcctggcaaaattattaataatattgcttttcaatctcaaaatgttcaggtttggatgataagggatacggtcacccttactccgtggcctcctcttccattctctcccctctaaaatatgtttagcagcaccagatggagctgcccacagaactgctttgcttatgccccactctactcaaaaactttatgagcttctcaaccacctactgaatacaatctagactccttaacccagcattgagtacagaagcaaggcttatgtatgtgcatctcctatagcatctcataaagtgctcatcaagcaggataatatcaggaaacacgtgttgatacctgaatcaatgtgtgtagtcatgctcaggctgcttgtcagtttcttgaaagcatctttcttctgcctgcttcaagaacttcgcacatgctgttccttctgccaggaacacgcttcctccctctctacctggttcatgccttcgcattctttagctgccagtttaatgctgcttcctccaagaagcttcctaactcccccagattagacccaacccccctttttttctctcgcgtggcactcttggtaattgcatctctgtttgtatgattatttatagttgaccacactaaactctaatcttccaaaaagaactgtctatcgaggctgtgtccctcctgtgtagccagcccctggtgcatggtatcccataaatagttgccaaatgcagacagggatgaatgaatgtgggttaccctttctgagccagtgcagtccgcatcacctgtttaaagtcctccaatagcttcttagcgcacttggaataaatgtgaagttcctaggagggtctgcgagtccctacatactttggattcttcccaactttctacctcatttcctgctgctctccccacctcccgcttcgtcatgctggcctcctggctcctcctcacacacccaagcccacccaggcccttgcactccaacatcacctcctcagagaggccttcagtgtccccactgcccaaaaagcacccccacctctcttgatctcccattctatggctttattttcttcataacactcactttctgctgtcttcttgctaatttgtctctgtctccgccacagaatataagctctctgagagcagagaccttgtctgccatgttgatcactagctgctcagagcctgtcaaacagtaggttctaaatcaatatttggtaaatgagggaaggaatgaaagcagaggcagggcagggccccttcctggaacccagcagcccctggggcaggacctgtggcgttgccatggcaacccactgacctgagccaccccctggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactggtaatgaccagggcccagggacaggagactggggtgggcctggcaccctcagggggaactggggccaggcccgccttggtagctgtgagtgtggcatgtcaactcttttatgtagcgtttctggagctgcaatttcctaaaataggcctcagcacagtgccctgagagactgttgatatagtgtgaataatggcctctattaaatcccggtgacactttttaagtcaggcagcgttttctgcaggtattgcataagtcaggacctccctgttctcatccagtgcctcaggaacaaaactcagcgtgttcacttctccactgcttgaacaccacggctggctcccagctgcctgcaggcttcgcggcctggtgggcccggcgggcaaggcctttgcaatctgctcctaacggactcttccacctgtctcccaccactgggagtcacaggtcggcgaactcttcacctttcccagaaccaccaggcctttcacagctttgtgcctttgtcctgaaggcagccctcctgcctgaaatgccctgcttccctccttggtctggcaggtgctgaatcctttaaggaccagctgaaatgccaccccctctgtgaagcagccaggctttcctctccatggaagctctcctctctatgccccacagcatcttattataataccaaacactcctggtacctgcttgcttgtagaggcagtgtgggcagtgtgggcatgagggcagtgagtgcaccccagcctcggagtcaggcagacctgacctagctcagccatcaactagcttctctggatctgagtttcattcttgcaaatcaaagttagtcaagtctctgcttcagttgctgcgagcaacagagatgaagcatgtggagcggggcaaccagccctggaggttactcaataaatgccagacatcaccattaggcatctgtccctgtcactcagccgtgagttcctggtggatagaaaccatgccttcctcatttttctatggcccttaaagccaaacacactaagtgccttacctttataattccagttaatctttgaagaaatcaggtaggtaggaatttaggacaatttaggaaccatcccaatgttacataactagtaagtggccaggctgggatttgaaatccagtcagatttgagctccaaaccccacattctcccaagcccgtctctgtcttctctttcatgttgcaccacctccccgtcagtcactctgcatcagccacctgagccttcttgccattcctcaaacaagtcaagcatgatctttcctggggttgggggtaaccttcgcccttgtggtcccctctctctgaatcttgggaaaccttgctccctcactaaactcagtgtctgctcataggctctttcttcccagaggcctttctggtggagaatcccccctccttgtctctcattctctattcttttcttcctttacttttcttcatcacaagcatcgctacagctatgtgcccagtactgtactaggctcttggggacaaggtactgaacaagatagacaaggtcattcgaacttacatgttaagggtgggaaaaataagtgatttaaagaaatggaataaacaaaaaaacccaagatacttttaggtcttgagacgctagtccaccagagatatcctgtgtaatatatgtgtgtcctgttgaatagcttttgttcatcccctctgtttgaacatcgaaggcacttgataattattggaaaatgaataaatggatgcagggataatctaagaggttgctgtcagtgtgtgctataaacttcaaggattacctggctcttgataaccgtcttaataggccctccctgccaggtcaatatgggtttgtgaggcaccactctgaaccttgaactgccttggacgtgccatgtccctgatgcggctacttctgggttattctttgctgctgtaaagagaatgaagccttgtagaaaacatgataactatatatggctctgctcaacctcattatatgtacccgagaaaataacttcacattggggtttccaaatcttcagtccaaagtgcagaggcataaagatcttcctctaaggtatgtgggctgaactccctgaaagtgaaaatccataggcattatctgcctcctcctttctgcccataatcccagatgaatcaggggaagggatgcttcacagcccaggagcctctgctcacggctgtaggcaaatcccgttgggcacttagcacaagcttggtccttactaacaggtcagatgatttttatagatcaagaatgaggcaattgggaataggaagttatcccagtatgaactgaactctctttctcctatgtcccatgcagtccccagaactcagtaccagtattgcagcattgatcacagtctgccttccttttagaacttttgcttcaagcctaactttccatatctataaatagagatatgaaaacataacatgtaatgttgttctggtcccaatttagacaacatatgtgaaaatggcttctatggtacctgccacacaataggagcttaataaagtttttagaaaaagcatgcatttattgtgcgacatctatggagccagccacagcgccagccactgggtgtgagatgatggacaaaaatgacagggtcccactctcatgagctcagggagtagcacgtgccttactttctacttggtaactagagggcagaagccagtcttattcatgtttatatcactacagcttctctctcttttttttttttttttttttttgagaatggagtctcactctgtcacccaggctggagtgcagtggtgcaatctcggctcactgcaacctctgcctccagggttcaagtgattctcctgcctcagcctcctgcgtagctgggattacaggcgtgtgctgcccacacccggctaatttttgtatttttagtagagacggggtttcgccatgttggccaggctggtcttgaactcctgacctccggtgatcagcccgcctcagcctcccaaagtgctgggattacaggtgtgagccaccacacctggccgctacagcttctctttagcacagcttcttgcatctggaaggcacaaaataaatgtgtgttgaattttgctttatttggaaaatcgcctttgatatgttatacttttccatgccttatgtggttaaaaaaaaaaaagaaaatgattaggaaattctatagatatgtggatgtatctacttatatgctatgcattctttgacatgtgtgtcactaatgtaacagttattgaggccagactacaggaaaaattttataacagtactagtagagagtcaaaagaaatagaataaaacgggctccattattaagtggtttaagttctaaactgaagaggctgttgtgtatgacaaaggctgacaaagaatatggaaatgaatttagcaaaattatgtaagtagagttttaggaaaagttcgaatacaaagcagactgagaaaaatgctgcagaattggcacattgttctggggactaaacaggacatagaaaaaggagaaagctcagttcacatttggagagagaactgtgattatgacctgaatttgaatgctggtcttcctcttactagccagatgactttggacgagtcactgaatctctctgagccttagtgttcttatctctaaaatgggcctattaatagcacccacctctaggattgtgatgagtattaagtatgatgatgtatgtaatgcagttgtatgatacctcacccatagtgagagctcaatatacagtgaactttattattatgaaatcacatcatctacaaatcaataaggtggaagaacacagtgtttcattcaaaattcagtatacatgtcattctgcttaagtaattcttgacctctgcaagaccaaaatccattgttaagaataattttaaagtatataacattgacttcagttgacctaaatagaggccttccagtcataggaagctacctggcttgtgagacatgaattggagatgccactcctaagggctccactagggaagaagtcagaggtcaaagtgcacctgcagatccaaggcccgaatctggtttggatatctcagagtgttgcatccacatagtctgaaatgcaagacccttgaatgcatgagaactctaactgtccagaacaacataggtgatggttctttcactgctcagaccattgtctgaaccctcagagtctatcccaagtgccacgtgttcacatggacattgattaactagaagacacccagaagcaggtgaactggatggcaaagaaatgggaacaatttcttccaagaaagaggtgaaacaaatgtggttctttgatgggggtacttcaaccagaaatatggtgaaatgatggttgtcttctcatatctgcaatgtgccagtgagaccagacttattctggattgccccagggagcagagttggctacaggcatagactgtggggtcagagtgatctgagtgggtgcaatgggtgagatgtcttctctttcattttcatggcacctcccaccctctcccacttcttgtagccttgctttcatctctctccagtgtgggattgcacagtgtggaggacaggtgctgccgtgaggaaagttctttctttactcaaactcttgcgggtgggcactgtgctctcttggcttacctggttaatagaaccagcttctctcgggaatgttgccacgaagttttcagagaatgtcccatcaatcacagggggttctcacctgcaagaacaggcccttctaaggaccttgatgttatcaggcctgaatccagtgcaggcaaatgggtgagagggagagtgtttcccttagttcctgatgaaagggggattggggtgtagatgtgagtgtgtgtgtgagagtgactgggtgtgtatacctatctaggaagaccaggggttggcccagaactatagatattgcttttggtggtaaggtttggtggaggcaggggctgcaaactttagcagatgccatctaaatgtagctatggctgctgccagggaaaatgtgccaggacttgaaaggatgagaagaagtgagtggagtcattctggagaatcctgaaaagaactctggagatgtgtaaccagatgtgcgtttggatacagtgtgatgacagacacctaccttgtgcatcccagctttgaaacattacaagctgtctgtctccacattgtgcattcgatgtctggaaggtgcagcgttttaatgttttgaatttctctgctcctcagtatttcctgggaaatatcagatttccatatcctctcaacaagctggcccttgttcttcccctcagatattttccccctacttattcacaattttggaagcagcttttaaaagagcagtttgttgggacataaaatacaaaacaaaacaaaaatccgacatttctcccagctgttggcattgatttcccctctccgcatagcttactcgtccgcgtggcttctttttatggtgtgtaacctaaggtgttaactaatgatcttttcctcggctctttgaattatgaggagtcacattacttaatccctctaaatcccagttgctttctaggaaaaacagagattaaaatccttgcttcagagagttgttgtgaggactcaatgaaataacttatgcagagggcctggcatgttcaaataggtgttcaataaataccagctcccagatcataaagaaggcaatgggaaaccacactgtccaaaagcctgcagccataggtgtcgccacttctgctataataccccatatgccttcctaaaaatcaccacattatacagaatcggccaacaaagaccactcagtttactggaaaaataagcttaggggcacaatgctgaaaaactttgtcaatgacacataataaaagatagaaacctaataaaaatgatatcacagttttgcacgtgttaaatggtttagaaatacacaaatacaataaaaatggcacttcaccttggaaaagacctgaagattgcttttagaggtgggtatcagaagggttgcagcctgtgagttattatgaagtgagcaggtgtgactcataacacaacgtggaccgaagtagctggtaggtgtctgaggtgtgaacgtgagtgtgttctgcatatttctgtggtgctaagtataatggggggtggggtggggggggcgtggagttttctgcattcacctaatttttttatgaaataaatggagcataaaaagacacaaagtttgcactatgctcaaattgttcccaaatatatcacttgcattgggacgcatttgttttctcaggacaagtgttatagcagagctgactgtacttagctgatgttgttgaatgatgaatgaatgaatgaatgaatgaatggtgggtggtctagaaaacagaataagtattacactacattgcaaaaaatacattggtagcctttgaaattggattaaaaaaaaacaaaccatagtcttggattttaaaagggctacatagtggctgggcaccatggctcacgcttgtaatcccagcactttgggaggccgaggcaggcggatggcctgaggtcaggagttcaagaccagcctggccaacatggtgaaaccccgtctctactaaaaatacaaaaattagccgaacttggtggcgggtgccttcccagctactcaggaggctgaggcaggagaattgcttgagcccgggaggcggaggttgcagtgagccgagatcacgccattgcacttcagcctaggtgacaagagcaaaactccgtctcaaaaacacaaaaaaagaggggctacatagctaccatagtgcttttgatttcttctcctgctgtggcttccagtctgtgagagctctttgaggggtccctggccaaagggaggcaagctacaaggttccctgccctctttcaaccagagtccctaaagttttacctgcttttctctttgttttcacttgaagaaaagttctgctgctaattcacaagtttacaaatcaccaccagtggttcagttggccaagtctggttttacaaactgctactcaggaacataccttctttgctcagaaagataatcctcagttggtgctacaaatactccagaattcatggaatctgaccaagaagtactcaagtgaggcttcaaagagccattttgcatccaaactactcagcagtctcatcagcagcagcaatggtgcacatggaactccatgcaaaatcccattccaatctgggcagatgccacatgaatattgatgagcatttaaatctaatgcatttatgatgttctgtctcttcacaaacacccacagcaattctgtgattttcttttttctttttcttttctttctttctttcttttttttttttttagagagctggattgaaagatgtctcaacgaaagtgaaaacaaacgttattccagccacacatctctggggaatgtttctaatgatgaaagtaagtgcttgaaactcattcttccatgacatcccagacatggccaatgtcctgatgggagggtagtgccactagattgctaggctgggccaagtcacctggaacaagacactctctagctatttatgaaatatcccaggtcctctctgtaatattccacaatggggagaggaatccattcaggaagacctggaaactaagaccacagcaaaaacttgctgtttacatactcatcttctgcaggagacttgctagcctgcattcccaaaaaccttgttatagtgacgctctaggcgggcaaatgtggaccctggttgggaaaggccattctcagtgtccactgtaaatatgggttcaaagtagttgtgtcacaggatagttgttttagccataaatgtccttgatatcagaaagcagaaatttcttccggttcttggactagagagctagagttaactgaaagatgtatcatcctgtgtttacaccttgtcctgtgttatgtcagactggggcttctgggtgctatattaagagcagtaggctacatgggacttgtattttttcccttaaacactaaaaaagagggatcagcttattataagtctaattttttgcagagtcagaagtgtctttcttccatggttggtaaagtgcatctccttcgttcagttttctgaaagcatgagccccggcccacctgctccacaatcccctagcatgtttgctagatctactcaatagccccctcctgagtcttagctggcattgtcattctatcatcaccatgtcacttcattttataaaattgagctacattgaacataaagtatacaaatcttgtgtaattagtttgatggggttttttttttctttacatattgtatccactggtgtcattactacccaaaaaagatatagaacctttcttgtcccccaggaggcttcctcatgtctcctccctgtcaatcactactgtcctgacttatcactatagcccgtttttgcctgcttttaaaacttcatgtaaatgggataatggactctgtattcttttgtgtgtaacttttctcagtcagtataatgtctgtgagattcattcatcttgttgtctctagcagtagttatttctttttcattgctgtatagtatttcactgtatgagtatatcacagtttacagatccttttaagtgttgatgaatatttagttgtttcaagtttttgattattaagaataaaacactactcgagaggctgaggcaggagaatggcgtgaacctgggaggcagagcttgcagtgagccaagattgtgccactgcactccagcctgggcaacagagtgagactccatctcaaaaaaaaaaaaaaaaaaaaagaatgaaacatatctgaacattctaagttttatttaagtttggcaaaatctacataacataaaatttagtatttaatcatctgaaatgtacaattcattgacattaagtacattcaccttgttgtgcagccatctacaccattcatttccagagctttcttcatcttcctaaactgaaactctgtacccattaaacagtaactcctcattctccttttccctcagtctctgacaactactattctactttctgcctctgttaatttgactgctctaagtatcttatataagtgaagtcatatggtgtttgtctttttatgactggcatatttcacttagcataatgccttcaaggttaatccatgttgtagcatgtgtcagaattttcttctttttgaaggccgaataatattcctctgtatggatatgtcacattttctttatccattaagacattgatgggcaattgagttgtttctgtcttttggtcactgtaaataacgctgttttgaacacaggcatacaaatatcttttcaagtctctgctcctaattcttttggcggtatatacccagaaatgaaattgttggatcatatggtaactctgtgtttaattttttgagaaaccacaaaactggttttcatagtggctgcgtcattttacattcccactagcaaggcacaagagttccaattttgccacttcctagtcatcatttgttattttctgttttttttttaataatagccattctaatgaatataaaatggtatcccattgtggttttcatttgcaattccctaatgattggtgatgttgaacatcttttcatgtgcttattcaccatttgcatatcttctttggagaaatgtctaagtcctttgcccattttaaaatcaggttgttttctgttgtttagttgtaggagttcttcacatattctggatcttaacctcttatcagttatgtgacttacaaatatttcctcctattccatgggttgccttttcactctgttgattgtgttctttaatgcacagaaatttttattttgatgcatccaatttaactattttttcttttgttgtctgtgcctttagtgtcatatctaagaaatcattgtcagatccaatgttgtgaagctttcgccttttttttttctgagagttttacagttttagaccttacatttagattcgtgatctgttttgagctaacatttgtatctggtattaggtaagagtccagctttattctttttttttttttcagacagagtctcactctgttgcccaggctggagtacagtggcgctgtctcggctcactgcaacctccgcctcccaggttcaagtgattctcctgcctcagcctcctgagtagctgggattacaggcacatgccactgcgccaggctaatttttgtatttttttagtacagacagggtttcaccatgttggtcaggttggtctcaaactcctgacctcgtgatctgcccccctcagcctcccaaagttctgggattacaggcatgagccactgtgcctgctgtagtccagctttattctttcacatgttggtatccaggttccccagcaccatttgttgaaaagactattctttcccccattgaatgtcttggcaccattgtcaaaaaacatttgatcatgtatgtggaggtttatttctgggctttccatattattccattggtctatatgtctgtctttatgacagaactagactgtagctttgtagtaagttttgaaatcaggaaatgtgtgacctttcatgttcttctttttcaagattgttttggctattcaaagtcccttgagattccatatgaattttagaatggatttttctatttctggaaaaaaaaatatgccactcgggttttgataggtgttgcattgaatctgtagattgctttggatagttttaacatcttaatagtaagtcttccagtccatgaacacaggatgtctttccatttatttggtgtctttagtttctttcagcaacaacatttactagttttcagtgtacaagtgttttgcttccttggttaaatttattcctaagtattttattctttttgatgctattgtacatgaaattttcttaatttccttttcagattgctcattcttagtgtatagaaatgcaactgattattgtgtgctgattttgtgtcctgcaactttgctgaattcatttattagttctaacagtacttttgtgtttgggtatgtgttaaatctttggggttttctacatataagatcatttcggccaggtgtagtggcttacacttgtaatcccagcactttgggaggccgagggaggtggatcacctgaggtcaggagttcgaaaccagcctggccaatatggcaaaaccccatctctactaaaaatacaaaaattagctgggcatggtggcaggcacctgtaatcccagctacttgggaggctgaggcacaagcatagcttgaatctgggaggcagagggtgcagtgagccaagattgcaccactgcactccagcctgggtgacagagcgagactacgtctcaaaaaaaaaaaaaagatgatttcatctgtgaaaagagataactttacttcctttttattaatttggaatgcttttatttctttttcttgccaaattgctgtggctaggacgtctagtactattttgaatagaagtggtgaatgcaggcaaccttgtcttgttcctgattctagagaaaaagctttcagtctttcaccatcgttagctgttgtttttttatatatgacctttattatgttgaggtaatgctcttctgttcttagtttattgagtgcttttatcataaaatggtgttgagtattgtcatatgctttttctgcatcagttgagatggttatgtagttttccttccttgaatgcaaggatggtctggcaaacaaaaatcaatcaatataatgtatttattgattttgtatgccagaccatccttgcattcaagaaatatatcccatttggtcatgatctgtagtccttttactatgctgctgaattctgtttgttagtattttgctgaggatttttgcatcaatttttttttttttttagatgcagtctcactcttttgcccaggctggagtgcaatggcacaatcttggctcactgcaacccctgcctcccaggttcaagcgattctcctgcctcagcctcccacatagctgggattacaggcgcccaccaccacacccagccaattttttgtatttttagttgagatggggtttcaccatgttggccaggctggtctccaactcctgacttcaggtgatccaccttccttggcctcccaaagtgctggtattataggtgtgagccaccacgcctggcctgcatcaatatttataagggatattagtctgtagttttcttttcttgtagtatctttgtctggctttcatatcatgataatgctggcctcatagaataaattcgaatatgttccctcctctttcattattttgaaggagtttgaggattagagttctgaacattcttgtatatcttttggtgaacatgagcacttattttgttggtatgttcccaggagtagaattgctagatcataatgtataggtatatttagttttagtagatactgccgaaacagttttctaaagttgtgccaatttagactcccactatcaatttataagtttcagtgtttcacttccttgccaacatttgggatagccattccttctaatattagctattttcatgggtgaatagcatatgtcattttggttgcattttttctgataaataatgactgtagcatcttattatatgctcattagacatttgtatcttttgtgaattacctcttcatgtctttttttttttgagtcggagtctcactctgtcacccaagctggagtgcagtggcatgatctcagctcactgcaacctctgcctcccaggttcaagtgattcttctgcctcagcctcccaagtagctgggactacaggcacatgccaccatgcccaactaatttttgtatttttagtagagactgggtttcggcatattggccaggctggtctcgaactcctgatctcatgatccacctgcctcggccccccaaagtgctgggattacaggcgtgagcccctgtgcccggcccttcttcacgtcttttgcctgtgtgtgtgtgtgtgtgtgtgtgtgtgtgtgtgtgtgtgtgtttggttgagaaggagtatcgctctattgcccaggctggagtgcagtggcgcgatctcggctcactgcaagctccgcctcctgggttcacgccattctcctgcctcagcctcctgagtagctgggactacaggcacccgccaccacgcccggctaatttttttgtatttttagtagagacggggtttcactgtgttagccaggatggtctcgatctcctgacctcgtgatctacccgccttggcctcccaaagtgctaggattacaggcgtgagccaccacgcctggccgcctgtgtgtttttaaaaattatgttgttggttttctccttaaaggtttgtaagagttggttttatatcttgaataggagatattaatatttgtcaggtaaaagtattacaaatatcttctcctggtttgtgggttgcttttatattctcataataacttttatgaacacaagttttcaattctaataaaatttaattaatgtttttcttttatagttagtgctttggtatcctattaagaaatttttgcttacctgaagttcatgaaggtctttttaacatatcatctagcagctttactattttacctttcatttttatatcaatagttcatctggaacttttgtgtatggtgtgaaggagtaatcaaagttcttttttttcttattaattttcaactgatagagcacgatttcttgaaaaggtcactctttaaccactgagtttcagtggtgccttcatcataaattggcagattatatatatttggatctgggtctggacttttattccaaactgttggtcttactgtctatttttgggctaatactacagtctttattactgcacctataaaataagtcgtgatatctggtagcataagacctcttgttcttctttacttcttcagtattgttttggttaatctacattcttaacaattccatattgattttagaattagttgtcattttttcacatatgcaaaatacctgctaggatttctgatggggattgcattgaatctataataaatttgggaagaacaccttaacaacatcaaatttccaattaatatatgttgtattagagcctccatgtatttggatcatctttaatttttcccagcagtgttttgtagatttcactgtagagattttacacatctttctttagacttattcctagataattgatgtttttcaatgctaatgtaagtagtaatattttaaagtttttcctaattgttagttgctagcatatgataatcaattatttagataataacttcatatttagccactttgctaaatgtgcttattaatttaaaatttgcattttttgaacattctatgaacatcatcatgtcacctgagaataatgacagctttgcaccttcctttataatctttgtatttttatttcttttgtgtgtcttatgtactggctgggttctctagtgcaattttgaggtgatgtggtgatagtggacatcattgcctttttcccaacctaagtggtgaacgcatttagtgtttcaccattaggtgagatgtttgctgtggatttttgtagatactcattatcaggttgagaaaattcccttctatctttggttttctgagagacttttcttaaatgggtgttgaattttatcaaacactttttctacatttgttttgatgatcatatatttttctcctttattctattaatactgggaattacatcggttgaattttgaatgttaagccaatcatgcattcctgtaataaatcacacttggtcagagtattatcttttttatatacttctgggtgtgatttttatatatttcaggctggattttgttaaggattttggcatctatgttcatgagatttgtggcctatgatatttcttttttattatgttcttgtcaggttttggtgtcaagattacagaggtctcatgaaaaggggtaggaagtttcctatgtctctattgttttgaagagttatataagattggtattctttatttcttaattgtttggaagaattcaacaactgggtttggaattttctttgagggaaagtttttaatgatggattcaattttctaaatagttattggattatttatatttttatttctttttttacttttagtaaattgttacttttaaggaatctgtttcatctaaattttcaagtttatttacactatgttcaaactttccttttattacttttgcctttactttttttgagacggagtctcattctttctcccaggctggagtgcagtggtgtgatctcagctcactttaacctctgcctgccagactcaagcaattctcctgcctcagcctcctgagtagctgggactacaggtgtgcgccaccatgcccggctaatttttgtatttttttttttttaagtagagatggagtttcaccatgttggccaggttggtctcgaactcctggccttgtgatctgcctgcctcagcttcccaaagtgctgggattacaggtgtgagccactgtgcctggccacttttgtctgtttttgacatctatgttgatgttctttcatttttgatattggcaatttatgttttctctgtttttcttcatcagtcttgccagggtttatcaattttattagtcttttcaaaggtccaacttttgggtttgttgtttttctcaatttatatcttttaagaattgcattcatttctgctcttatttttctttcttccttctactttctttcagtttaatttgctgtctttttctagcttttgagataggtgcttagattattgattttcaaccttttctaagatatacatttaaagtcataaattttcctctaagcattgcttaattaatcccaacatttttctgatatcacactttcattattgttcagttaaacatattttcaattttttattgtgatttcttcttttacttatggtttatttagaaatctgttgcttaatgtccaaacattcatagatttcctaattgtctttctgttgttgatttctcttttagttccactgtggtcacagaacacattctgtattatttcaaaatttgaaattgttgagacttagtgtctgtcccaacatatagtctattttggttaatgtccatgcacacttgaaaagaatgtatattttgcattttgaatgtacattttgggtttgttgttgttgtttttgggacaaagcctcgctctgtcacacaggctggagtgcagtggtgcaatctcagctcactgtagcctctgcctcccaggttcaagagattctcctgcttcagcctcccaagtagctgggattacaggtgcctgtcactatgcctggctaatttttgtatttttagtagagatgaggtttcaccatgttggccagggtggtcttgaactcctgacctcaagtgatccacctgcctcagcctcccaaagtgttgagattacaggtgtgagccaccacgcccagctgaatgtatattttaaatgtcccaacatatagtctattttggttaatgcccatgtgcacttgaggagaatgagtattttgcattttgaatgtacattttgaatgtatactggatggagtgttttatagataacagttatgtgattaacatacgttatagattatatacatatgtatatagattatatacatagattatatgttatagataacatatgttatagattaacaacagtgaagttggttaattatgttatttaaatattccatatccttactgttttattgttgctattgtttgttctctcagttactatgacaggtatgttaatatctccagctctgattatggttatggctatcgatatttttagctttgttaatttttactttatatattttgaagtattaatttcttagaaatttaggattgctatgtcctcttattgaaatgacttttttattattgttaaatatttctaccttttctctagtaagaatttttgctttaaagtctattttgtctgatattatacagctacaccagttttctttatacatgggttgatatggtatatctttttcatctttttattttcaatcttactatataatcttactacatttagtttagtaaagtttttcactatagcttttttgaaaaacaaaacccagtctgataatctttgaatttagaccatttaaatttaatattgttactgacattattgagtttaagtcaacaaacttactatttattttttattttcccatctgtctttattcctttattcttactttttagctttttgggaagggattaatagagtttttaaaaatatttgatgttttcttctgctagcttttcaattatacattcttttagagtggttctattagggattacaatatgcatttttgcattcttcactaattattattaatacatctacctcacattacttcttcccccacttcaagctcagtgaaagagcaccatcacattttaacctcattttcctctttctcaccttctgagctctggttttaatggatacatcttgtacaagtgttatacaccccacaaggcataattattattgttttaagcagttaatatttatttttatttattcacaaatttaccctttccagggttctttctcctgcagcagtttcatgcttccatctggaatcattttttctttaactcagataaattccttgcagatttattatcatactgtgtagtatactgaagatcatgaaacacatgtttatttcacatatatttttgaaagatatttttgctggtgataaaattctaggttggtgagactttttttaattttaattttcctttcaacactttaaagttatcattccactgtcttctggggtccaaaaatgtctattgaaaagttagtcatcagatgtattgttactcctttgaatgcaatgtgtctttttgtctctggctggtttaaaaattttttcattgcctttggttttcagtagtttgactatgatgtgcatagatatggctttcttgtttttattcttcttggggatcactgagcttcttgaatctgtgtgttgtctttcatcaaatttgcagattctttgccattgtctcttcaaatattttgtctccctcactattctcatcttctggagctgcagttacatgaatattagacttttcgattatacttcatttttttatgttttgctctggtttgtccatcttcatctctttgtacctcagttttgtatttttttaattgacctgcctttcagttctaaattcccattttctatcatatctagtcttctattaagcccatccaagtgatcttaatttcagatattgtattcttctgtggtaggtggtccaattgattcttttctcatagtttctaaatcttgattgatattctccattttttcttctgttttgtccatttcctctaatttgcccatatttttctctatctcctcaaacatattatccatggttattttaaagttcctgtctgataagtctagtatctgaattatctctggatctatttctattatctggctatttcttggatttcaggtatttttggtccttttgaggtttttcaataatacctcatagttttttatccaatgctggacattatgaatgcaaagttgcagagcctctgggtgaaggatgttagctttctccaacaatattgggggaacgcacccccaatatttcaacgtaggttctattttccataagtgtcggctggctgagaaataaagagagacagtacaaagaaaggaattttacagctgggccactgggggtgacatcacatatcggtaggaccgtgatgcctgcctgagcctcaaaccagcaagttttttattaagggtttcaaaaggggaggggatataagaacagagagtaggtacaaagatcacatgcttcaaagggcaaaaagcagaacaaagatcacatgcttctgagggaataggacaaagggcaaaagcagaactactgataagggtccaacaaagatcacaaggcaaagggcaaaagcagaactactgatgagggtctatgttcagcggtgcatgtattgtcttgataaacatcttaaaaaacagaaaacagggatcgagagcagagaaccgatctgaccacaaatttaccagggtggagtttttccccaccctagtaaacctgagggtactgcaggagaccagggcatatctcagtccttatctcaaccacataagacagacactcccagagcggctgtttatagaccaccccccaggaatgcattcctttcccaaggaatattaatattaatattccttgctaggaaaagaatttagtatatcttccctacttgcacgtccatttataggctctctgcaagaagaaaaatatggctctttttgtctgaccccacaggcagtcagaccttatggttgtcttcccttgttccctaaaaatcaccgttattctgttctttttcaaggtgcactgatttcatattgttcaaacacacatgttttaccatcaatttgtacagttaacacagttatcacagtggtcctgaggtgacgtacatcctcagcttacgaatataacaggattaagaggttaaagtaaagacaggcataagaaattataaaagcattatttgggaactgaaaaatgtccatgaaatcttcacaatttatgttcctctgccacagctccagccggttcctctgttcggggtccctgacttcccacaacacagcaagtgttgagttttgttctagcaggcagagagagagctagcagatctccttaatcttgtcaagccttgcttaagtctagtctatttcacttttgtctgtactactagggtgtggtttttattcctaaagcctggcctttctgggttcactgctgaaagcactgggtgtttaccgacttccctttactttgacccagcttggactccaaccctaaccaattaatgattggctctttagtctctaagctgctacttttccctcaatttcttgttttctcaatctgcatgtatagcttaggagtgggctaaggacttgaggggtaatttgaatacaagtatgtttgtctctttgtttaaagttctcttctctttggaattttgctccttagatattagctactctgtcatccccaaactctccttagctcaatagactatactctttgcttgggttccatttcccagtgtagcaatttggaaagatctttcgggaaagatctttggaaagatcttggtgtttcgggaaaacgccaaggtggctgtagagcttacttctggtgcttcctttctttcaaggcttgtagttcctctagtcctgtctgcatttattgctctccaatgtttccaaatagctatttgtatattttatctagcttttacaatttggtgggtgagttaatctagtgcaagctactttatcatggagggaactggaagtctgattatcaacaactcttagacaaggaaattgagacctagagaagtgaagtggctttctaagcttatacaagaagtcaataccagtgctagatctagaacatgggccacctgactcttgtccaaataaaagaataaagaagtttcagttcacattttgcatttattttcaaaacacaaagattatattttaaaaaaatataatataacttacagtcccacaactgtaagttacatgtacatatatttggaaaaatatctgaggaaagaaaagaattgcctctaatcctactatgtagagataaccattcttgatgtttttgtgtttccttccagtcttttttctttctaagaatactattgttaagcaaaattgtatatatgtatatatttatagttaatatgtatatatagctatcatttattgagcaatgagaagtgctttaattccatgatctcatttctttctcacaatagtccaaagaggtggcttatgattatgagcttttgcttacatatgtagaaattgaagctcaagcatacttgcattcaaattcccttcaagtccttagcccactccaagctgcattttttttttttttttttgagacagagtctagctcactctgttgccaggctggagtgcagtgatctcagctcactgcaacctctgcctcctgggttcaagcagttctcctgcctcagcctcctgagcagcttggactacaggcacgtgccaccacgtccaactaatttttgtatttttagtagagatggggtttcaccatgttggccaggatggtctcgatctcttgacctcgtgatctgcctgcctcggcctcccaaagtgctgggattacaggcatgagccactgcaccctgcccaaattgcattttttccccctagcaggtgtcaagagtcttgcccaaagtcacatagctggtaagtggtagagttgagatttgaactcaggtctatatgtctgcctttcagcattagtctttttttttttttttttttgagatggagtcttgctctgtcacccaggctggagtgcagtggcatgaaatcggctcactgcaagctccgcctcccgggttcacaccattctcctgcctcagcctcccgagtagctgggactacaggcgcccaccactgcacctggctaattttttgtatttttagtagagacagggtttcacggtggtctcaatctgacctcgtgatctgcccgccttggcctcccaaagtgctgggattacaggcatgagccactgtgcctgacccagcattagtcttttatagtgttttttgcacttgtctacctctcagaaagtaatgaaccctcacgtttcaaagacttgccactggagatttcataatttgccagtaggaacaccaagagtagagctcatcacccctgcttagtgattgatctggagtgtcaatatttgattgtgccttgtcatctcctttactagactagaaagccccaagaaggcagaaatgttgtgtggttcactgttgtaaccccagtacttggcacaggacatggttgaagttttaaaaattacttacgagggaaaaaaccactctgctttagcatgttaagaatgctttggcctgtggtcccagctactcagcaggctgagttggaaggaatgcttgagctagggaggtggaggttgcagtgagccaagatcatgccactgcacaccagcctgggtgacagagtgagaccccatctcaaaaaaacaaaaatccagcagaatgctttggattgtaagagacagaaacctgatgatttaaatgatgtagatatttattattttatttaaccgaagatgggaaggagtaggctccggggtttattcaacaactcagcatcctccaggacccaggctgtttatgtctttctgctgagtccccacattgttggtattttgtccccgagttagtacctcataatcacaaggcagctgctgcaggtccaggcatcaggtccacatttaagacaataaaatggaacaaggggaggtgccagctacttttcttcttgtgtgtctctcttttatcagaaaacaacaaaatctttcccagaagccctcaacagacttattttacgttggttttgtccagaactctatcatttatagctgaaaggaaggatgaaagaggatttgtccaaagaataagattatgataattggactgaccacaggtcaaatctagccttgggctgtttttatacatcccatgatctaataattttttcatttttattttattttatttattttattttttgaaatggagtctcactctgtcaccaggctggagcgcagtgtcgcgatcttggctcactgcaacctctgcctcccaggttcaagcaattctcctgcctcagccttccgagcagctgggactacaggagcgcaccaccacgtccagctactttttgtatttttttttagtagagatggggtttcaccatgttggccaggatggtctcaatctcttgacctcataatccgcctgcctcagcctcccaaagtgtggggattacaggcgtgagccacctcgcccgggctttttttttgtttcatttttaaagagtgttgggcggggcggaggggggaagaagaagaaaaggaatagaccatatgtggcccacagagcctaaaatatttactatctggctctatgcagaaaaagcttaccaactcttggttagaaaaatcatggtttacctcttgggctatcataatattgccttggataaaactggggtttgattagcaagcaggaaaaaattaacgattggctattggctggcctgccatagagtgtatctctggaccgggccaattgaaaaaatgccttctcggggtgtgatttcagagaagtcaagattctacccactgagaggactgctttttctggcatgagcctttcagtatcagcaccagggacctggtcaaaatgaaaatgtgttgctcggaatgggagactattcagtttgttagcctagaataaaatagtatgagattttatggatcatcttggcccaactctcctgttttacagttaaggaaactgaggcttagagaagggatgtgatttgccagagatcacactcctagttagtggcagaatcaggactgttactgaggtcttctgatatctgtcaaatgctctgttacgtccctttagcaacccagaaaagattgattcagttgattcgctagagattcagtaagcgtgaggaaatgtgatatgggactgatattttttgatggaatgcagttggaaagaaaaccctggaccagtggggtcaagtcctaaatgcctgatgggtgaagaaaccgagcaagagtggatgggttatttaccataattcaggtctcatgaattctcacttccaatctaaacaattgcatttttcccctagtagatgtcagtagatatgtatgcttctcatggcatactcaccaacaaacaggaggattgtgactgtaaaatattaaaaagtccgtgactgttggagcatcatatacagagaggaaagctcagcagtgtggattagacagagttgtatgggtagaacagaaatttctgcaaaagttgggcccagaagattccctgagcccctactacatgctagactccatggaaatcccaaaattatataatgaaagaaagaggagggagccaatattaaaatatattcagcaccaggcagtatgctgggcataatcacaaccatgatttcttttaatcctctggagggaaagtattttttctccccattttacagatgaagaaactgagattcagagattatgtgacttgttcaatgtcatagcaagtaagtggtagagttaagactttaatttagagctatctgattttattgctggctctcttttgactacataaactgtcttttccatggatccctgctctcaatgaattttcaatctagaagagaagttaaggcacatacttgaatattaacaatgcaaggccatatgtgattgacttcattcaaatgatatgagttgtacttaagaccttgccacaccaagagtgatcctggcctatagcatagacctccctggaagcttgttaggaatgcagtatttcaggcccatcccagactcactgaaacatgctctgccttttaacaatacttgcagatgatttactaattatgcatgctaaagtctgggagaggtcacaagattgaaaggtgactctggggaaggcatcttggaggaggtgacatttgccttgggcctcaaaggatccatgtggttcctgcagtgatgggaaaatcgggggaggcagaaagctacgagactggtcttgagcttggagagttttccagattggcttgaacagagaggttgaagaatcatgggaaatagggctaggaatgagtttgggccacatcactgagggacctgaattccaaacaaggggtctagagtttgaggtctgaggtgccactgaaggagctggctgaggagtgacaaatcaaagtggtgttttcagaaggttggcgtggaggttctatgcaggtggattcaagccagcagacacatcagggctgctacctactccaagtttgaggccttagactaggcaggtgttagagggtttgaagaaattggagaaactgggaggataggatgggtccaaagagcaggaacccaatgggattctttgggattcctgtttccctctttcagagacagaataagtcaaatgtaaccaagaggtgctcaagtcctctagtcttcaggtcaccatttccttaacatctaaatgaaatgactccatcctgtatcctaggcgggagtccagaaccttccaattccctccacgaggtatcagacacacacatgcatgtgtgcatgtttgttgtggaatgtatggaatgaggctcttcctctcctgagacagtccatgctgtgtcccgttccctctgccctttcacagctcctagccactgccattctcctgtcttaccatgttcctcactctgagtgtacacttcttcctttactctcttgtgttactgactgtccagtggggacagaggatatctatagcaaatggtagggaaaagttctaattcagtggcatgatggcatagaaaatctggggtcaccacttaaggtgactcatcactattgtattaaaatatcattgcgggccggacacagtggctcatgcctgtaatcccagaattttggtaggccgaggcaggcggatcacttgagatcaggagttcacaaccagcctggccatggtgaaaacccgtctctactaaaaatgaaaaacttagccaggcatggtggcgggcacctgtaatcccagctacttgggaggctgaggcaggaggattccgtgaacctgggaggtgaagaggttgcagtgagccgagaccacgccattgcactccagtctaggcaacaagagtgaaactccgtctcagaaaaaaacaaaacaaaacaaaacaaaacacatcacaattcaaggctacgtaaatggaagttacatctctctctcactccattcacctcactcagcatgtcttagttgattatccaatttggtttcttataacttcataaaaagatttccagagaagaggaaatgtcattaaaccttatttgaaattctttactaaaaaagacggaaggaactgctcggccttatctgttgtggagaggagaagactatggtgagatggaatgtctccaggagaagaaggaagttcagggtggtcaggagctgttttgtatttccactgagatgtaggccaaatgccctgccaatagcagaaaggcgttcaggcagctcctagagctagggcaacactgagagtccaggacaggattcaacaggagagacctcctgggacacttgcaaagaattggattgcccccatggggtgtctgctgcagttttagtgctggctgggaacccaggttcgagactgctagctggctggcacggccccagtgtttaggctgtgatttaagatgacctccttggctcctccccttcctcacctccatgcccacagtgtcatcaagggctgcccattctgcccgcagtgtcagtctatctgtcctctcttcaccagcttaccttccccactcctctggggaagaaggacataccgtttcctctgggctttgagcacactgccaggccagggcccctccaccctccatttagtctctccatggggccaaaatacttgaggggaaggcactatgtctgactgtatctcaccagcacttaacatagtagggcctggtacatagtaggtgctcagtaagcatatggatattaggaaaacaaaatagaccataaagcctccctagattatgggtgtttataatttgcttccagtttttggcactccaggaccacttatccatttgagtagattcttcctgtggatgcccctcccctatagggtctttttaatttgttcatgcttaaaagttagaatagttttgaatagataatacagccatatggtccaacaatcaaaatgctttaaaaggtactcattgagaagtcctggtctcacctccaacttccccctgcaacactctaccccagcttcctagtattaacacttttgttacttacacgttcttcgagtatttcctcatgcaaatgaaaaattcaaatatatgttcctttttttttttttttttgagacagagtctcgctctgtcacaggctggaatgcagtggtgccatctcggctcactgcagcctctacctctgaggttcaagtgattctcctgtctcatcctcctgagtagctaggattacaggcatgcaccaccatgcctggctaatttttgtgtttttgtagaggcaaggtcttgccgtgttggttaggctggtctcgaattccttacctcaagtgatccactggccttggcctcccaaagtgctggaattacaggcatgagccaccatgcccagccatttgttacctttttaacacaaaaaagtggcatactatatgcactgtgctgtgacttgcttttttcacttaataataaaaaccagaatgttccatatcagtaagaacatagaaagcgtcctcattcttttttggttttcatctttaaaaaaaaatacttgcatagtatcccattgtgaggatgcattctaatttagttacccagatgaacacctgggctgtttccaaacttttgctgctacagacaagctgcaacaaataaccttgtgtatgcatcgtttcggatgtgtccaggtaaagctgtaggatcagttcacagacctggggctgctggataaagggtacgtgggatttcagtagattctgccaaatgaccttccatacagggaagccctgggttttgtttgttttgttgttttgttttgttttgtttttgtttttgagagagggtcttgctctgttacccaggctggagtgcagtggtgtaatcgtggctcactgcagcctcaacctcccaggctcaggtgatggctcctacctcagccttctgaatagctgggagtacaggtgtgcaccaccatgcctggctaatttttttatagagatggggttttaccatgttgctaaggctggttgaactcctgagctcaagcaatttgcccaccttggcctcccaaagtgctgaaattacaggcatgagccaccatgcccagtctttccagctaattttttaaattttttgtagagacggggtctcactatgaccctccggcctcagcctcccaaagtgttgggattataggtgtgagccactgtctggccaggaggcacggttcgctctccccctgcaaggtcggagggtgcctgtttctcatagcttcacagcagagttgtgcggttgtgatttggatttttgccaatctgataagtaagaaatgccatcttggtgtaatttctatgtttattgattaaaactgaccatctttccaccttttaagagcatttgtgttttttccatgaactgtgtgtcatgtgcatgcctattttttcttttggttcttggtctttttcctgctatttttttgggagctcttttctatggtgggcagatgagaccattgtctgtggaatgattgcagttttcctgagtgagtcattatctttgtactcatgttgtggtttttgtttccctcacatagaaattttggattttttatatagtaaaatttatcaatcttttcttttatggctttgtgattttgtatcaaagttagacagcctctttctcgctccaagattatgaaggaattcacccagaggaggcgagaggaagcaggtgtgggcccctcacagcaaatgctgccaacatcacagttttgtttgggatttagccacgttcccacggggagaagggtttgctgccagaggctgatgcccactgccaaaggcctgggtgccagtcaccctgctcatcagctggtgccctttgcaggggctggaaacgaggcaaatgaggggaaatgaaacgtttggcagccccatgttcccaacaggtgagttctggccaggtgcagccaggtcagtataatgaaaggaaatagaattagaactttgaagtgaaatttgagactcacataaacttgaacctttcctgggatttgaaaagaagtaattaatttagaaatgtgtttcctcaatattaaactctgccacactgactccaggcaggaaatattctggaatagattcccaaatgtgaattcatttgacatggaggcagaaaggaaatgatgaggcagataataacttctctaaaatcttcagtccagtactatgagtttgaagacagaatgaggcttataaatgtttgggtctggggaggttttgacatcaactagcctgggtccttgtctttgctctgccactcactatgtgacctcagacaaattccttcacttctctgagccttagtttcttcctctgtaaacggggataatactaatcattaggcctaacattgattaagcactaaggcactgcatttgatgtttcacatgcattaaactgttcactgtctagggcagctgtgaaaactaaatgccataccatgaagagctttgcacagtgcctggcacaatatgagtcctcaataaacattccccgatggtactgctgttttgtatgcttactgaaatcagatgggaaggctccacttttaattgtggtgtcattttattcattcactcattccacaagtgcttcctccgaccctaccacatgtgggtgctggagacaacggtgagcaaggtctgcaccctgcagagcttacaagctaacaaggcagacccagtggtcagtgctgcagactgaatgtctgtatccccccaaattcatatgttgaaactctaaccccctatgtgatggtatttggagatgaggctttggggaagggttaggtcatgaaggctcagcccttgtgaatgggattagtgtctccttataaaagaggccccagagagctccctcaccccttctgccatgtgtgaacacagggcaagaagacagctgtctttgaaccaggaagcagaccctcaccagacaccaaatcactggtgccttcatcttgaacttccaagcctccaaaactgtgagaaatcaatttctgtgtctaaaaaccacccagtctgtggtattttgttacagcagcctgaatggattaaaatgatccatgggcagcgaccacactctgccatggggactttgctggggagcagtcagggtgctgaggcagcacagagtgaataaccctgtccctgctgcagggcttgccaaacctcaggcacatggtccctctggaggagcaataaccattataggagcagggaacacttagatagcaagtcctttgaaccggaagtggttcaattaatactcatgacagctgtatgtgcttggtactattattatccctattttacagataatgaaactgaggaaccaaaatgttgttcaaggtcacgtggctaataagtagtggagctgggatttgagcctggaaatttggccccagagtttatgtcaggaggtagatgcagagaggagagcagagatgctcaccactgcaaactggactgagacctctgcaccgtgttaggaatcataactgccaagtgggagcagaacggagtggcaagaagaccaggcgctggggcagcatcttggcaggagttttttttttaaagcagaccactgctctccagccttggcaggaccatcagcggggcactgcaggtgtgcctgcgaatggctccaggaatcctgctggcctaaaatgatactttacaggatgaatcttgtttggttcaaggcatgtctcccagtgaaaacgaaaaggcatttggcaggaccagttcctaaagtctctatcaactatggctatttacctaaaatgtgttctcctactctctactctcttctcctaggtaaggttgctgctcctcctcagatgcccaagccaggctcataccccacacttggtgctgctatagcatcctggacctgcatttcacagctcttgcctaggacttaattttaaagtttggggtttctttttgttttgttttgttttaattttactttacttttgaaatggggtcttgccatgttgcccaggctggtctggagctcctgggcttaagtgatcctcccagctcagcctcctgagtagctgggactacaagtgcatgccaccgtatctggcactacaggtgcatgccaccgtatctggcactacaggtgcacgccaccgtatctggcactacaggtgcatgccaccgtatctggcttggacttacatttaattggctgataatttatggcctcaagagagcagtgactacgtctgttttttcttaccctttagcacctgtcatgggactggaatgtagcagacgctcaataaatatctgatgaatgagtaaataaatagccagcacttcaggagaactgagatagagagccatcaaataggagggtcaggcctgggtgtgacacacctcctactttagaagaaaagggcttgggcattcagaccctgggcacaaagtcaccagtgatctaaggaaaggagccagcagaggtggacagcacctgtttgctgactgagctggagggcccacattggctttggggtagaccagttctcttctaaacactatcagtagccactggattgctgagcacctagtgaggtcctgtttccattcaccagctacatggcctcatgcaattattcaccctcaccaaagatctgtttccttatttataaaatggggatataaaacttcttcatagcaatatttggaggaataaaatgaggtagcatatgaaaagtgatgtgtagtgcctggcttaagtacttgaccaatgaatgctattattagtatggcatttttaaaaactgtatctagttcttaacatattatatttaatcctcaaaacatccttgtgacagaagttatgattcacatttttttagataagggccttcaggcttggatgagtcaagttgctgctcaaagtccacacagttgggggcaatgctggaatttaaacccatgcctgcctgtcctcaaagccaagttatttttattcactgatactcagaaatggggccataacaaagtttagttgggaaaaaaacctgatataacaaaggcagtattgcttgagtgggagacactgcgatggaatcccagaacagggagcttccctggctccaccaatgggaccacatgcatcttccctgggccccaggtcccagttccttgcctttgctcctgctgcttctgcctcttggagtaccctctcccttggtggcctcctcccagagtctgacaggtcctcttcaaaatgaacagggcaggttacaaactaggatggactgtatgaccctcacatgttttaagtgtagatatgcatgtgcttgtgtgtgaaagaaccctgataaaagatgaggcaaataggataaaaagataacagttgttccctctgttgagaggagcttggattctcagatattttctccatactttcttaattttaaaaagatgaacatgcattacttttgtgaatataaagcaacgttattttttaaaaacctcaaccatcccttcagggctcagctcaagtgccgtctcctatatggagctgtgacgtcccctggtgtgtgtttgccttgtgaggtccttggtgatgccattgtctttgcccctgtaaatcttccaaagcagcagatcccagcagacagaattgctccaaaagcctcctggccggccaggcacagccaagggcaacctttccccgcagatggctgcagagggtgcttttgaacgcttaccctctgttaagctcatttcacttaatcctcccaacaaccttttgaggtagggattattattatcctccatttagagatgactgtcttaagacttaaacgggataattagattgttaaacatcacatcacgttccatactcacctggatccactctgccacacccagcagagacccgtgctgcagccaccttgcttctgggaaagtgacataatctgtcaggtccccttgtctttatctgctctcaccttctccaccctactcctcacttccatcccaccttccccccatctggtgcccatctctggctcactccaggacacagctcacctatcacttcttccagggagtcttctctgacaagctctgctttttcatgtagtctgggttggccgactcctctgtgcctacctgtatcacagcacttaccacttcttgctgaatttgtcctctctctcctctgcctttctcttttcccaaccaaactcaagggcaagagtttaatttctttctccccagtgcctagttggcacaaataagatattcaataaatatttgttgaacaaattaataggattcttataattgccatagaagatgaccattttacaaatgaggaaaaatgaagctcaagtaagttgagtgatttgctcagttctggccagtaagtgttaggattattcgaatctaggtcttttgacaacctgtccaggtggaccaaaatgctgaaatttaaagaaacaaaaatgtaaaaccccgccagttttagggggaacaaaaatactaacaacatgccagtgcaagctaggtagaggtagattttggttgtttttcttgtttaaaaaaatacaattgacaatttgtcattgttgtttgtttttgagacagggtttcactcctgtcacacaggctggagtgtagtggcgtgatctctttgcaacctccgcctcccaggctcaagagactcttgtgccttagccacccgagtagctgggattacaggtgtgcgccacgatgcccagctaatttttgtatttttagtagagacagggtttcactgtgttgggcaggctggtctcaaactcctggcctcaagtgatctgcccccctccgcctcccaaagtgctaggattacaggggtgagctaccatgcccggtcccatgtttttcatatagccttttctttcctttcaattatttgctcagtattataatttctagaagttgggttgtgaggacaagcagctgaacattttagatgtccctcagtattactgccaaactgcatactaaaaacattaacactaccttcaggtataaagaactctgagagtgtcaatttcaccatgtatacaccagcatcaaaaattgtcattatttaaatttgcttttccctcagagatataaggagtgcctcattatttgtttccttttcacttctttgtgaacaacagaggttgagtattgttctatgtgtttaggggttcacttacccacattcttgtgagacccacatgttcatgtctttattgtgctgttctttaagactggagaaggcacacttaagtatttaaatactaagtggaaggcactatgctaggtcctgcaggaggtaatgcagatgactgagataccacccctgccttctcactgagtttatgcttgagcagaagggatggatgtatacagaaataatgctccagtcacctgaggtcaggagtttggcaccagcctgaccaacatggtgaaaccccatctctaaatggggtttctaaaaatacaaaaaattagccaggcgtggttgtgggcacctgtaatcccagctacttggggggctgaggcaggagaatcacctgaacctgggaggtggatgttgcagtgagctgagatcgtgccattgcactccagcctgggtggcaagagcaaaactctgtctcaaaaaaaaaaaaaaaaagaaaagaaaagaaagaaataatgatccaggtggctacactgggcagctaacaggcaaataatgtgttatagaagcacagagttaggatcaatgattgattcctgactaagagagtatcaaggaaggcttcaaagagttggtggcatttattccaggctggaaaggatgagaaacatctatttagaagaactccaggttgacaaagcatcatgaacaagtgttgagtctacgatgtattttacattccgttcctgagaacatttagcattagtgtggtttgggttctaactaccagttagaatggttttggtggcagggaagagaatacccaatgaaaggaggttttatcaactgaagaaactgtgctatctcatagaacaggaggcagccattgtttgggttggttcaacagaggcaccacatgtgacaatcagagcccccaggctttccctttttttctctgccttcctaggtgttgactttgtcctcagattgcgtttttccccatcccaagtttgctgctttcatctagttattgtgtcatctcatagccacattcaaaagtagaacaggccagaatctctcactccttcaattttattagggaaaaatacttttcccagaagccccgagagagagtgtctcctgaaatgtgatcggcccgcatcatgttacatgctccacctaatccaatcagtggctagatgacataaaattaattaccatgattgttgtaaatgaatcaacattcacctttctaggatttgaaagggggtcattctccttgaacacacaatcccctctaaactggcgttctacaaataaggaagaaggtgggtacatgtaggttttgattaagcaacaacagtatctgccacagtgcttacaagcagacatttaaatcagaattacaccaatattgataaattttcatcaagaagatattttctagattcagctttgatgagctaatttaattttagaaaaatttttctatacatcatatgacattttcatttttttattttcatttttgttttatttaaactattttcatagataccaattcttttccatataaattttatgccacagattgatttcattgatctttttaatgtctatattaaattttattgataatatttgtaggctttgacattattagttttcttcttgagattgttatttatcctaattatcttgggccaaattttgtgggtcagggaattttatgttgactgttcctatcaataatctttattaggaattggataagagactgattatatgtatttctcagtaaatccatgatgaaattgtgacaaattctttttagatatgctaaaaattaatctgttattcagattgtggtattgcagggatcagcaaatcagggtcatgtgagctaaatctggcccgatacttgtagggctgcaagttaaaaatggtctttacagatcaacttttgcaatctatttaataataggcaatactaattttaatcccaattagaagaacattacccacacccccaaaattaatttaattcttcttattaatagacatatattacaaatattatattcgattattactattacactggattttttttttttttgaatcttgctctgttgcccagactagagtgcagtgctgtgatcttggctcactgcaacctccacctcccaggttcaagtgattttcctgcctcagcctcctgagtatctgagattacaggtgcatgccaccactcctggctaatttttgtatttttagtacagacggggtttcaccatgttagccaggctggtcttgaactcctgacctcaagtgatccactcaccttggcctccgaaagtgctgggattacagatgtgagccactgtgcctggccttacattgaattttattaataactatttcatggaaacttgttttctctcctgtcatataaattctacataatattcttgatttttactattgatgcacaaaccctaaaatatttactatcatgtcctttacagaaaatatgtgctaaaccctgctccattgcattgctaacctgattcttctgaacactttccctccccacattaaggctctgcttcattggggttacaaagaacaaatggtgaatagcttagtctgttcaggttttcataacaaaataccataaactgtgtgggttatgaacaacagagatttatttctctattatttattctcaacgatttattaattaacagagattcattctcccagttctggaggctgggaagtccaagatcaaggcaatagcagatttgggtgtggtgagggcccactttctggttcatagatggctatcttctcactatcttctctgtcttctcagaggggagaaagtggtatgggggagctctctggggtctctttcataaagacactaatttcattcataagactcatgactgatcacttcctaaaggccccaccttcaaatatcatcatcatctgggggattaggtttcaacacacaaattttgggagggtcacaaatattcagtccatagcagtgactgaggtccctatgtttttagggttgaaattgtagtctgtcctgcttcagttaggaaaatattaagtggatgagtgtgatcacattgctcagtgataaagggaaatgctctttaaactctaacacattgtgtcaaataaaaacaaaattgacatgagagttttaaaataaaagtcaatttcccctttttagtattaaagtatgatgagtctaacatgttggaaaagccaaaatattgtttcaaagcatcaacatttcaaagaaacatagtcttttgaaacttgggagagtcgagaggacttttactttttcctactgtttcctactgaagttagcttctttttctttcctttaacagatgaggaaaaagaaaataatagagcatccaagccccactccactcctgctactctgcaatggtaagtttccatttttagcaagttctgtcttcagaggatgctcatatcttcttgtctataggataggatatcacttggatattttaacattgtcctgataacttgacattccacaacatgaaatctatttaatttgcagtatatgtaaaatgctcaactagccttagatctagcctggagattggaatttttgtattttattttagggtagatgttttttctgttatccaaacactggcaaggactggattccccatgggtattattaattgattttaatagaatccattattacaatttataataaaaacagaggtctgttgactcttaccaatgaacccttaattcataatgaattacaattgtatataattattttaacattaataacactaacaagagtaatctactagaatggctttctctttaatatttggcattcctgggcttgatgaaatatttaataatgtttaagtggttgcacttgtgtttgatatttacagataaattctcctctaaaagctttatttggaaattatgttgtagctttgaacactagagctctctatgcctgagattcaccctatgaagaatcttggccattgaaggcgattattcccctagcagtgcagccgagcaatatgaaggaattaaggaatgacggggaaggaaagagaaatggggaaaagaaaggaactaaaatccattatatgcacccctccaggctaggcactttatatatatgcctcatttcattctcacaattctgtggagttgctattgttgtgcccatttaactgatgaggaaaataaagctgaaccagttaaaccatttgcctgaatagccacacagccaatcagtggcagaggcaggaagtggctgggtctctttaactgcaaagctcatgcttgcgaagaaaggaaaagaaacatcaggaaggatagagaagagaggacagatcagaaaaggaagcagatgggctttaatgagcaaatcatattagattctctagtctaatccatccagaggtgagaggaaaacaacactgggagaaagcattcaggaacgtaactcaatcttctctaacaagagcctcagcagtcagcttgttttgcttcaagaatagcaaaggttgttttcaagagctctatttccagccttttggcctctttccatcatttgttcctatagactttttctcattgcatttgctgctttttgctttatttaaaattctactttatgtatcagatcaaatctcccccttcacccttctctaagtattatggccatgcaagttcccatagtgccaagacatcgaatgaggcatcgatgtaaaggactctgggagtgggagtttctagacatgcatggaattgacagacttttttttttttttttttttgaggtggagtctcactctgtcgcccaggctggagtgctgtggcgtgattttggctcactgcaacctctactttctgggttcaagtgatcctcttacctcagcctccctactagctgggatcacaggtgcctgccaacatgcccggctaatttttgtgctttttgtagagacagggtttcaccatgttggctaggctggttttgaactcctgacctcaggtgaccctcctgccttggcctgtcaaagtggtgggattacaggtgtaagccaccatgcctggccaacaaacattcttgctttaataacctgaacatgtcatatgtttcagagtaaaaaatttgaaaggaactagaagaaaatcactttgttcacatctatttttctgggattccaggacatctgcctgggagcagtgaggctgtaaatggtgcagtctctgaaatcaaactgtcatggcttaactcccaactctgccacttacaagctgtgaagtcttgggcaaggtccttaacctctctgtgcttcagtctactcacctgtaaaatggggatagcaatagtgtctagctcatagggtagtcatgaagatgaaatgagttgttctatagaaggtgcttgaacagcacctggcatggggtggggctcagtccttccctcagcacactccttccttctgagacccacagggaccacctggagcaggccccgtctcctccctggcataggcacagccagttctccttctatggtacctaattctgcacaaaatatctgtttttctaaataaagggtcacatagatcattccagaagaaatttcaccctccaagtcacaaggtcagacagtgaattttttttaatgataagtctattttcaaagccaaaccaaatctgagaatttgtacatattcgcctattcttatcaaaagacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctatatctatatctatatctatatctatatctatatctatatctatatctattttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaaagtgctaggattacaggtgtgagccaccgtgcccgtatatatatgtcattaaactaatgacactcagggcacagtggctcacgcctgtaatcccagcactttgagaggctgaagtgggaggatcgcttgaagccaggagctcaagactagcctgggcaatatagtgagaccctgtctctgcaaaaaacaaaaaacttagctgggcatggtggcataagcctgcagtcttacctactctggaggctgagacaggagtatcgcttgagccttggagatcaagactgtagtggcctgattgtgccactgtactcaagcctgggtgacagagcaagaccctgtctctatttaaaaaaacaactaatgattgatagataaacaagtaatgcattagatagtgagaagtgctgtgcagagactttagcttggctaatacgatagtgtctgagaggctatttcaggttgagcagtaagggcaagtttctctgagaaggtgacatttcagtggatacatgtatgacaccatgacagtgtgaaaaccagggacaggggaatgttgcaggtggagagaacagcttctacaaaggccccactgttgcaggtgacctctccagattgagcagagttgtgcctacaggtggtttattagggcatgcgcccagcctccacgcccataggggtgtgagggatgctggaatagacagagggggtgttaggcagtgaagaggttatcacagaggcttcagccaatcctacagggagttctgaggtggagatggccagttaaaaatgatctgaatcaaagcaacggatccagacctttatcccccaaccccattgtccatcactgaatacaggctgcccccagggtgggggtgtaacttgggagaggcggttgccttcatgttttgctgaggatcactccttggaatgattcagcctcccagtagggggaacaatgtctcagtgcctcagggcagtctgggcacactcagcgtccaccactccttcccgggatgggagcaggctgagcttgctgaaggacccacgagaaggtggcccatgtggttggagcatagcacacatggaggagaatgacacaagatgaggtgggagaggcaggcaggggagaggctacataagcagtagggaaaagaaagtaggacattaaacttagataggaacagtcatgcttaaaacggtgtggagaacatgtgacctcctacgtaaagctgcacatgtatcatcttttaaaaaatatggtttcagtataaaaactttctctctcaaaagagagtggatgcaccctccattttacaaggaaaagtgacatgatttacaacgtgtcccctttttgctgtggctgccgtggggttgagagctaaatctgatgcttacagacttttgcaatcacttctttcctttgtctaattttcttcttcttttgctagcttaaaaaaaaacccaggatataagtaaatttaataaatatatttttgctttacttttattttgtttacacaagaaatacatttccttgttaaaaaattaaaaacattataggtaagactccagtccatttctccttgtagttctttgccttctcctcaaaagcaaccctattcagtgagacatgtgtgtgcatgtgtgcacttgtgtgtatacatatgtgtagatatgtattacagacccttccctatgaatttgcacacatatgtatctgtagaagtttctgaagtatggtttttaatttagcattgtctcctttataaaaagcatgcagatgtatcacactaaaaatattgacccgcaacctgttatgctgtattgatccactacttgctttcttccttagtagaatgtcctgaagctacactcatggttcataaagaacaacctcattttaactgcagctcagtgtttagcataagacaatggcagaattaatgttgccatttcccctttttttttttttttttttttgagacagagccttgctctgtcactcaggctggagtgcaatggtgtgatctcggctcactgcaacttccacctcccaggttcaagcaattctcctgcctcagccttctaagaagctgggattacaggcgcgcaccgccacatccagctaatttttgtattttggtagagatggggttttaccatgttggccaggctggttttgaactcctgacctcaagtgatccaccggcctcagcctcccaaagtgttgggattacaggcatgagccaccccacccggcgccacttcccttttgatgaacatttaagttttgttcaaatctcatctttgccattacaagtagggcctcacggaacatcttcgtgtgtgcccccttggacaccgtgggagtgtttcttcatgtctgtatcaagaaacagaattgctccattaacacttaaagtgttgatgggattgcaaaattacccatcaaatggctttaccattttatatcttcatctgcagtgcaaaatacttacaaaacaaaacaggaacctaatgctaggacaagcatctcattctctgaggcatttatgtccttcatgctgtgccctctctccagcggcagtggccagcccctgaggacagagaggagggcaggcccaggaaaggacactggccgcaccactaaggcgcccgccacccgcctgacagtgtcgagctctcctgggacatttggcttgttattggaattgggttaggagctatttgcttctccttcttccccttccttgccacaaaccccctccccctccccctagaacaaataacaccgctctaagaacaaataatacagcagccaagcagcctaaaataattggggacacgtgatctggaggcaactcccagcagaaaacaggcaaatattgtcaaatgccttctgccaaacactttccagcatcctcggtcacgagggttagtaaatcccaactcactggggatggtgagcgctgctggaatcccggccgcacaataacctctattcatgcagagaatttcgaaatggaaagcagcctgttccgcagtcccggcctacttgctgccaacacatgccccctccgtgccccgccctcgcccgccacccttgccgcccttacccagagctccttgtacgccttctgggtggggacgttttcccttccagcaatttactgaagaaatgaggctcttccaaaaaggaggacagaagatcaaattgtcactttcgggggggattggggggagattttcctttcttttgaaaaaaattaaattgaggacttgggtggttgacaagctatcaatattccaaattaatatgaaacaaaagaaatttataatttctctttagaatgttctggaaggtcataggtaagacattgggtttggcactgttccaaagaagaaatacattgacattttagaccagatcacagctgctagatcagactcattggatgtaaccgataactgacattttgcacccttttgtgacttgattcttactcaacagtgacagaacattgctttcataatgtgagttaggtaacatggttctaaaaagggaggctgaacacttttagctctgaacacaaccagtgttgatagataatgccactagatgtgactgtgtccctccggatgacctcagctacagatggagaaaggtcagttaagctggacaacccaatgccaagggcagaaatttctcagggaatgagatgctgtgttgtggaaccacaactttttttaaaaaaagtattttgtgctgtgggtaaatgtgtcaaatggtaaagccatttgacgggcaattttgcaatccattagcatttgaagcacatgcagccagcagctgtgcttcttgatgctggcagggagaaacactcccacacaggtgtgtaagggggcacatacgaagatgttctgcggggccttattcataatggcaaagtgcagtagagatgagtagagtactgggtataggtggaaagggaccactgaggaggtagcttctggtaggggatggtgccaaaatcacctcagctactgtccaggacaaccagagctctgggctgcaaacctgtagcctaggccccaaaagaagcattcggaaccaaatggaaattgcaacactgtgcttaatacattgcctagttttatccaaaaaaaaaaaaaaaaaaaaaaaaaaagaggggacttgaataaccaaaaactgagctgagagattccagaagctacctaagcccaggccttactagaacactaattcagtaggttgtaggtcaaacccagcgtaggaattggatgactactgttctggtccagtttagacattacaatggcaggaataaatctctgattcagtccattgccccacatcagccaaacctacaggttcagcaatcacccgtgggatgccaggcttgtcaggtgatgtcactgctgagcacacctaatcctcatgaaaatcctgtagagaaggcaggacagctacctgtatttaaagaggaggaaaccaaggtagtctctttctacacaaagagggggacattcctgactccccagggaaatcctcaacaacaaggaagctgggtcagctgaagtcccctgagaaatgtcagtgtccacacaaatgcatgtttctgattggctcgtctacttggcagcaaagcatggcttaatggttgtgtaatgaaatagattgtttttttgtttgttttattttgctttggagttttctagacttagcctcagtcctaaccagagcctgtatgagccaaagcccactgttttctattcatttgctgtctggtggtgttatctccctagctcccatcttccttctggtaaactgtcagtttcttaaaggctggggcaagagtagcatcttcttgttcatggctgtattctacagtgcctggcatatagtaggtgctcaataaatgtattctgactaaccaaatgaatgtcagtctctggcacatagtgagaactttagaggcatcatacctgagttcatactttttaagcctagcttttcccagcagagtcgctgtggacaagccactttacttccttggccctccatttcttcctctatgtcctagggcatagtgtttactcatcttgtgggggtagtgatagccaatatgaacatccctagcgcagggtaggcacttgaaaatataaatcaaatatattaatattaaccatgcttttcctttaactacccagatattaagattaataaaataccagaatcccttgacctgtgcaaaagcctgccttccttcttattggcctttcctcctttcccctccttcctcctgcagtgtttactgactgtgttcaggacacagtgctaggaactatgttaacatcaataggaatttggtttgatccctgccatcaaaggactttcagtttaagatacaaaacattacctgaatattccacaatattgtaaaataatgctaattgttactctttattgagtgtcccccacaataaagggcctcaggctgtgcatggattcttgtctagtcctcacagcaagcttgggagatggtacagtttctctcattttacagatgaaggaagtgagagagttcaagtaacgtgccccaggctatatgcttgtaagtggtggaggcaggattcaaagtcagtgatctcaaactctaaaaccagtgctggctcctgatgaagctatttgagccataagctatgaggaaccatggccatccctgggaagtagtgagagctttacaagcagaggatgtggcttttcctacagacataacagcagctggcatttagaccactgcagcactctacatgttattgaatgaataaatgaatttggcagggaggaaaggatgaagaagtggttagcagatggggttgagtgtgcactgaacatagttccatggaagagaaatgtgagttgcgccttgatgcgtggaacacggtggaggaggtcatcccctgcggtaggaaggtgatggatcgtgtgtgtgggtggaaggtgacaaggtgtgtctcaggagcaggaaacgatccagttggctggaaagaggtatacgtgtgggaaagcaggacggaaaaggagccaggggccttggatgccacggtcaggaatccagacttttgtggagagggaacagggagccgttgacgggtgtagactactgtcttgtcctgattgcttagcaagggttttttttttttctacatagtttacagtctcagatctctgtgacaacttcagtgataagttaaaatagttaatatttttaaaaatcctgttgtcttgtaaagtctgggctttctgtaaaaaaaaaaaatcctgtggggttttttttttttttttttggtaaaagagaatgaaaaagtttctgttcttgacatgtgtgcaagaacttgaggagtgggcactttgaactgacgcagagcgacctttcctaagaatacatcgatcatgctgcccccatgctataaaacatctaatcagtttaaaagatctctgcatatacatataagaaatcacaggtttaaaatgaggacagtgggaaatgatgccaggtgccgaaacatttgcttttcattgtaaagtgctgatacaaagcttcctccatgtgccttaggaggccacatgctgaaaccttgtgaggaagtcttcttaaaaatatataactcagataatgactcatgttagctagcagactgagctcattatctctccataataggataggctcaattcaaatataatcaagttgttaaatagaagataaggaaaatggaagaagtgggaatttttttgtgatcattaaaaaaaacccaggtataatggagcattgttcaccatgtcagactaatgatgtcctctaaaagagaggaggaaacgagaaaatttcatcagatatgaagaagaataattaactgcctttctttctgccatgctttggtcagggaagtggacattccaattagcaactttagtagataggcagaacctctggttttgggcaaaggtgtcatgatgctattcctgtagaaacttatcaagcatcaaaggggcccttccatgccaattacatccatttgttcatagagcttattaaaatgcttcatagttataagccacctagttactttgaggctcagaagctccggaaagaggaacaaaacgtgggctgaaatgtagtaatttaggaggctctggcctttgacaggtaactgtttaattagcccagcctgtgtgaaccatgacttacacccatctgatttgaatagtttgttgctgctatgggttcatttgatgtgatgtttcttaaccatgatcttgtattttaatcttgacctcttggccagatttagtaagcacacaagccacaagaacagcaaatggaaactgaggcacaaggagcttaaataaagtaacttacttagaaactcatgctgtttaatgctgcatttgaaagcatgattttcacccttaactgtcctctccttctgcatttctggtagtggagaatggagccccccattcatccattctgcccagttaggaacctgagggtttgcttggttactcctgtcctcctcacatctggcagcatgaggcccacaccctaagtgttacctctgcccccacaaccattgcttcagttcatgccccatcatttcctgccagaactattatagtagctcctaattggtctcctgtgttcattcattcattcaacaagtcctaattaatcagccactatgtgccaggctttgatcgtcctcctgggccacctcccctagaggtacagagcaaactttccaaagaatgcattgatcatgccactcccatgctttaaaaaatctaattggttttaaaggatttctatcaatttaaataatcatatgcaagatgaattctgaatggtttgaaatacacatttgtttagtgtgttcatggatttttttttagccaaaataaattctaggaagccattagcaaaaataagcaaaaagggatacttttatcttccccacagcttgtcatacacaaaattgcagttgcccaaattgttcatgtgtatgcatgagactggaaaatgttccactacaagtgttgaagtcaaatctcttaaaaattgcttaatggaactctcaaaagtcaaagatggccaggcgctgtggctcatgcctgtaatcccagcactttgggaggctgaggtgggaggatcacttgaggtcaggagttcgagaccagcctggccaacatggagaaaccctatctttactaaaaatacaaaaattagccaggtgtgggacacctgtagtcccagctactcaggaaactgaggcaggagaattgcttgaaccggggaggcggaggttgcggtgagccgagatgtcgccatttcactccagcctgggtgacagagcgaaactctgtctcaaaagaaaaaaaaaaagtctaagatgatacctatgagacaggtgttttgttgttgttttgttgtttgacattcttttattatactcaagccattcctggcaaatagaacgtattaagctttaaattaatgtcagttattgttgttactgatgatattattattattatcatcattattattcctatagcatcccggaagcactcaggtcttcccgactcctttgagtctttgtttctttcagtcctcctgagtacaattctaccaccttcttctgaaaataacatttttatagtaactcttgaactccaagtgggtgctaaattcttaagccaaatcatatccatttgtgtggcatttaaagactccctccacctcccatagttcttccctttagataccctttccttctctctttactcagatcagcatctccatcattaaaagcacatggcactgtctcccatccttgctgttctacttgcctggaacctccctccctcccccaactaccgtggcagaataccagagagatttggaatgagacaaaccctcctatttactagctgcatgactgggcaaatgagttacaccctctgagcctcagattcctatcctgaaacatatgtataaatacctacctcatgccatacggttattgtgaggtcaaatgagaccatggatacccagtgcccagcacctagtaagagctcaacagatgctaactgttgttgttacacaatcctaaacccaactcttctatgaaactttaattatctactctcatctacacatcaatctctctgttttcccaccttcaactgtacctatggtcaggagtttatagtaattaaatattatttcttgtgcatatgtctccccaaatagactgcaaagttaactaggacatagatcatgtcttatgccaacacaagtgcctacaggagccagacaaggaacagaaaatagacagggtacaaagaaatagggaggagtgaggactctggccaacttcagggcacatgtagctctggccaattgttgtcgtgcgggaatatgggtccagtgttgccagatctcagctttttcaaaagaagccagaaatccagattcttatgtgcaatgtcctgaattttaaaaattgggccaacactgttcaggccaaaacaaagcatgtctgtgagaccccagtttgagaaagctgtcttattcagatggcccctacaagtttgtacgcgagctggttatttggacctctgaactcacttttatagagaaacaatgccgcgaatggcagttaggggtccaggctaacctcccaggctgattttcattcatactggacctgaaacttaggacagtcctaagaaacctattctttatgtgaaacccttttcccactggaaaacacacttagaattccaatttatgatgtcaaagacatacatcagaatgtaagcctgttcaggacaggaccattgttttgttcaccactgtttccttaatgtctagaacattgcctggcacttagtaaatatttgttgagttaaaggttatctgtgtctttgtccatctgtctaccattaatctgttcactgtatgcaagcatggactatcttgctcactgtgatatccccagcgcctggcaggtgataagatcaataaatatttgttgaatgaataaatgactgaaataatctatccataagacacttactgagcccctactgtgtgccaaggaatatgctggacctcaatgatgcagaattgactcagacactatcccagcctcaaggaatttgatcacctagaaaggattacatcaactctttctgggaacatttctaaaaactatcccaagttactcaatgttccccatcccagaagcgcgggaagtagatgagatgatcggggactattcagcaccaggttttgtcttggtgctgacaggtctgtgtccctagggttgtattccccctctgtggggtttgggtatgaaatgattgaactgatgttcttgcaatcacatgttggaataagttgagcgagtgctgccctttcaagtgggcaccttggggggccgtgtcctcattccacttcacttacgacagcgctgggccacttctttggcaaatgctctcagagggagttttgaagccacttgaggacatttatttcatcactttggaattatgccttatttttgaccaaaaaattgggggtgggggatggttttccagtcactttatcccccaaacttgcttccaaataactttgggttgtttcctaaaatctagttaatgatcaaaggagaaatgtttcctgttggtgcattgatttagcagtaggtgccccaggcttcgaaggcatgaccctaagagaagttcccaaattgtcttgtgccacagcagttttcttgggaaaggtatttaactttccagagtgcctaggacaatggaggcaagatttatttggatgcctacattctggtgtttgggttaaagaataataaattttttaaaccctgtatctaatttttgtttatatccccaatatttagcacacggtcaggacatatagtgcccaaaaatgttttctggagaggaagaacgaatcatgaggaggtctgacgtcttctcagtgcttcccatgcacgtgccaggcaccatgcggatgcttgtcacacgttacctcgtctgatcattataaccactttaggaggcacttacaattcaatcccaccaaaaggaaactgaggcctgagcttaagtaacttgcccaaggtcaccaagccagcaagtgacaaggctgggatgtaaacccagttgtagaaaatctctcctacagaatccctaatggagactcactaagaaggtgatgggtatagaatcattattcctagcacagcagaggagaagaggattctaaagtaatcatggggccaacttcctcctctggtcatgagacctcccttcagtcagcagatcagtgtctgtacagctatacaggcctctcctggggcattggttttcccagacaatccccctccatagcatttgtcagccaaggagctccaagatgttgacacatcctccttgggcttttagctgttacaaatggctcctcaagttggtctgtggttccattcctggctgattggggcacccacaagaccctatgtagtttttggagtttgcatgtatctgatctagccagaacaaggccaggtcaatgacagtacagagtagaggatctgggaatttgggctgaaaaagtagcctggtgtcatacccaaaggggccaggattctgacactgccaagccactaatgccaggcatgaccttgggcagcttgctttgtcttcctgggccccagcttctccacctgtagaaagaacgttatttctaaggactgcccatctctggaggactagaaagaacagaccgttcttgcttggggaaggtaacacattttttgctcattgggcgtttatttccctaggctggaggagaactatgagattgcagagggggtctgcatccctcgcagtgccctctatatgcattacctggatttctgcgagaagaatgatacccaacctgtcaatgctgccagctttggaaaggtgagtccagcctcatcaggcttgtcctccctaccaccccaactttaagtaatttatgcacagttttaaagcattttagttattttttttaagttatcaaagtacttacttactttggtactttgacaacttcaacttcactgtaatactttgctatcaaaatttcaaacaattcaaaaacattgtaaagtaagaaattcaatgtctcacttgaatttcctcagtacttaattttcatgaagtcacttattttctctgagaggcaaatattgaactcacaagtgtgttacatggatgtcaatcagcctgggacaggcaacctgcttggcttagtcatgtggatgcctggagaaactggaaatggccctgtatccttagattggaggtgtgggagtcctctgcaaagagtggtactatttgcattatcactacagtccagactgttctctttccaccttataaaaaaaatgcaatccacatttagagctatgtctacaaaaaattgttagcagtgatcattcccatttaataggccaaggaaagctgttggggcattctttaagactgatcatttatttatttgatggctacaccaaaaaaatacccaatttgagtcaatacatctaaaccttcctccttttgttagcttcctttttctatgtgtaattttttctgcatctgctaacaaaaataggcttgttctgtaccatgattttttatcagttttctgagtgcaggaatacgaagggctgaaatggcagaaagaggtcagtgtatgagtttcaggaattcccttttcagatccccaaaagataaatcatcagtaggaaaagacaaagagccgtgttagggctgagccagccaccctggagagcccaaaaatggagtggctgagaaatggctccattcaataaatgggaggatgctctgtgatgacttggggaggaaaaaacatttttgtgttgattaacatgatttctccaaagtgaaagggatgtttttttaaaagtcagtggagaaactacctttggctatttctttcattcatttcttcaatccttcagtattggtagagactggctgtgtggcaggccctgtgttaagtagtggcagtggggacccagaaaggaactcagtatggctctgctatggaggtgcccctcagcaggtgggagaagggagagcacacaaggtggatgtgtatgctaccagagcttggtcaggagtttgcggtcctggaatattcagtggcacctacaaacccctcgcagaggccacagtggaaagcccagatgaggcctcttacatacaggttggggacaggttgggtgaaccaaaagaccaagaatcctgactttcctggacttattatctaacctctctaagcctcagctgccccagcttcctcagggggatgttgcaagagtcaactgagatgatgtcagtggatgatggaaggtactgtttactcagtcatccaataactcagacatttattaagcacctaccatgtgcgattacaactgttgctgttatgaattctgcatgagatgtctgtgcatggacataaacagacatttgttagcttatattctgcaaaacaaataaaaaccctcaccacttgtagaaactccaatttgcctgcacaagaagcctctattctcttttcctcaactacttttgtaaccctattagcttgtggttttcttgacctcctgatctaggtaaaatcagtttaagcgcacgccttcacctcagcaccccagtcccattttcaatttaagtctcaagcctgccccaagacttcagcaaatctcaaggcatttgcattctcagggtcaccttgacttgagactcttccttctggtcattagccatgtgtggctgtttaacttaaacaaaataataacttcagtacactagcagttgcattaaccacatttcaaatactcaagagccacatgtgactagaagctaccatattgggcagtgcagaatgaaacgttcccagcatcacagaaagttctatcagagagtcctgtgttatactgcagtgagccaaggaggaaactcagtacccactttgcttttcacaagacagcccacaggaagcctctgtgatcctagtagagtgagatttgtaggagaggtttacatcccaaacagggttaacatcccaaacagggtcctacggaacagacatcccccacttcaaaatgctcttcatcctcttcaccacagtgggggcttactggccctgcccctgatggttcccaaagctagtcccagtgcttctccaccctgctgtctcccttttctcctcttccatctcccttctcctcattctcctctccccttcctccttgagacaccccccaccaaatgtctctcttctgcgatctttggtttctgctgacatctatgcccatagaggtacctcactcaccccaaatggcatttcaaaatatttttctgaacaatacatttcctccctaagaattatagtgccagctgcttccaaaatagtcatttaaaaaacatccgaactccatcttatcttcagccttaaaacaaggaaatactctaatggcattaagaacacaaatgcaaatgctctgtgcagctgccttgccatcagtttcaaatggactgggcattggagctgtccttccagccacagaggacaggagctgcctgctaagggtttccacactgagcttgctggattgaaatcccagacacatttgcctttcctgaggactccagcatgctgcagctgccatctccttgagagaaagggactagttgttctgtgaaactttgagatgaaatcgtggacagtcttcctttgagcagatccatccaaacttacaattcattgatgaacttttaacttagagcaggcgaggtttaatatttcagcttagcttttggagaacaaatacattggtagtagtctctacccagtttgcaagtgggctgaggcaacacagacatcaatgctgaagctgtcccccagggacaaccagggtgacctggttgggataccgttcttcataaagtgggtggcagccattgcttcgctgcaagtaagatctgaaatgtaaatcctctttccaagtctgtggccaagccccaaaaacaccggcttccagtaatgctgtattgactttgggtcccagaattaatttagggagtatagagaatgtgaaagcttctagctgaactggtcttgtgcctgctttcgctgttaagggtaatgaaagttcacccaacttggagtcactgaacttttctgagctcatatttccttatctttagacaggaataatccctcacaaaactagggataaaatgagacagtgcttatgagggcgttttttgaaactgtcaagtgctctacccatcaaataaatcatcattctctaaatgatggcctcattccatctcacctcccatccttccttaccatgctttatttttctttatagcatttatcatgacttgaaatagatatatttatacatttatatagtatagttttctctctatatatagatatatagctaactttccctactgctactctatgcttgtcaaatatctatatctatgtatacacctaccatgtgagtatacagaagcattatatatacgtaatgattttgttttgtctgtctcctctagaatgaaagctctatgaggactttctgttcattatgcatcccctacacccagaacaatgcctggcacagaataagccctcagatatttgttacatgttgtatgatttatatttacattacttgtcagggaccatgtgaatcacttttacgtatgtgaactcgtttaaccttcatgataataaccctatgaaactggtgttgtatccattttccattagcccatttactgagtagaaatgaacttattgaggtacacatggaaactagctgtatttttacttactttgaagaatcgccttcaaagttctccacccaactcttcctgctctgatgatgatgtcttcagaggaaatcccacagcatctggccatgttcacccatcacatcagtcttggctgaataattacagctcattctcagctattaaaaagtgtagttcagtccaatttaaaacttcaatctcacatctaagtcagaccttcttcctccttgtggctcagaatttgctctgggaaagaggggtaggatcagctttttctccttccttttctggctcctccagggttggggttgggagacagtgggggaggaaaggcaacaagagtcatttgacaaactggtgctcactgggggcttctcctagctataagtgccttctgctatgactgtcacccaaatgctggggccaggggtcctgtcataggttttgggggagccactgtggatctctgtccacattagctgagagatgtgctctctagccaacctcctaccacctccactcacaggctgctttggcccctcaggtaactgaggagtccctctgtagctctgttattgtgttggaagcttctggccaactcactgcacaccgagtgttacaccctgattcttagagatgcccagaggagccccaaaaagcagaactggcagataggacaggctgaactcaatgaagcataaacaaaaaatagctttgctttgttccaagtttgtctatggcccacttccttccctgacccctgattgttgcatggcagatttaatagcttttgggttattgattataagaacaagcatcttctcaataatttatactcttttttagatgttaaaagtccagtccagtccagttcttgaatttaaaactgcagtctcacatccacttcaaaactcctccctagcccagctggggtctggctatctgtggcttggggacccacagtgaggaagggaagagtgtgatctgatcttctcctttccctgaccattccctcctgctcctggtccctttaggtgtgttagactgagaaaaaatactttcagaatataactctagctctccagggaaacagtgaaataaatttttagagaacaacagaactataaattgaaacaaacatacggtaatagggatcacaattggcatgctcatgacgttgtccaagcttattaataggcaattttttaacagatggtagaagtgtctagctctgtctaacttagaatgcaacattcagttttcatacgattaaagagcaaacatttatgtagggctttctgtatacctggtactgttctaagcactttacatatatcaaccgtgtctagtcctctaaataactctatgaagtagatactgttattgttcccattccatggatggcaaactgagtcccagagaagctggatgatttgccaagttcacacagccagtaagtggtggactcaggatgtgaaccaaggaaatatggccccagagctcatgcccttagccacctcatttacacaggatgagttatttcagggttaggctaggtatgtgtggaggcaggttttgtgcacacacttgtccttttgactttgttgcagtcattagtagtcatctggtgatctcctaggtgatggaattttggagagaagtctcagcctctgtgtatctcagggatcaagtgtgctgatcactgcagttgagaaatgctttcccaaatcttcccagctggggtgttctgggtactgtgaactctggggtactgagtactaactccctcagcacccgggttcatccatttatctgatattcatttatctcatgtctgtgtggacccagccccgtgctggaagatgggatacagagtgaagtctgcctccaaggagaaggccctgtagaggagatatatacacatgagtgactgcaaaaccagatggcaaatgcaattcctgagtatgaatgcaagattggaagggcacaggattagagggatgcttcctccttgtaggggtgaggggcagcctgagaaccaggctggttgtggaaaagctccaggcactgagcatccccctctctcagcccacaaccctggaaggtccatggaagctaaagtgggtgttttaatttcaccagaaacctccttctcctgcttgaccacttgtctttcagaaactctaataaaacaaaaactctacccacacaaagatggagcatcactgcatttggccaacaagctaagccttttcagaaagaacaactgagcctcagatttttgagaaaagagaacatctctagcctacaaatgagttgctttccaagcatttgtaagctgcatttcagtagagcagaggtcctcaacccctggtctgtggactggtactagtctgtggtctgttaggaactgggccacacagcaggaggtgagtgggtgggcgagtgagcgagcattacctcctgagctccacctcctgtcagatcagtggtggcattagattttcacaggagtgagaaccctattgtgaactgcgcttgtgagggatctaggttgtgttttccttatgaaaatctaatgcctgatgatctgaggtggaacagtttcatcctgaaaccattccttcaacctgtccaagggaaaattgtcttccatgaaaccagtccctggtaccaaacaggttggggactgctgcagtagaggccacaaagtgaaagaatgtcttcttcaactcacacttattgagggcccaccatgtgctgtagcccatggaatttccaataatgtcaggttttgagccctgaacttgaggatctttcacccttactcaccatgtgatgatgggcaggtccttttccctctctgaacctcacttcctccatctatcaaatggggaagttagtctacaagcatatgaggatcttaccgtattagcccaaaacacttttcaactagaaatcataaaatagctaacactgactctatgccagttcctgggcaagcccttttcatggattatctcatttaatcctcgcatactctgtgaatgagatgctgtgatctgggttttttgtttgtgcatttaaaactttttaaaagagaaattttagtttgacagcaaagaataaattgtacagagatttctcatataccccgtccctacacttgcccagcctcccccattaacaacatccctcaccagagtagtacatttgttacaactgatgaacctacattcacacatcatcacccaaagtccatagtttatattagaattcactcttggtgaattcactcacattggtgaattcactcacatactgtgagtttggacaaatgtataataacatgtatccattgttttggtatcatgcagagtattttcactgccctaaaaatcccctgttctctgcctagtcctctctccctgtcccctaacccctggtaactactgatctttttacagtctctagttttgccttctccagaatgtcatatagctggaatcgtacagtatgtagccttttcagattggcctctttccattcataatatgcatttaggtttcctccatgtcttttgtggcttgacagcacatttctttttagtgctgaataatatttcattgtctggaggtaccatggtttatttatccacctacttactgaaggatattttggtttcttcccattttggcaattatgaatacagctgctataaatatgcatgtgcaggtttttgtatggacataagttttcaactcctttgggtaaataccaagaagggcaattgctagattgtatggtaagagtttatttagttttgtaataaactgccaaactgtcttccaaagtggctgtaccattttgcattcccacagcaataaatgagagttcctgttgctctacatcctcaccagcatttggtgttgtcagtgttccaggttttggccattctaataggtatgtagtggtatgtcgttgttttaatttgcatttccctgataacatgtgatgtggagcatcttttcatatgcttatttgccatctgtatatctctttggtgaggtgtttgttaagtaaggtctttggtccatcttttaattgggttgtttgttttcttattgtttttaaagagttatttgtatcttttgagcaacaatcctttattagatgtgtctcttgcaaatattttctcccagcctgtggcttatcttctcattctcttgacattgtctttcacagagcataaaattttaattttaatgaaatccagcttatcaattatctctttcacggattgtgcctttggtgttttatctaaaaagtcatcatcatacccaaggtcatctaagtttccttctatgttgtcttctaggtgttttacagttttgtgttttacttagatctatgatccattttgagttaatttttgtgatgggtataaggtctgtatctagattcactttttttgcatgtgtatattcagttgttccagcaccattttgtttaaaagattatctttacttcatttattgcctttgatcctttgtcaaaggtcagttgactatatttatgtgggtctgtttctggactgtctattgtgttttgttgttctatttgtctattcttttcccaataccatactgtcttgattacagtagctttattgtacatcttgaatatgggtggaatcaatccaccaattttgttcttcttcaatatcaggctgactattctgggtctttagcctttccatagaaacattagaatcaatttattgattgccagaaaataacttgctgggattctgattgagattgtattgaatctgttgatcaagatgggaataactgacatattggcaatattgcatcttcctatccatgattatggaatctctatttttatctagttcttctttgatttagttcatcagaattttgtggttttcctcgtgtagctcttatacatagcttgttagatttctacataagtatgtcattttgaggggatgctaacataaatagtattgtgttttcaacgtcaaataccacttgtttattactggtatataggaaagtgattgacttctgtatattagccttgtatcttgcaaccttgcttattagttccaggagatttttttttcttttgtagaatcttttggattttctacttggacaattatgtcatctttgaacaaagagttttatttctgccttctcaatctacatgcattttatttccttttcttgtcttattgcattggctaatgcagtatgatgttgaaaaggagtggtgagaggagtggtgagacatccttggcttggtcctcatcatagtgggaaaactttgagtttcttatcattaagtataatgttagctgtaggttttttgtagatattctttatcaaattgaagaaattaccctttattcctagtttgcagaaagcgttttttttttttcaaatcgtgagtgggtgtttcaatttgccaaatactttttgtgcatctgttgatatgatcatataattttttagcttgttgatgtgatagattacattaattgatttttgaatgtcaaaccagccttgtatatctgggataaatcccacttggttatggtgtataattacttttatacatcattggattcaatttgcaaatattctgttaagaatttttgcatctatgtttatgggaaattggtgtgtaactttttttaatgccttttatctgattttggtactaggtaacagctgacttcatagaaagagttaggaagtagtccctctgcttctgtcctctgaaagagattgtaaagaattgacaaaatttcttctataaatgtttggtagaatttaccagtgcacccatctgaacctggtgctttctgttttggaagattattaattattgattcaatatacttaatagatatagacctattctgtctgtttctttttgtgtgagttttggcaaatcaaatctttcaagaaactagtccatttcatctagattatcgaatctgtgggcatagagttatttatagtattcctttattatccttataatgtctataagatctgtagtggtgtctcctccttcaatactaatattactaatttgggtctgctctcttttttctttgttatgcttgctagaggcctatcaattttagtgatcttttcaaaggactggcttttgattttattgattttctttattgatttcctgttttcaatttcattgacttctgctctaattcttattgtatcttcttcttacttcagattaaattcactcttctttttccagtttcctaaggtggaaacttagattattgattttatatcttttccaatatatgcattcagtgtgataaattttcctctactcactgctttcatttcatctcacaaattttaatgttgcattttcattttcatttggttcaaatatttttatttctctgagatttcttctttgctccatgagttatgtagaattgttgttttatttccacacattcaaggattttctagttatctttctgttattgaatgatagcttaattctactgtggcctgagagcagacattatatgatttttgttttatgacccagaatgtgatctatcttgatgaatgtgccatataagtttgagaatatatattctgctatttttggatgaagttgtctattaatgtcaattatatttaattgattcatgtccttactgatcttctgccttactgatttccatttctgatagaggggtattgaagtttccaacagtgatactggattcatcaatttttccttgcagttctattagttttggccttatatagtttgatgctgtcttgttaggcacatgtatattaagaatcattgtgtcttcttggagattgatacctttataattatataatgcccttctttatccttgataactttctttgctttgaagtatgctccatatgaaattaatatagttattcctgtttcttttgattagtattatcatagtatatttttctccatccatttacttttaatctacatggatctttatatttaaagtgggtttcttatagacaacatatagttggatcttgttttttgaactgcttaggcaatctttgtcttttaattgatgcatttagaccatgatcttcgaagtaattattgataaaattggataatatttaccatatttgttactgttttctatttgttgcccttgttatttgttacgatttttgtcttccactcttctgctgccctttgcagttttaattgagcatttcatatcattccattttttctcctttattagcatatgttatactttaacataaaaaaaccttttaaatggccttcctataatttgcaatatatatttacaactaattcaagcccacttttaaataatgctatgccacttcacaagaagggcgagcaccttataatgagaaaatcataacttttgtgccctctgtaaaaaaaaacatgcacacatacttatgtatgtgttttaattgatatacacatataatcaagtactttgttgccattattattttgaataaactgtcatctgttagatcaattaaaaaacaagaaaaataagtttttattttacttcacttattccttcttcagtcctcttcctttctttgtgtaaatctgagtttctgacctatatcaatttccttctccctaaagaatttcttttaacatttcttgcaagtcaggtttactgaaaacaaattcccttaatttttgtttgtctgagatagtctctactactacttcagttttgaaggataatttctagtgtacagaaacttaggttggtaggttttttcctctcaatactttaaatatttcatttcactctcttcttgtttacatgatttccaagcagaagtcagaagatagtcttgtctttgtcctatataggtaacatgggttgtttttctctctggcttttttcaggatgtttttcgttatctttgattttctatagtttgaaaatgatataccttgatgttgttttcctgtggtttggctttttgttgtttatttgacatttatcctgcttggtgttctcttagctttctgaatctgtgatttggtgtctgacattaatttgaggaaattctcagtcatttttgtttcacatatttctttgcttcttttctctctttttttctctttctgatattcttattatgtgtatttacatcttttgtaattgccccctagtccttggatgttctgttcggtttttcagtctttgttctcttcgctttttagtttttgaagtttctgttgatatctacacaagctcagagagtcttcagctgtgtctagtcacctgcaaatccatcaaagtcactcttaatttctgttacagtgtttttgatctttagcatttctttttggttctttcttaggatttctatctctctgctcacatggtccatctgttcttgcaggctgtctaatctatcaattagaacccttagcaaattgatcacagttgttttaaattcctggtctgataattctgacatccttgccttgtctggttctgagccttgctgtttctttaaattgtgttttagcatgccttgtaattctttcttggtggccgaacatgatatgccaggtaaaaaaggaattgctgtaaatcacctttagtcatatggtggtaaggcgtgttgttggtgggggaagcaatctattgtcctgtgattaggtctcaatcctttagtaagcctatgcctctggactgtgaactttactacaagtgtttctccattttttccctcccctcttagatgtcataggatggctaaagttggctagaattggatatttcccttctttcacatggaaggttagaggggactggtgttgggttatttcccttctccgcatggaaggctagagctgactggagttgggtatttcccttctcccaagtcagttaggctctgataataccccagcagattaggctctggttaactagcttctcctgaaagcaggccttgttaagaagaacagagtgctccagcgtatttcaaaatggttcctttactccttcccctgccggaagcgtgagggacttttgctctgatatttactgtgggaacctggtcaagctcctagaggtacatctctcaatattgtgtgggttcccctatgattgggtctccctagagttattttttaactctcagccttgtctgcattaagccttcacaacttgtcaattacaattcaggtgttcctaccacagtactgggtcctgaggcagttcccactcctgagtctctgctccagggagccacgattccctgtatttacccgtctctccaatcttgagggcagcagtttgctctgtgtcctcccctctcttaagaacccaagaagaattgttgatttttcagtttgttttgctttttacttgttaggatggagtggtgacttcaaagcttcttatatacagaaaaccagaaactggaagtcaaaatgctgtttttattcccatttaaagatgaggtagttgtctccagggcctgtgttgtcaatatcggatttctgatcaatgcaaaggagcaaaacactggagcattctctataaagtcgatcctaggtggaaaccagaaggtctctgagttattacaaaaattggggctgtggggaaagatgtcccccccatgcctcaatagtggcttaaataaattagtggtcttacttttctcacataaactaagtctagaggaaggtaacccagctgcagttgggcagctccttaaaagcatcagagacccagtttctttctgtctttgtgctctgccctttctagcagatggcttccagtttctatatcacctcatggtccaaaatgactgctagactccaaaaactatcttccaggaaagaagtagaaaaaaatggggtaagggaagaaaggtcaaagctcccagttcagtcagccctctttagactctttcccagagctcagcccagtgattttcccttacatctcattggctgcctttggctatcagggaggcaagaaaatgtggtccactctatcctggaataaaaactacggtttgagccaggtgcaatggtgcaggctcatagtcccagctactcaggcacgaggctgaggtgagaggatcacttgagctcctgagttcgagtccagcctgggcaacacagcgagagcccctcttaaaaaaattttttaaacttaaataataattaggatttatttaccttggactaaggatgaaggggaaaaaagaaaaaataattagggtttagtggggaaggagtaggcaactagccattttatccacataagggtgtttcacacatccatgcatccttgtatatgctacaactatgaaatggaactcaggatcctggaagagtataggttattctctcaaattatgagctcatgggaagtaacatgggtggtacaatgtgatcacttaagactgtggagggtgacatgattcatggtcagcaatttgctgaacttttcaggaaaaggctggcttatggataggcactagatagttgtgatatagtgtaatttgaatatgtggagaggccatttggcctcaaaaatataccttctgaaataaaggcttaatgatgtcttaaattcctcaatcccacttatttaagtctgtaaaaatgcaactagaacaggataagatcattcattaatacttatcacttactaacacttcagtatgtatgagtttaatctattaaggagactcagagatcagttgatgcaatcccttcactttccagatgtggaaattaaagctcagagggactgagtggttttccccagttcctacatttggtggcaggtctccccctcccccacactggatccagtggtggggctgagagtgtggaagagacaccagtaagaggtagagagactggagaaagggaagctgaggtgacagatgtgcttgtatgaattaaatttatttatatcctgcattttttcagtgaggacatgggtaattggcagtttgggttgtgggtggctcatccttgaagatttggctcctttctcctcgctgaccatccttgggcaatggggaaaaaagccaagtgtgttctggggacctgtgcttcatcagctgcacttacctgcattggagagaacagagacttcctcatttacacggtggccctcttcttctagtcccaccagtctgcccaccctcctcccatcctgacgtggggtcacttgcacacccctgaactgacacagcagaagatgagggcactcttgaggcatctttaggatccttcaaagatggtctttttccagttctcaaaggaaaaaaaaatacgtacatagacagactttccttctacttttaattcttgtatatatttttcttaatatttttgaatctgctgtggggcatccatgacagaatgtctgatttcacaccaggttttttctaggggtgtgtgtgtgtgtgtgtgtgtgtgtgtgtgtgtgtgtagtgccatgtaaaactctggggggtcaaactctttgggtttgaatttgaatcctggttgtaccacttagcagctgtgtgagctcagataatttcctaacagccctcagcctcagtttcctcatctgtaaaatggaatattgatagcaatcaatcacctggagaactgttgcgataatgactgtaaaagggctacttagcacagagcctgtaattataaacactcaatgcttgttagttatgacttcagtttattatagcaatatttcatgatcactaacatatcagtgttccagcctttctaggtgctcttctttctgaacaattttgagaacaattgttctaaaaatgtcctacatcacacacatgctgccatcaccaccctcgccctctcttattatcatcttcagaattattccatttttgacttaacctgtatcttatgtaactcacctcattctagctaaatcagtgtgtgatgactgccttctctcatgtacacgtgacacattatccagtcaccctgaggacaatgaggtgttcacatatggatttttggcattcttgttattgccatccgtggtacccctcaaggggcaacagattcactgttaccttttcagccctggggcttttcaaagaattcttcatcaatccataggcatgatttgaaattccacttctgtctcattgccctcagtatgaatttcttgtagaaattttgcaatttctcttagggaatttcctgtgacacctgtagcattctctaaccctttcattccccagttcctggcacccaggaagtgtcataaaaattgttgagtaggtaagagttacatcagtatagtaaaatgaccccagcaaacactcattttaagatggaagcattgagataggatgttttacagtccccattcatatcaccagctttaattattttttcttttctgaaaaatagactaggtttattgtcaaaagaaagaaagtgaatatcctgctttcagagttaaatttgtgacaattagttccctttaaccaacttctttccctaatcatttctctctcttgttcaaagcattgtttcttatgtgtgtttttaaaaatatgccacaagatttccacaatatatggttataaaacaggaacttgtcattgtattaaatttctaatttcttgcttcttgaaaagcccttctttacccacacctaaaatgacccctgaagtaagacccacaactctcatttttaaactatgttcagcatactttattctacatgagtttatctccttcagtgtgtggaaggacatctactgattccattgcattagaatttattttagatcacttcttgttgatggcaaatctttacctactgagggtgggtggaatttttggaaacaaacgcccgatgactaagattggagatcaaactgatcaagatcatattatttggggtcaaaattgaaggctgtattatgtagagtgatgagactgaatggccttcctgggtggctctgggggtgtctcttgaggcaacaccaagagaggcagtggggcagggggtgtcattcacaatgagaggacaccgtgctggctctggcatgtgtgggcatgtgtcagccacagtaaagaagatgacaggtagaagaatcagattcctgtttcttccactggccagagactgtgaatggagacagccttgaatcaccctagatcccagttcctcatttgtaaagtgagatcatcatactctcttccagtgttgttttccttctttcttttcttttctttcttttgtttggagatggagtctcgctctgtcacccaggctggagtgcagtggcatgatcttggctcactgcaacttccgcctctcaggttcaagtgattctcctgcctcagcctcctgagtagctgggactacaggtgcacgccaccacgcctgactagttttttgtattttagtagagacagggtttcactgtgttgcccaggcttgtctcaaactcctaagctcaggcaatccgcccacctcggcctcccaaagtgctaggattacaggcatgagccaccacacccggcctccagtgttgttttctaagacaaaatgtactaccgagtataaaaccacctcatttagggcatggtgcttagtgatgctcagtggctgacagttcctcttttcactctttcctttcctcatcttaaattaggagggcaattgtttgaacatgccatctcggaaattcttgcttaaaactcatgtttctttaaaaaaaaattgcacccacaaaatgatgtaagggtatcctgcatgctgggctaccttcaactggagtgtggtgtatggggaggagaacggacaggggagatgagtgacatggccaccaccacctaaagaagaattccaacagctccagagagagtagttctccagagcttctctgcttcccacccctatccctgcggagcccccagctctgtctgcccaggctgaaagagagaagggtgggattcatgagtaattaaagggaatttggaaggctgggatgttgcggaatgttagatcagtagctagaacagcatgtggtgttctttaggcaggcttcattgaatccatacaaaaaaagaaagaggggctgcctgcctgtctgctcatttatcaaacagcgaagctcaactttcacagctccacaaaagtgttttactgtttgctgagtcttgctccagaaattaaaagctgagcagcctgagcggggctgaaccgaccctgcattttgagactcgaactaaattgtgctgggctttcagattcagggaccagttgattatttggtgaaaggagaggagaataatttgtaatttgcagcccataagaaacacttaaaaaaaaaaaaaaaaagccaaacccccttcccacaggtttttgttgcagctgcaaggaggaggtgctatctgcagcagccctttctttgctcagagtgggaaaagtcttgacctgcatttgggcagaatgtgatgtgatacagcagcgcttccacccatcccccatcccctactcacagcaaactccctttcctctgatttctttacttgagattgcctttttctctcttcggaggaggaggagaagatttggccattagatacttttaggtaaaagaattttcacaaacagaactaaatattccaaccacactaatatgttccttgggaaagcataatataccacaaaagcccaaaaactagattgaatgaggagcgtctgcaaatccatgaaggatggaagtatagagggctaactccgtcagtgaagagaaagggctagaaaataatgataactagaggacgagtcactagagaggcagagaggagtgttaatagatatggaccccctgctccggctcctccctggcagctggtcactcctggctcccctccagccagcgggctgtgaaagcctgttgaggttgagctcttgccctgcactcttgtcccacttccggctggtgaagtcccaggaggcaagcctgggtacccagtctctagcctctctgatcctgctacgagcctgtgagataagctgagcgagtgttatgatccccactttatagatgaagaacttgatgctcaaatggaagaaagagcaaaaggtcttttgtgacttttcaatttagcacatttttataaagtgttaatgctgtcctatactttataaaagtgtgttttaagaacattgaaatgtgtctccccttggataaagcagctccacctttgagaaactatcacgaggaggaaatcccaaaacaaagtatccacaataaaaaacaaaaatcatgccacaaaaagatattgcttatagcattatttgcattaacacaatgctggagacaacttcaatggccaatcaaagaggaatgattctttcattctttcattcaatgagtcaatgaattaatgcactgagccaccttctctcccacctggactactgcagtagccttccaactggtttccctgcttccatccttgcccctaagtcagttctccacacagcagccagggtgacccttttgcatggtaagtcaggttttgttccccactcccctccttaaagccctctgaagtcttcccatctcactaagagtaaaagcagacagcttacaaaggcctgcaaggccctgtgaacccctccagcccccagacctctcctcctgccactccctcgcccactggctctgctccagccacatgggcctcctcattcttcctgaaacgaatgagacaagctcccacccaggtccttcccatgggctattccttcttgcagtttccttcccccagatatccacaaagttcattctctcacttcctttaggtcactactcggatgccacatcatcacagagtcctaatcaccctaaacaaaataacatccccacctccattttctttcttttttttttttccaagacagagtcttgctctgtcacccaggctggagtgcagcggtgtgatctcggctcactgcaacctctgcctcctgggttcaagcaattctcctgcctcagcctcctaagtagctgggattacaggcatgcaccaccacgccaaactaatttgcgtatttttagtagagacggggtttcaccatgttgtccaggctggtcttgaactcctgaccttagtgatctgcctgcctcaccctcccaaagtgttgggattataggcatgaaccaccgtgcctggcccccacctccattttctttattcccctcaccctacttttgtgttcccctctggagcacttacctgatagaagatacattgactttttcatttatttttggtcttctcacactagaatgtaagcttcttgaacagaggctgtttctgttttgctcagtgtgtttctcagtgcctagcaaaatgtccggcctgtagcatgagctcagtggatatctgctggtgaatgaatccctgctttgtaccattagccaacctattatggttattgaggctgcagcttgttgaacatggggaaaatgaggctggagatccagtttgtgtggagtcttacaggcctaggtcaggactttatagagctaagcagaacactgattatttataaagattctatgggagtggcggagttggagaaatttggtcaaagaatacaaactttcaattaggcaggaagaacaagttcaagagatctattgcacagcatggtaactatagttaataacaacgtattcttgaaaattactggccaggcaccgtagttctggcctgtaatcccagcactttgggaggcagaggtgggtggatcacttgaggccaggagcttgagaccagcctggccaacatggcaaaaccccatctctactaaaagtacaaaaattagctgggcatggtggtgtatgcctgtaatcgcagctactcaggaggctgaggcacaagaatcacttgaacccaggaggcagaggtttcagtgagctgagatggtgccactgcactccagcctgggtgacgagtgagactctgtctcaaaaagaagaaaaaagaaacaagaagaaaagaaaattgctaagagggtacattttaagtgttctcaccacaaaaaaataacaagtatgggaggtaatgaatatgttaattaactcaatttagccattccacaatgtatacatatttcagaacatcatattgtacaccataaatatacacaattttatttgtcaactttaattttaaaaaaagattctatggatcacataactacggtcacccaacaagtggcccagggaaagtttctaggaggaaataaggtacaagctgagatgtgaggatgagtagacattaggcagaaaaagggtgtgaagagagggctctggacaatgagaacatcctgtgggaagggccagagtaagacagaacacagtgtgttcatgaaacttggaagaagttccattccgtatggccggagcacaggaattgggagaggacggggagaggtaagctggaacaaaggcagggccaattaggcaggacctggtgggtctgggttctgtctagaggcttcatggaaaagtggtcgtgatggggcatgacgggaagcagggccaatgagactatggcagcactccaggtgcaaaaccatggtcctgggatgcgtagagatgggaggatatgggtagaatcaggaatatgaagatagagggtagaacttggtcacaggttggaagtggcacatacaaggcaatcatggtttgggaaaggcgagctctggtgtggtcaggtaatggggaaaggctcacagagcagcagagtgcatgctgcgtggctggatgggctctgagggcacaggtagtgaggagggagagagagtttaaggtagaaggtgcagaggtatggacctgggaagcattcagggaatagtgcaacaccaagtagtctgacttggacagaacctcgagttcatggaaggaaatttagagaaaagatggaagcaaagagtggtgtctgagtttcaatcaaaagaacctctgctaagtcaggtgaccgtggagaattgccagaggcctctaggtagacaggtaatgatctgcatcattccttcagtaaacctacttggggacctcaattatgcaaataatgatttttgattagcattttattaagcaggagcatttcactgccagatgatcacttgagtgggtgcagggaaatttcatccaggaggagacacggggctgtctgctgatgacaccatcccctcagctgcttctcaccttccctagcctattgggtgcagggccctcagatcctgttcatagcagaggccaccagaacatctccaagagggtcaatgtgaggagaatagaagagaaatcttcactgaagagttgatgagaacgagaaatcatttcattcctcaaacacacccaatgtgtaaatgtaggaatatgacataaaagaaataaaggttactgttaaaggaaggaatgagaggcttcgagacattctcattcgtctagaagcagtaacattgcggtggtagagtgttaagttggactggatgcattcaaatcgcaggtctgcatctgagctgtgtggctttgtgcaggttgcttagcctctctaaacctcactttactcatctatactgagggaatatcagtggaacctggcgctggattgttgtgatgattaactgagataatacatgtaaagtggttagcacagtgcctgagccaggactggaacccgggtgagcctgactccaaagcctgtgtgcctaatcactgtataccactgtttcccaattcactaggaaaacagagaaaggaggcagctaaggctgcatgggaagggtcacagggcaagtgggagaggcttggagaaagctaggagttccttggggtgagtggaaacagtgtggccttggcattccaggcacagggaacagcactgtggatgtgggagcaacataagcctggagctctggggagtggctggatttcaggctgggcagctgggtgggagtcgatcacagagggcctcatggaccatcctgaggagcctggatttttattcagagtgggcagcaagaagacatccagcattttcaatgaggaagtgaaatgatcatattggcattttagaaagatcctgccgctgaggccgggtgtggtgcatgtacctgcagtcctagcttctctggaggctgaggcaggaggatctcttgagcccaggaattcaaggctgcagtgagctaggatagcaccactactccagcctggtcaacagagtgagaccctgtctcaaaaaaatcaaaaaaacaaattccactggtgaggcaacaagactggtggcagggaaaccagttagaagaatgtttctgtggtccaggcagtgagagatcacagtggactagtgcagtagtgggggtaagggcagaaagagagaaggggctagattcaggagacatcctgaaggcagaaccagtaggacctggggttgtgcagtgttaggaagagaggagtcagggaggactctcctgttctgtcttaggtaactcagtggagattgatgctggtcacacagatgttaaaactgcatgtattgatctatacattattcaaaaagaataagtaaaaaccatcaggaatgaagggagtcatagattaaattgatccgtgaattcccaggccccatgctatggcttgataattcctcaagatcacagtgcatagaatcacaaacacactgattgtacacgttattgcctcacagaggtagaacaaatggctccagaaggccagtcatttcccaggggccttctggcacatctctagaacacagtcggcaacccctggtaccttcacctagggccaggcatcaagggcttggcctgtgttgctttatagatgttatgtaggataccatttggataaacacttagaaagatttcagaacttagcccagtctcttaaatcaagtaatcataagacttagcaaccaaacaaaacaatgctgctttcttcaattatctacgtattgtttatagaaaataggaaatgatttatgtttttaaaaaaggaaagaaagaaaaaaataacaacactataacactctggtagattttaggtgcttcttccaagattatcttgaactttcagttatttcaataaggaaatccttttctatttgcaaaaaacaaaaagtttatttagtacataaatatacaaaccctttttgttctacccacaatcccaatgccctaacgaatatccattttcattttaccacattacctgtttattcctatatttttacaaacaattctctgttataaaactataacataaacacagattgagatctgctatttcatttaacattataagcattttctgtgttgtgacatagtttttgttaccatcatttttaatggctatttcataatttctaccgtgtgtatatatactatcatgtttttagacagtttcctatcattagacatttatgctgtttcaaatttttcactctcattagtagacttacatttagcttttccttatttcagattatttccttggaattaatagatcaaaaatataagtactttatggcttcctatgtattttaaaaacgctctggggaagggttgtgctaataaatgatatcatcagccatctgagtattccagttttactacagccttgacagcactgaatattaacctttccaaaatgtctgtgaataacagagggttaaacatggtgccttactggccaagtgcagtggctcacacctgtaatcccagcactttgagaggttgaggtgggtggatcacttgaggtcaggagttcgagaccagcctggccaacatggcgaaaccctgtctctactaaaaatacaattagccagtcgtgttggtgtgcacctgtagtcccagctacttggtaggctgaggcaggagaatcacttgaacccaggaggtggaggttgcagtgagctgagccatgccactgcactccagcctgggcaacagagtgggggctctgtctcagaaaaaaacaaaaaaaaaaaccaaaaaccacaatactttactgttgtgtccatttgtatcggagaaattttccagacctaaacataggaaaatttctgctttttctaagcaactagtatgcacttatattgatactgggactcttggaactctattgtattatcttctttgcttgggtggttaggaaacttagaacccacttttaaccaatgtgaaaaatcccctggctcaatttttatgcttcccttgttttctttctatcgctattagcatgtctatgtctgttcagtagtgtgcctttgtgaacagctgcttcaaatcctggctctgaagccattcatatgctgaaagtctgaagggcttggccacaggttaatataaatccaaggtgatgaggccactaaacctggatgcagtcttaggctgcactgctagacaaagtgtttaaagagcactgttactgaccccatcttgaatcactgccttttactcaggtcaccacaatttgagaaggacataaagtgaaaagcttggatcttcagtttacaagagtcagggttaaagagatgggatttattgcctacaaagtggtacccttaaagaattcagagaattgttgcatcattttgttcagtattatcaccatgagatggtattttaaaagccttttttacttccaaaagtggtttcatgatgctatcgtattagattctctaaacattcttgtgaggtgcatctttttgtcaacgattctctgatgctgaaatgctgcggcatccattctccacactggaggtggtcagctccccagtgtagagaaatggtcagtcttcaaggttctcaatttctcactaatttgtgcacttctgtccatcccattgataccattttagttgagatcaccaacacctagccctccaattaggggaagactacacaaccccttagtcctcaaatgccacaggaggaaattcaggcacagagaggttaaacagtatgtcccagttcaaacagctaacaaggtcacagtccatatttgttgagtgaatgagtaaatcaatcagtgagagtagtggtgtggataaaagaggggtgaatagatgaatagagattcatccccatccctagagaaagcactcaaggtttatgccctaccaacaagaaatcagcaacagcatcttttctcatgaaggcttactctctctgaccatgtatgcctgctcagtgctgtaccaggagggaagggagtcttggttacactcaaaaaatccctggaagtaaaagggtcatcaggacaatcagtggtaataatgggtaacatttattaagtacttactaactgccaggcactactgccagctatttacatacattcactttttaaaatttcacaataactctagaggttattatcattcctattttacaaatggggaaactgagtcatgtggatactaaataacttgcccaagggcatccagcctaaccaatgcctgagcttgcattcaattcaggtagtcgagttccagagttcttgcacgtaacccctgacctgtcatgcctctccacaaacatcatctccgtaaaccccaaggaaaggggcctcatggttatgttttcaccttgagagatgctctctcttcacggatttcttgtgaactggtgtggttgtcctgggcaacagcaattatcatcctctgctctgcagacagaaaaaagatacccctaggctttcattccttcattcaacagatgtggattggggtctttgcatgtgccaaaccctgtatgaggtccttgctctcatggagcgtgtgttcaagcaggaggagacataaactaagtacccagagagtaagtgaacaagataacttcagatagtgctaagtgataagaagacaaagcagggccatgtgacccttgtgctactccacactggctggtctgagaaggcctctgggcagaaggacattgtccagacgcctgaatggttaaagaggaggcagtcttgtgaagagctgagtgaaattccactcctgggtgcagtacaaaggccccccatggggagcaacgctggtgtgtttcagtaatagagaaaacaataaaaagccagtgtggctgggatctggtgagtaaaggtgagaattataagagaggaaggccagaaggtaagcaggacgagttacagaggctaagtgtgggttttagttccaggtgctgtggaagccactggagggttttaaacaggggagaggcaggttctggaccaaccagaactctccttcctttgtgagtaggacggggtgaagcatagagtggccaagtgagacccccttagtatccagagccccacaaccatccaagcactccccactctgacaccagtagtcttctccagggtcctcacagactcctattaagtcattgcaaccaaggacctatgttttcctcccttctgtagatggctatttgtaaaactcagtcactatgctcccaactcttcccaatgggtaactgattcttgtgttgacttacagatcataaggcagcagtttcctcagttaaccaccagaagactcgggacccgaggacagtcaaagtaagcaccggacggccattccacctgcagagcgcacatctatgggcctcgagacaggccacacccttggctctttatcctgagctctgtctgcaggcctggcagaagtctgtgcctagagggaatatggaagagctttatgacggccagggcccctctctcaggactcctgaaagagaggttgtccaaaagcccaagacgagttggctctgctgctttaaggaatctgattttgtaccaccctgcttttaggcatattttgtaaaatagtcttgggcatcattgaaaggattgccttgtggcctcttggaggatcaccaggttatctggactgttttgctgagcaaactctgctctgatagtatgcagtagaccagagaagcaaaactgtactattccctgcatgggagatggggcagaaaggtccagctgcaccatggtccatgagggttcacggcttcccattcatcagtttcatcaagcaaccaaccaactcatgctttatactttctgtgtgtcacatatgtggtgctaggtactgggaacacaggagcaaatcagttgctgccctcgtggagcatagattccggtgggaaacagacaaaacagagaatcagattgtgacaaagttgtagcagagagcaacaaaagaggaatggccagggaaggtctttcagaggaggttacatttaagtaaagactaggggagtgcagaaggctgtgcagacacttgtctgctaggtgtgagtcagtgggaagggaatctcttcctgtactgctcgaccttcattaaaatctgcatttataggacttgcctctaaggatgtttcaaaaattgttggacgataataggtgttccatgaagaagagcagcaggccctataagtttggttaacactaagtttaaacagtttcctttactgcaagacttctcagaacccttattatgctaatgtacaaggtgactccactagagggtgccttattatgcagcatttctaagcattttgaccacgttgagcaggtcagcacatagtgacctataaaacactgtaactttttagaaaggcaaccatataggacttttaagacttgtcttgaaggatgtgtcaaaagcatgtccagtgctctcaccctgggccaaacccctgtccctcaccagctcctctcatccctgggcagcacattcccatcctccaagggtgggtttgattttggagccaaggtagggaaagaaaatggatgatcgaactgggaaaaacccttttttggtattctgaaaataatgagactaatttttttggtgtagctcagaagcttttgaaccagtctctaaagggatttccagaagactgttgaacaaaggacctcttggaataaattcctaataattttccaaaatgactattctgaaaaaaaaaaaaaaaaaaaaaaacaaacaaacctcagttataattttaaaattctggtatttgtttaaaagtaaggtttcagccttggtacgattatagattacaaaagccaggttcttccttgtttgctggtaaacacatagtaggcaattcaaaatgttggtcaaacagaagagtggatggacagaacgatatggaataaatgaaaataaattatttttctccagctcttggtctttgaggaatcagtggctccgatagcttgttgctcatttctaagaagagcagaaatagtaaagacacacagtaaagagagagcagaaaggtttcccatcctgcataaacagagaaaatttccttctgtccacatgggagagtctgtttttgttttgtttgtttttctttttctttaacctcgaggttggcaaaataccctctttaaaaattctgtataatcaattttattgtatcctcttccataaggatactccaaagttggtcacaccttcgaccagttgaaaggcagtaagaagctcttgtctccaacctgcatcatggccttatagagaaactcccttggcaaattgacaatgacagaagaaatctgggggggtgggccaggtgcagtggctcacgcctgtaatcccagcactttgggaggctgaggcccgtagatcacttgaggtcaggagttcaagatcagcctggccaacatggtgaaaccccatctctacaaaaaatacaaaaattagccgggcatggtggcacgtccctttagtcccagctactcaggaggctgaggcaggagaattgcttgaagctgaaaggcagaggtttcagtgagccacgattgcaccactgcactccagccagggtgacagagcgagacctgtctcaaaaaaaagcacattctgcacatgtatcccctgcctttttttagaagaaattaaaaaataaataaataaatctgggggtggctggtgaggaatgtgttgttgtgccctacagaactgaaatagaagaactcaagatcagagcagtagcttcactgtggttgttgattttagctacgtgatctctgaatagtcaagaagtggtctggtctgaacatattagatgatctggctcttaagaagttataaaggtgaactttttaaggttacggtggtgtgtcataactgtcatcccacctgaagccaccggaaccatgctcctcccccacccacagagtgagttccaggtgggaaggcagttatgacagttgagaagtagtagaagacacggaaggcacagaaggcagacttcgctcagcacaaagaagaattttctgataaccatactggcaaaatgaactgggctgccttcggagggtctgaattcttcatcccagaaggcattcagatagattcgagatgcccactaagcagaaatatcacggaatggtatcaggagtaaaggagggttggggagagggaaggttttgacgtgctcatctcttccctcctcgcaaaagcccttcccataattcaaaatgccttctcatctgtatgattttgtgactttcattgtatctccatgggtagagaaaagtagttaatatgttgtgcggtgtttctgaaagcgaggtccacggatgacctaacatttgtattgccacgggactgtgaaaatcgactctagacgtactaaataggagtctttaaggggggagcagggcccaggagtctctattttaatggttttttttcttcttcttcttttagtcctagctactagactaccagggatattttaatatgttttgtaagtgattcttagtagtagtaaggtttgagaatcactggcttagtggttcaaagcacttgggaggttcaaatcctgcctctgctccttactcactggctgatcttgggtgcatgacttaaattctctgggccttagtttccttatctataaaaatggggataataattaattctagctttatggggattttgtgagattaaataagataatgtgtgtcaagcactcagtaccagagatctcaaactgatgtgctttagaattacccctatggtgcttgattcagtgctgattcctgggccccattcccagatgttctaaatcagtaggtactgagagagggcccaggagtctgtatttttattaaactttaaaaatgattctgataagatcaaagtttataagactatcttgcagtgttttcagtaggatagcactgtggcttcatagtcaaaaagacctgtctgtgttcaagaacctgttcctcccctaaacagctatatgaccttaaacaaattatttgagctttcttgcctccagtttctcatgtgtagaaagactgtaataatttccattattggttattttacaaattaatgcatgcaaagtcctttgcaaactgcctggcatgtagccaatatataatgctcaatagattatagctaaaatctaaacaaaatgcagcctccaatcccttgttagtcttaattgaaaacattgctaatattaagcctattttgagttaataaaaagttctggtcttcgctttacattcagtgtcaactgaagcactgaatttacctttttaaaaatacagttctttgagactaccatttattgattaagaaaaacataggccaaggccaggcgcggtggctcatgcctgtaatcccagcactttgggaggccaaggtgggcagatcatgaggtcaggagtttgagaccaacctgaccaacatgatggaacaccatctctactaaaaatacaaatgttagctgggtgtggtggcacatgcctgtaatcccagctacttaggaggctgaggcaggagaatcgcttgaacccgggaggcgtggaggttcagtaagctgagattgcaccactgcactccagcctaggtgacagagcgagactctgtctcaaaaaaaaaaaaaaagaaaaagaaagaaaaaagaaaaggaaaacacaggccaaatgaatttttattagaggtgcagttagtagtcacaaacatatcctgcttgggtccccacagagaagggaccctcaagtgctggtatcccatttggctagacatgagagatcaagtactaatggaaaatttttcatcccctctctgctttgcaaagtatttgacttaacgttttctgtaggaggcaattttggttatttttacctgcctgattgatggctggcactttggtttaattctatatttcagtgatattagccttacaggagagttaactcttctatccccaggtaggatggccccagctttccttggccttgggcaacactccctactcaggaaacctcacttaataacagtgcatgtgggtctctctctttttttttttttctctctctccctccctccccttgtggcccaggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtaactacaactgaagtgactatttggggtgggtggtttctctctctttctctctctctctctgtctctatctctctctctctctctcacacacacacacacacacacacacacacacacacacacacacatttattgcaaaaccgtgagtttaaaaatataaagatagaaatccaggccaggagaggtggctcatgcctgtaatttcagcacttgggaggctgaggtgggtgaatcacttgaggtcaggagttcaagaccagcctgaccaacatggtgaaaccctgtctctactaaaaatacaaaaaattagccaggtgtggaggtgggcacctgtaattccagctggaggctgaggcgggagaattgcttgaacctgggaggcagaggttgcagtgagccaagattgcaccattgcactgcagcctgggcaacaagagcgaaactccatctcaaaaaaaaaaaaaaaagaaaagaaatcaaaataaagcatggactatagttaataacaatttatcactatgagtttattagttgtgacaaatatatcctagtaatgcaagatgttaacaattggggtgaggcatatgggaactcccagtactatctttacaacttttctgtaaatccaaaactattctaaaataaaatttgctctgtcaatctctatcatgtatgcctatctgtctatctacctatcatctatcttctgtctttctacctacctacctgtcctatgatcttatgctgtctcatttcatgaggaaagaacctctcccctctgaattgcttttccacaggataaagtccattttcccatgtgctgcaggggatttggtgaaataatagtctaacagtcaaagaagattttataggtatagtgaatctgatagttttgatcatagaatatttggagcaagttactggaaaaataaatttggggaagtttcccttggggtatcacatttctttttttttttttttttttttttgagatggagtcttgctctgtcatccagcctagagtgcagtggcgcaatctcagctcactgcaacctccgcctcccaggttcaagcaattctcctgcctcagcctcccaagtagctgtgattacaggcgcccgccatcacacccagctaatttttgtatttttagtagagacggggtttcaccatgttggccaggctggtctcgaacttctgacctcatgatctgcccacctcggcctcccaaagtgctgggattacaggtgtgagccaccgggcccagtcgagtatcacatctttaatgcacctattgatgcaacccagtgctgctctaacatgtattgagcttctactaagtctccatgtcacactaggatctgggatgcagtgaagaatgagatgagtcctgctttcagaaagcttagagtcaaccagggagatagtgcttgtataagtcaaactaagtttatataaaatgcatgtctatgttctaaaatgaggaaaatgaacttgtatctgtaaaggatacattaaatctaagaaatagataaatattttttcttaaatttgcttttttggtcaataaacatacaaatgaacttcctgcaccatggatttaaaattctcaggtaattgaaaaaaacataaaaataaaaaaattattggataaatggagggggagattaatttttttttttatttttgctaagcacattgcagagaatttccaaatgtcttatggtgacttaggcagaatcacttcttcatataactatacattggattttaactttctagtggtctcagccaatgaagagaatttagttccataaccctgcttagctctatgtgccaggcactgtgctaagtgctggatacatgagcatgaataagataccatttttgttttcctagagctcacagtctcagggggtggaaaatgggggcaggaggagaaaccagcgcattccgtatctcagggagaaacacactcgtgctgtgtgagcacagaggagggagccaagggtcagagaataccacctaatgaaaatcagtctcacctgggtctggtaggctgagccggtgttaggtgaattgcatcccccccacagggaagaaatgacttaaaaactgaaagtccaagggcagcagcaatgtgtattaatgtatgtctttgttgttgatcctctacacaccctcacaggtttctacctttattatgatgtacagaacacactgtcagagaatactggacactgtaataagagccaactttgatgaggtaggtcaacaagggttgagctgtgaatactcggtattaaaaatcttgtaacactagctcctatttcatgagctcctgctaggtgccaggcctggcatctggaagcccttcctggatacccattagctcacttcatcctcatgagatcccatgaagcaggtacgattattatccccattttatagaccatacatgtgtatagcagtgggcttggcctcctcctttgactgaactggtgaactgcctcctgccctatcagcacactaggaagaccattttgccaggatatcattaaacccaggattatagattcagagaagctaaagaaaagcttccttacattttggaaaaaatatataaaaagctttattctattttgtatatttaggcttttcctgaggcttgtccacttgggtacatttggagctggttaccctccattcccaaggtctgatccatagatttccatcaaatcccattagtagggccatcgttaaatacaaacaatgtaagaagtccattttattttaaaatattgtagttaaagaatggagaggaggaaatgagaaaggatgggagaacaataaccaataataaagttatataactttattattttttgagggaagacaatgtggtctctaaaaggactataaaaaacccagtagctattgatggaagacatcccagaaattcctttggtgtgtgtgttgtgggaagggggtgctgttgtaggtggagggatataaaaacgatgtcaggtacaaaatgctcttctcctgtacttttctgccttcccacggctgtgtcctttaggagtaaatgtttgttgagcacttccactatcactttgctcacagacacagctccagacaagatgggagtgtgttggtaaagaagtactgttcttccttctcttgacttttatccactagacttctaaaatgtactttaaaatgtcccaaattacttgagcaataatttcagtgatttttttcttttaagaaagaaaactccctgctttctttcgaactgcggtttggctctatcttacattccaaagatcactgagatcaggacaaataatgattcgtgactggctaagacaatactagctgctgtaacaaataactctgcaaatcttagcacactggaggtttatttcccacccatgtcacaatccagtgcgtttgttcttggttggaaggctggttgctggggggtgattcagggactcaggctccttccaccctgccctagaaccttggagtcctctttgttcagctgatgggtggggaaaagaactactaggaaggcataccccctacttatccttgtcagcccagaaataaaatagcacttctgcccatattccatggacgggagctggtcccacggccccaccttaatgcagcgggggctggggagtgtggtccctcactgggcagcagcttacactactcaaatctctaagggacagctgttcctctctgccacagttaccaacaacaaaactagtggcagtccccccttatgttcatatgtagcttagtcatctcaaaactcactctcatttcatttcatttgcttaattccaacacctattgggtcccatacactattggagagataagtaaaacacagttgataggatggggggaaggcatgtaaccagcaactaggatgcagaatatatggtgagaggtccagaaacattgaggggcagatgctgctatggaaagagtgccaggcttcaagtcccaggcttggattcaagagctggctctgcctttcaagcctcaattcctcatcctagaaatgaagatttaaaaaaatcatccccatctatttaattcatagtgttactagaaggaggagataagactgcctggtaaaagctctttgtaaactgtaaaaggtcatacaaatgcttgttcttttcagatgtatcaaccagagtgttcagagatttggccaaggtcacacagttggttagggccaaaggtgtgacaaggtccttcgtcacctcacacccttaggccaattccaccccactggcaggaatatttggtggctgcttttaagatagctaattcttctcagccacagaataatgaagggagacattttacctctgatgaggatggctttctcctatagctgagaaaagtcattggtaaatggatggtggatgtatctggtacaccttgactttacagttggtttcaagtcttccaagtctttaatatcagttgaggttacaacttatgctagtatcacagtcctaaattatcttgtttgttcacttgttcattgtttgtctctaccactataatgtaagcttttgagggcaggaagctcatctgtcttgttcactactatatcctatctagccatacttttaggctgtcagtcagtatttgttgggtgaatgagtggatgaatggatgaacaggtgtagaaatgccattgacttataacattgtcaagcaattaaagaatgcaaatctgaggccgggcgcagtggctcacgcctgtaatcccagcactttgggaggccgaggtgggcagatcatgaggtcaagagatcaagatcatcctggtcagcatgatgaaacctcatctctactaaaaatacaaaaattagctggacgtggtggcgcgtgcctgtagtcccagctactcaggaggccgaggcaggagaatcgcttgaacccaggaggcggaggttgcagtgagccaagattgcgtcactgcactccagcctggtgacagagtgagactccatctcaaaaaaaaaaaaaaaaatgcaaatctgcatgtaggggactcgggaacgtcttctccagactacattgcacaataagctgtaaagttcagtagtcttgtgattgagtctcaaatctgccactgactagcctgtgaccttgagcaaggcacttaacctctctgagcctggatttgttttgctacaagatgaaaataataattatacctatctcatagtgaacatgaaattgtgtatgtaaagtgtctgattttgttctagaatatgatgttaggcatttttgtaattattttattgagagccttccaagcctggtacacttagggaccccaattgcaagtcatcacaggtgtttccacaaggtgccaatgttcagaatgaactaaatatgaacatggaaaaagaaatagaaaatttgcttggtattcctaaggaaatcatctcctagtacttcactgagctgagagacaaagggccgagagttcagaagattgaaacagatacctcaggaaacttaattttactaataatttggaatcatttgcctctgattctttcactgtttatgcttgtaaggtgtaagaacttatcagaactctcctttctgcctaataatgtttccatttgttaaatgcctacacgatgccaagcattttacataagctatcttatttcaccctaatagtaggaagacatcattatcttcattttacaaatgctggtaactctgagagttatatgtttagtcctgagctccagattcaattgacttgaaatttaacttaacacggccaaaccagagctcttaattttctgccccaaatctgtttttcccaggtcttagattgccactcccctccacccaattgcttaagccacaaactttgattctctcctttccctcacccttcagatccagtccactgggagatcctgtcagctccaccttctgcagggaaacactgcatctgtccatttcatgcctaacttccaagccttagtgcttgagctaaggccattctccctccttccttttccttctcacctggaggaacaagtatcattggacaataaatgacctaaaatgcagagtagaaagggatgttaaaactggagaatacatcttctacaaaagccactcagcaaactgaggatggatcagccttcccagtgcagcttgaacaggcttcaaacagacagatgcctgctgaggagactgattttgcacagatttgtttaaatccacacaacagctgatcttttctagacattctgctagaaattgactgctcatataaaaaagggggtacggctgcctgcaagaagagctaagtaaggcaaatgaattcaaaatgtgtcaactcaagaatcagctgggcagagcttcttactcagagttagaggagcagacaagaaggcccaggacctgacctgagcctgatgcccagggaatgagctgggatcaggggacagtggagggtcctctggagggcaagtaccttgtccaaaagccgtggacatctccaggctcaggccacgctaatagtcagccaccgggtgtctcagtgacagaacaaaagtcttgataggtgagcggagccacagtagggatcctggctgggtgacattcagaaacataggcaagaaagtctcaaacacctagggcaggacactgatctcttgagcccagtagtggtagtgcctccatgatataatagtagtaataacagctaacctttattaaacatctatgatgtgccaagcactagaagcactttttagaaatcttcaccaaaacctatgcagtaaatactgcttttatccccatttcacagaaggggaacggaggcttagagatatgatactcctcagtagtggagccaggattagaaccctgcaagtcagtcttcactcctccagattttgttttcattttcaatctggatgaaaactttgcagtatttccactgtcagggaataaacaggactctaactgaagtcttttcgatttacagacctgacttcattcaccactacgatcatgttttcggcaatcaccacttctctcctaggaagtcagaggggcatgcctttatccctgttccttatcctccaagccttccatcctgtacttccacagggaagtccaggcaggctgtaggcatcagggaagcctattcacaggaggctgagatggagtcaccaggctagagtcggggcatggctctactagccagaggcagccttttcagagcaaaattaggccctactccttggaggggcctgaaggatgctgcaggttaccagggcaggggcagaaagctgggaagtaggcagcagtctagggagagacatgggcctcagcaatggggtagaaacccagttaccatgtgaagaacaaatgccacaagagagactgtggaaggactaaggcagacataggctctatctcagccataccctgactggctgtctggctttggacaactaatatctctgcaaataagagtaatgattctcagctatagtattatgagtattacatgaaagaacctaagcaaagtacctggcatatagtaggtactcgataaagaaagctaatggcggccaggcggtggctcactgtaatcccaggactttgggaggccgaggcgtgcagatcacctgaggtcaggtactcgagaccagcctggtcaacatggcgaaaccccgtctctacttaaaaaatacaaatattcgccaggtgtggtggcacacacctagaatcccagctactcaggaagctgagacaggagaatcgcttgaacccaggaggcggaggttgcagtgagccgagaccacaccactgcactccagcctgggtgacagagcaagactccatctccccagaaaagaaagctaatggcaataatacttgccccaaaatgttagactagagggactcaattatctcccacaccaaatcaggattgatttggggaaacagggatgtggataatgctacatgtggaactcaagagtgcccatctgttggggagagaaggaaacatgatccagaaaccaagtcaaacccattggaatgtataaaaattcagagttatgtgttccccagcttcgagatgggctgctccccaactgaagatgtgctgcagatgttagctgatagctgaagtctagattttctcaaatgttattatatacatcagttactatcttctactatttctcttcacttcccttacctttcccaccacttcaccccctattctactcaacttctaatccacagctaaaagacagaggtgtaggggaggcggcaaggggttctctgctttggacattcactctgcccttcgttcagtaacaatgtggctcaagttcctgctatcatcatattaatagtaataattgcatttctgggtgcctgctataatctggttctttgctagtggtttggggagttttaaaaagtcagtcacacacacttcatgtgcccacatagcttaccactcaggtatcaccatctagcatcccatatagcacccactggccagggagctttgggaaatggaagaattctgatatgaaaagacttttgcacttgacccaatctttgacgcacaaatttgaatcagaattttgtgtgtgtggcacctactctcctttcagccacactccttttacccgcgactcccatacctttcccttccttcccagaatacccaggggcccctgaggttcagtgggctcaaagaatagtgagtactagtgctccgacctttttaaaaacaatgccccaccttcctttccttaaactcttcccagacctcagtaagcactgaaggcgctgaggggtgaaagtgcttcatcttttggggcagaggagaccccagcctgccaggctagtcagttccccagcagtgtgcatgttgcatgcctaggcagagggaagacttgaagcaggagaaactcccagggcctcctacaacatggcaggctgggggtgacttctgctgccgcaggggaagtagatgacagcattgtagactgggttggccttggtggagtcccaagcttctgttgggagggccctgggtaacctcatgattcttctctctgtgggtcaatacaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacaggtgggcatgcttattcttgtcttccttcacggctggtccacagaagggattgttctgcttctcttgtactgattataatcatgcactgtccagaggcctcccttgtaaagaccattaatattgaacttttaaatattaaagtttatttatattttggaatataaataaactgttaatattttgaaccatttgtgtggcttaaaattcaaaggtataagatggtgtacagtaaacaatctccccaccagactcctgttccccagacaacccagtcccttcccagaacatcaaatagaatcattttcttggagtctgtccagatctgatatgcacatgtaatcaatgcatataatatactgtttttcttactgaaatggtgacatacactataccctgttctgtgccttgctgtaaaacaaaacaacttaaccttgaagtttatgctggacagcttccatgcccctccagatgtactctccaccacacttcatgctgccttctgctggggccagaggtggggcatatgctgatagcatgggccaccacacagggcgcttctcagggagggatggagggaggagagtgaagtcaggagatggattatctggcccccttcctgtgagattgtgttgagctggctgggttccttcactgggctgtgttcccttccaagcaactttccaggctgtccttgggcacagagtgggcgagaacctgtgctccgagccttaggttgcagcagtctccctcatagttcctctactccgtccacacctttgtgacatgtcccttgtaaataaacccacccatttagagtggcactccttcctgttgggactgttacaaagcacattgcacatccatgtataaggtataaggagcttttttcttttttacaactgtatagggttccaccatcttgcatttagtcaattctcttgatatgtccagttttgtcctactccaaacaacactgtgatgaatgacatttcatttaccttttttttttttttaacatggtgaagtgcattagtttcctgtaactactgtaacaaattaccacaaactggcggggtgacttaaaacaacagaaaagttattctcccacacttctggaggccagaagtcccaaatcaagcattggcagggttggttccttactgaggctctaagggagagtatgtgccatgcctgtcttctggctcccggtgttgccagcaatccttggtgtttcttggcttgcagacgcatcactctaatctctgcctccaccttcacagtgcttcctgctctgtgtgtgtgtgattttcaatctgtataccttttccccacccctgtcttattgcactggctaaaatctttaggatgatgtcctagcctaggcaagggtggacatctttgcatttaccctgaccttaaggggaaagcattcagtatttactataaaatacaatgctagctataggtttttaatatctggttgaatgtgtgtgtgttcgtgtgtgtttataattattataattattattattattttttttttgagacggagttttgctcttgttgcccaggctggagtgcaatggcgcagtcttggctcactacaacctctgcctcccgggttcaagtgattctcctgcctcagcctcccaagtagctgagattacaggtgtgcaccaccatgcctggctaattttttgtatttttagtagagacggggtttcaccatgttggccaggctggtcttgaactcctgacctcaggcgatccaaccgcctcagcctccctttgtgctgggattacagacgtgagccccctacacctggccaattaatttttttttaagatgaggtcttgttctgttgcctgggctggagtgcagtggtgcaatcattgatcactgctcactgcagcctcaaactcctgggttcaagtgatcctcctgccccagcctgcggagtagctagaactataggcatgccccacaggacctggctaatttaaaaaaaaaatttgtagagatagggtctcactatacagcctagtctggtggtcataaatttttaaaaaatatgttgctagatctgaattgttaatattttgttcagagggttttatagttcatcaaagttatttgatcaataacgaaagttactcatctttagttttcttgtctcataatgtctttctcttatttagatatcagaggaaacctggcctcataaatgcattgaaaagtgttccctctcttctttttttttttaattcataatattttcttattatccttttaatatctgtaggctctgtagtgatgtgtcctttctcattcccgatgtaggtaatttgtgttttctttcctttttcttggtcagtgtgactagaaatttttcagtgttattgatctcaaaaaatagcttttggtttctctggtttcttgctttctgttttcaattttattgacttttgctttttatctttattcctccctttttgtgcttgctttgggtttattttgctcttctttttttagtttctttaagtgaaagcttaggtcattgattataaatctttctactttcctaataaaagcatttaatgctataaattttattctaatctctacttagctgcacccacagattttgatatgttggattttcattttaattccattcaaaatattttctactttctcttgtgaattcctctttgatctatggggtatttagaagtaaactgtttaatttctaaatatttggggattttcaagatatctttctattaataatttctagtttaattcccttctggtcatattatatacatagtaatatatcaattcttttaagttgatacttgtttcatgctccagaatgtggcctattggtgaatgttctatgtgtacctgaaaaagctatatattctggtatcattaggttaattattctataaatgtcaactaggtcaagttaattgatagtattgtttaaattttctttgtctttactgattttctgtccatttgttctattgattagcaatagagaagtatagacacctccagctctaattgtgaatttgtctatttctatacatttttgcttcatgtattttgaagctctgatgttaaatgcatacaaattagaactgttatgtcttattggtgaattgacttcttttcataatgtctttttttatctttcataatatttcttgttcagaagtttactttgtctgtttgtaatatagctactccaggttttttttaaattagtgtttgcattacatttttttccaccctgttaatttgtctttatatttgaagtagatttcttgtaaccaacatagaaacatagagggaggtctttcttttttattgtctggcaattttcctttttagttggtatggtatgtgtagatctttatatttcatgtaattaaatatatggttcaattaagatcttccctcttcctagttgttttctattagtttcatcagtttttgctcctttattcctcttgttgtgcctaattttgtttaattatttttatcatcccatttatctccatggttggctttctttttccccctctgagacagggtcttactctgtcacccaggctccagctggagtacagtggcacaaacacagctcactgcagactcaacatcctgggctcaagcagtcctcccacctcggtctcctgagtagctgaaattacaggcatgtgccactaagcctggctaatttttttacttttatgtagagatggggtcttgccatgtttcctaggctggcttgaactcctgggctcaaggaatcctcctgcctcagtctcccaacgcgttgggattacaggtgtgagccaccatgcctggccatgattgtctttttaaaaatacctcttaaaaaaaatttactagttgttttaagtttgtatatcttctttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgccagctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaagtttgtatatcttcaattataatataccttcaaataatgttatactgcttcacatgtagtgtaagaatcttaacaacagtatactccctatttgtcctcccatttttatgctattgttgtcatacattttgtttttgtatatgctataaactcctaaaacattataactatttttgctttagataactatctttgagaatgattaaagatatgaaaaaatattttatatctgctttcattcacatgattcctaatcttcatttctttgtgtatatccaactcatcggtgtaatatatgagttggatatgtaatcatagtcctctgcctgcaaaattttctttaatgtttctcatattgcaggtctagtggtaacaaattatttgtttctgaagaggtctttatttctctttgattttgagaaatactttcactgggtatggtattctgaattaacacgtttttcacttttggcattttaaacatttcactccattgtttttggcttgcatgtttgtcttttgtacatctttgctcctctgtaggcagtgtgccttttttccttggatgcctccacagttttctctgtctttggtttttcagtctctatctttggttttcagctgttcgaccatgatgtgtctcaatgctttgtgttgttttcaatcctacttggggttttctgagcttctcggatctgtgctttgatgtatttcattatttttggaaaatacccattcattatcttcttctctgctttctctcttttttctcctcctgatatttcaattacaagtatgttaggccatttgatactgtcccacaactcccggatgcttgattttgctttttctctactcatttttctccttgtgttttagatggagtaatttttactgacctatcttcaggttcactgagtctttcctttgctatgccaatgctactaatgagactattgaaagcattttttatctccatcactgtactttgtttttatgtcaatttctaatattacattcttttaaaagtaatttctgcattctggctgggtgccgtatggctcacacctgtaatcccagtgctttgggagatgaaggcagaaggatcacttgaggacagcccagacaacatagcaagatcctgtctctacaaaaaaaaattagctgggtatagtggcttgtgcctatagtctagccactcaagatgctgaggcgggaaaattaattgagcccagaaatttgaggttacaatgaatcatgatccaggccggatgacagagcaagaccctgtctctaataataattattatcacatttattattaatatattaattttatagtagtaattatttatgtgttcttctgaaattccacctctgttcatgcttgtttactttttccattagagcttttaacatagtaatcatagttactttaaattttaaatttcctgtctgatagtctggttatgttgattgttttgtttcttgacagtaggttctttttcttaattttctgtttatctcataatttttattggctgccaaacagtgtgtagaagagtagagactggggtaaataatacttatgcctggaaatgggcatgcttcttcccctgggctctgaatatgagttgaggcagtctattcgggagttcattgcatttgggttttgttgttcctatgattacctttagtgtagcaccagatttaaattcttctggggtactttgtgcttaagttggagatttgttgggttgtttcccttaatgtgcctactcctttacctgtaggccatccctatgcacacagttgcttaagacttggtgcttgttagcctgattggagctggaagtggggatgtgggttctcctttgtacagtcctgtttcagtcttaagcaagccctgtgctttggatctcagagttgggcactctcagtgatcttgactcattgcagagacaaaactctagtgatttgatcccttggtggtttctagcagggttacagagctttctcttttcatctttcccccacctacaacgggtcttccctattccctggggtcaacagtgttttctgcttttcccctagtcaactgaggcttttgttccataagggagaaaggtcttggtggaacttcatgctttttccacagcaacagctgttcccttcctccaaacatgtacctctcagaaaggcttcttctgtcctcctgtcctgtccccagtcttcctcatgaacacctggtgaggcctgtggaggagggcttgcaaatagatgtgaacttcttttgcatctgtcattccaagagttctatactctcatggtagttcatattggcccattagcaatttgttaaaagtgttagcaaaatttatttcacccacttgtatgtaacgccctgttttcttccctctattgcaagtgagccagtccccaagtccttctctcattggaggtgcctttctttccataaattccaggctacatgattgtgacctcagctctctaatggtttaaagaaaagttataattttgtagattatctggctttttcttgttatggtggaagtgatgctctttccggctttccacattgtagatggaacggaaacacacccaaataggttaacaaaggttacctccagaggggattatggccacattttagtctcatccttttctgcattattcaaatgttctacattaagaccgaatttcaatttttataataatatgtatatgtctatattatatacgtaggagccatttagggctttgtgttattaaaatctttctcagtcactgatcaagtgaacggaggctaaatctccacttttattttgtaccacaaaggtatcttctgaggatttagtaaaacacatctttataagaaagattcacatacttttaataatgctttataggtgttaaacacacacatacacatggcatttgctgtttattacaaagcagtttgtggggtacaaatgaaatgttaacccctcccttcctatctataattgacttatttttacagatgtggaggttaaagattaaaagctgaaatgagggccaggcatggtggctcatgcctgtaatcccagcactttgggagtccgaggcaggtaaatcactcaaggccaggagtctgagaacagcctggccaatgtgtcgaaaccctgtctctacgaaaaatacaaaaattagctgggcgtggtggcaggcacctgtaatcccagctacttgggtggctgaggcacaagaatcacttgaatccaggaggcggaggttgcagtgagctgagattccaccactgcactccagcctgggtgacatagcaagaccctgtctcaaaaaaaaaaaaaaaaaaaaaaaaaaggctgaaatgacttgtctaccttcacctgcaaataaatgaaatagtcaggactcgaatattcattcaagaaaaccacaatattcattcattcattaaacaaatgttgattgattactacaatgtgctagggactatgctagttcctggaatacagcattacataagataagcatgctccctgctctcattgagttacagtctgccaaaggagactgttaaaaaaatcacgtggttacataattactactgcaatcttagcctgcaaggcttacaaatcaagtgccgttttcattaaatcaggaagacaaagttattcaaaacatcaggctccatctgagagctgacttttcagttttatatattcatccatccctcaaacttttttgagtgccttttctgtaccaagccttgtgcttggcatcatggaaatgagaattggtactagaagttctcactcatgaccctgggcaggcccaggctgaggcacatctccccaccccctagctcagacccatcccttcctttccaactcagaagagcatgttgaaattcaggggaataaaaagacactatgatagagataaccatggatcatacactcccatttataagaaagggaaatcattctcaaactggggtttttcacttcttccaagtaatctcagcacagtggttgttaataacaattgggttagctatagtaagaaagtgtgtgtgtatgcatgtgtgtgtgtgcatgtgtgtgtgtgcgcgtgtgtgtgtcgtatgggcagggaggagaagtcaaagaggcaaagaaaagactgaggaccaagcctgaaatgccaaaggaatagcaacatcagacagaaaggcagagggcactggagatggggagcagcaaggcatgtcaaagtgcacaatgtggtactttcatcaaagtggagtaggacagcggttgtaagtcagatagacctgggctttactcctggctctgccacttgctgcatctctttggacaagtaaaataacttttgtgagcctcgatttctcacctctctgttgggactaacaacagtatgtacttctagggctgaggtgaggattaattaagaaagtacatgtgaagtgttcagtagcttggcacattgcactcattaaaaggtaactgctgttatcaccgttgttgcagttgtaacagcatcactgctgatgggcattcagggagctacgagtgtggagttaagatgtaggagaagggctgaagctggagctgtagacttggcagccagccgcacaagagggaggaaaagtgtgtccctagaagtggaggacagaccctggcatcccagcctagggaaggaaagaggtggagggaaagcggaggaaggaggtcgagctgcaggtatacacccacagaggacagtatgtcaagaaggcatagatgctgcaggagatggagtcagttggggcttagggaggcatctcttagagcaggtgatcaggaggtgagctgctatctggggcaagagcttccaggcagaagggatggcaagtgcaaaggtcctggtgaggtaagcaagggcctgaagtgttggagaaactgaatggaggctagtgctgcagggatggagtaagctgaggggacagtgggaggagctgcagccagagataaggagggtagggagggggacagtttggacaagacccgttgtccatctggggatggagagccattcattcttacacttcacttaacaagcatttcttatgtgcctactatgtgtctggcactatgctaggtactgaggatacagtgataagcaaaacagacatagtccctgccctctgcatgaagggtacagtgagaaagatgcacaatgatcagataatcacacaagttgacgtaacaacaaactgtcacaactacatggtctttcaagaggaatcatcaggggtgctgacctggtctgggggcttcggggaaggtttgcctatagaaataatatctagtctgagattagctaaataacatggagctaagcaggtgaagagggaagagatgttcttgactgaaaggatgccaggggcgaaggccctgaggggagaggaccagttggagttggaggccagaggtccggaatgcagagaaagggagaaggtgcaaggtggggccttgggggctgcagcaagaattggggtttttatcctaagaataatgtgaaaacattgaggagttttaatcggaattacaggtgttttggaaatgtccctctgacaatgtggaagatggagtggaggtgggagggtgagcagggcaggatggactcaggaagctactgtaagtccggatgagagatgacggcagcctgaactagggagaaaagggagagaagtggctgtgcttgggaagtaatttggaagcaaaatctgtaatatgtggtaaagggaaagagagactgtgtccaaaatagcgtatgcaaaactggatacttgcctaaagaaattgtaactgaattaatcaagtctttagaagcagacaggatagatgaatagattacatgacactacaagacagaactcaaccaaatcagagtgtaggacattccagggaacaaataccatgatgttgccaataaataaatggcacaaaataggggaaaaaaatatttaagaaatagaacaggacaatgttatatctttcatgcaatgtgtggaccttgtttggatcctgattcaaacaaactaaacatctttgggagaaatagaaaagtctgaatgcagactgggctgtagatgatattaaggaattactattcattcagttagataaactaatggcatggaggatttaaatgttgcatgcacattgtgtgcgtgtgtgtatacatgtacacatatgtatttaaaccttgccagtgagaaatgcacactaagtttttaggggttaaatgacatcttggatttgtttgaaacacttcagaaaagataaagtggaatataatatattaaactggcaaaaatgatgccaatttttgaagctgggtcatgggtgcttggaggtttattatactacctgtcttggggtatgtttgaaattcttgaaaataaaaaagtgatcaataaaaataaaatgatgaaaaatagagttcatactgaaatagaggacacaagaaaagaagcaggtccaagggggaaatcacaagttcaacttggagacctctgggccggaggtgcaaaagttaagtgcagacagtgaatctgcacagatgggaatttcgcagattcagtgaatctgtgggcctggataaactacccggggaaggaagaaagctttgtgagaagagagcccaggactagacatgaagaactgagaggcgtgatgaccaggcagagggcaggagttttgtgactggggaggagcagcagaaggagggatcacagaagccaagagaagtgagtgtttccaaaaggagggcgcaggtgacagaatcgaatgctgccaagatgtcaagcagatgagaaacatgacaagtccactgggtttagaatcatgcatgggggctgcttaggctgaggtcaggagcggggtgaggagggaatgggaggtgaaggaaatgagacaaagaattgggcagcactttgaagaagtctgtctgtgatgtgggagaaagggcagtggctcaaggagatagagtggaggaaataagaggtttgttgttgttgttgttgttgtttttaaggtgagacattcttaaatgcattaaaataatgagcaggactgggcatagtggctcacgcctgtaatcccagcgctttgggaggccaaggcgggcggatcacttgaggtcaggagttcgagaccagcctggccaacatggcgaaagcccatctctactaaaaagacaaaaaattagctaagcgtggtggtgtgtgtctgtaatcccagctactcaggaggctgaggcacgagagtcatttgaacctgggagccggaggttgcagtgagctgagattgtgccactgcactctagcctgggcaacagagcaagactgtctcctaaaaaaactgatgagcagaatgatgtagtagagaagaaaaagctgaatatacaggagaagggaccgtcggtaatgtagatttcctgagaaagcagcaggggatggcaagaggaaggatcgctcatggattctatcaggaaggaggaagagatgaaccagacaggtagctgagtgctgatgacgtccttcctttgtgtgtgtgtgtgtatgttttttttttttccctgagaagtaggaggtgattccacccgctggcagggaggagagagttggggaattggaggcgtaagggtcttgaagaaggttggagatagccatgagaaaggaaagagtcagtgaccagagagaaatggggttgcccagtggggtggaggttggtgattttgtgtctgacaggagacagtgggtgaaaggctgaaccagggcaggctaggtggtgttggtggaaggcaaggatggatggtcaatggggagatgtccctgtgtctggcacaaccaaggaggacttcgtggaggagaacgaacctaggcctgtgagcagatggctttgatagcaagggccagaaaatggtgcccggtgtcttctcaacttcaaattcccatcttattgcaacctactgccctgctcagtgcttcgcctctccagttccttcctgcctcctgttctaatatggtctttgactcttggaatctaatatggtttcaaggcccatatcagggttgtttgctaatttaaaaatatgctgttgcttcccagttcccaccaaatggcgagcagtttggtaagctgggtgggcaggcatggcagttatgttgcaaacagggttcctgcctgcctgggaggatcagacaggactgggctttctaaggcccacggcccactgtcttcacccctcacacaagctcttcaaaagcatgaaggagcatgttttccttgcatctaaatagttctggatgccaccaagccttgcagtggccatcagtgaccagcagagtacattctattcgtgcccttcccagacccaccggctctccacagggcttggactgttggcactgtctctgaggttgctattacaaatggcacctattggtagcagccaaaacatgattaggggaaataaaaccctctaggggcctgtgggaggagctaagcaacatgtgcagcacttaaaactcatcgtttctttttctagcttaactcaggtgattcgaaagtttgccaagcaactggatgagtggctaaaagtggctctccacgacctcccagaaaacttgcgaaacatcaagttcgaatgtaagtactgagttgagagcgggatggaagagagaattacattttagtgccaaatattttacataagttgttaatagtagcagcagctactgtttactggttgactataaagcaccaggtattatactaattactttacatatgtaaatatatttaatcctcataaaatgtttattataggtggcacatttcttcctttacagaagaggaatcaacttagagaggtagtaagtagcagagacaggattttctcccaggtctgtctgacaccaaagtttctgctcaccaccaccaccatcctccttatctcatttaatcctcatgctgcctctgcgatgtagaaagtagtatccctgttctacagatgaggctctaagaggcaaagagagttcccccaaagccacgcagccacacagctgtaagtaggggccaggaatcaaactcaggtctcagatttccttgaagttcctgcccataaaatggtggtagcaggagagagagaatagcttaagggcttcatgcattctctgcctaattagaaagccaaattaatatttctcataaagggattgagactgtgaaccttttctttgctgagtgttggcacccattccccagcattagttttctaattttctgtttcaatctgcctgtacttgcagggagactcatgtaccgttcgtttgctgctattaaacaaagatgaaatgattttcagcaaaacaaagttttaaaatatacattttttaaagccccatttgaatacaacggcttgctattcctgcccaaaataagtgccagtgaacaaaatgaaggcgatcaaattaccctctctccacaggcaaagggagccctttcagacgcgctttgaggctgcctgcagtggccatcacctattgataaagcctgctttatttcatggctctcagctcttttcttttcatgagcactaaattccacatcacaaagttaaagaaaaagtaattaaggagaaggattaacgattgatcagcctggaaaattagaagtccatctgccccctcccacccccattcctccactccacaccttatttttcaaatcaagccagctctgagtacaaattagaataatcctagggaaatttctgactattacttgaccagttcagaaattaccaagaagaatgcccccgcacccattttaattatgccgacaaaacaaacctgttcaaagtcggcggcaaggaggtttgttggaccttccacctgtgtgtgtctggaggaagctgttcttcccagggagcccagcctgggagtgtattttgagaatgtgcaaggggtggaaacaagtcccactgcaaccactctgtaagaatgaagagctagggcaggcacatgtcttgtctgcgttgaaatccacagatataagatcaccctacttcaaattatcagcctattatgtcagtgtaggaaacaagaccttttcctagctgcagtcatcatcaaaacatgcaaacaggtcatggagatcacttgataaaaaggacagattatgaatgcaaagccagggttccatcccagaagcacctcctagccccacacaccgctgaggctcaatcaaggtttactattagacatactactttttaaagggacttcttcaaagcttccacttgattcctgcaattatttacggggagaagtgattgagcttgcaattagcgaaatgaaagacaagtaaataattgcttttactcacggttgattgacgccaccatttctcacacctgcgagtgtatcgtgtgcatgactttgaaatatgtaccccaaatgtcaccattaggaagtagttgttgaagcccacatgggagaacaaagaatcaagtgcagggttttgccagtgggtacataaaatgggattgggcagtgagataaacgtaggcaaaataagcaggctactttttgaaatgtgcccctggaaaatccaagttagaatcataaagcatgcaaatatttcaaactaattcttttctccttgcagtgtcgagaaggttctcccaaattctgagacggcaaacatcactaaatcatctctgccaggtagctgtcctccattatgtgttttaatcactgctgagtcattgcaaatgagggggcaaatccacaaaaacaacctcctgcaggatctttcaggttaacagggcactctctctattattttttaatttctacagataaggaatgaaaacattagccaataactagtttcaactaatatacaaaataatttctggtatcagttgccccttaacctttcagatatgttctaagtccacagttctgtgtttctcttaattatccagcccaaaatgtatgtagtggttgaatcaaatgattcaaacagattaagaggatgatttgtttgttgtatcatctgagttcaaagccacataatatattcaatatttgcctaattttgtttagtttttttccagatctgcattatttttagcacaaaagtgacatatgcttgctttcaaaaacatttaaaaatataagtgtagtaagtaaaagtggaagatcccactccatgcccctatcaactctgtagttatagcttgatggcatataactacatttctattaattttgcactttaatgaagggactctaagtctgttaaggcaaccgattaacattacattaaaatattaatgaccttaaagcagaggtggcaaaccggtggccacaggccaaatctggccctcagatatgtggggttattgttgtttggtttgaatatgttcaaaacaatttttttcacatggtcactaacagttggaactgggagatgacagctaaacacccacatttttctgtagaaaaccttcaagggctgacaacttgctcccagagtcccatttccccagggcagctgtcagctgctgggccaagcttctccacagcagccaccgtcctcattccaccaactctctcacacttggcccacctcactcctgaatgtcacctgcctgcccccttcctgtgtttctgtttgcagcctctcctttaaggtgctgttggttctgggtgggttcaaggtcaaggtggtagggaggggtttctagttagagtggcctgaaggagggtcccagaccaggaaccagaaagtataacacaacacccacatatacctcactgctcctgtcctgcccctggcatggacagcacaggggatgatttggagaccagagggaaactcatccagattcatgcaggctgctacagaggctacacctgggcattgttctggtgatggtgcagagcctgacagattaatgggattcaggaaagaaggtgaatattggcctaacaaagaaacactgccttatttctgaggatgcatgccagcatctggttcttttttccagcttggaagagtggctcttgggtcatatcagggaactagacatggttttggtgcctccctctggggatcagacaatttagagaggactttgttcctttaatgcacatgtagataaaagcgtccacacccatgcctatagccacgtgttgcacaagcgtaggggcgcacacacacgttccctctccaccttccgcacaaaaacagtatgtaatttaatcagcaaatgccccatttccatctctaccggaaagctttcagacgcattcccagatcagacagaggactagggttaaggctgggaatgaaacaccagctagtatcccagtgagctttcccaaacacacatacacagcaagtcagactaaacaacgtccaactgaagactcacctcaaatacttagacctaagattcacgtccaggctctttcagatacaccaggtaagtaagcacttggcattcctatctcagccattcacttcacagaatcttttgggtgcctactgtgtgcccaatactgtgcttagtggtacttgccctcagcaggaaaaaaaattaaaagtgttaaatgttatgaaagaaacagaatggaaatagaaaatcacaaggcattcaggtcctatgtagataaagtggtcagagatggcctttccatgggtgtgacatttaagctggagcgtacattgtagtggggctgctggggcaaggagggagaataatgttccggccagcaagaacaccatgtgcaaaggccttgaggtatcaacacaatcactgaaagagaagcgatcggataacagtagccacttttattgagttccctgcactatgcactctgtttttcaaacactatctcaaggaatcctcaacagcagcccttctttaagaggtaagcactaaggccctaaacatgatggttagagacactattaaaaagcatgttctaggcagggtgcggtggctcaggccagcaatcccagcactttgggagacctaggtgggcagatcacttgagatcaggagttcaagaccagcctggccaatatgtcgaaaccctgtctctactaaaaatacaaaaaaattagctgggtgtggcagcatgcacctatagtcccagctactagggaggctgaggcaggagaatcacttgaacccgggaggcagaggttacagtgagccaagatcgccactgcattctagcctgggcaacaagagtgaaactccatctcaaaaaaaaaaaaaaaaaaaaaaagcatgttctaaacacttgcttacagaattcactctttggtaaacagttcatttcattgtaataaagtagctcacaacgcatctctgaaggaacatgctcaggaaagaaaaaaaaaaggtaggtactatcatatctccattttatagattaggaggctgaggttaatctacttgcctgccccaagtcagctgctcagcaacgaggccaggatttgaactaggttatgtttgaatccaggacacctgacctttccattcagttgttttcattatcattagagattcacctaactcatatattctacacctttgtgacctttaaagagttctacaattatttaactaagattttacttgtaattggatggtctgggtacaacaagggtttgtcagtatttacctttgcctagaaatttacatgcattaggagacttgacaatgtcttcgtgtattttaattttttttattttattaaaagacattttgaaaacatgcaaataaaggaaatgatcctagatacatatttttcttagcttttctcagtattgtttcaacttgatgatattgttccaagtattgttccaacttgcaaatttaagttcactaataagggttccatgaaaaagccacagctttaaagaaaaaaaaatacatatatataattattcacacactatacacatccctccatccactaacaaactactgagatgtatggtatagtttcccttttcctccaacctaattattcatgtatgttttaatcattatagcaacattttaaaaaagcaaaaacagaaaactagagcataaactgcttcagaatgtatttatatgaaaaatacacactttgaaatttctgggattaagttaggcccaggggtagcaagaacacttctaaatcccagcctgcagcttctcaggtactggagacacaaggataattcagcacagagctcccatcccacaggcttacatcagaaagctgacagatctctgggcttcatcccattgttccatggggtcaagaccaaagggactggaaacagcagggtttggtctggcctagcccaccctcgcagtttcttgtagagaaaaagagatgtgtggaaagaaccataggagaaaacagtgtctgcgtcttctgagttacagagtcttctggtgctttcctgaaattgaatttcccggaatttcagggtagtttgcaaaataccataagcagatgcattaacaaggcataaaaggaaatacagtgaaagggttttaacaacccatgagctaacgagttgattggattggattataggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaatgtaagctgtcccaccagggattgttgtcctgtttttatttttaaaagaaagaaaaagtgtcttagtaaataccgaagtggcatccccaccctgttcttcccagcatctcttcctccttattgttccttattgttccttttaaatgagtcagtccagaaggaagggctgattgacttgagaggacatgtgtcaacactgctgggtaaagagtgttctggtgcaattgggcagcatacagtgtcatgcaaagggccccacatgtgacctgaatgccagccccggttccatggaggtggcattaaatatgagaacaaaagcttattgcctctctcagtgtatgtcagcctggggtcagctggatatgctgcctatttttcatttgagggtcacgactcagcccacctattggtaggtgaacctttcaatcacgttaaatgtctgagaagcaggtggatggtattttacttctgtgaatatatgttcatgtcccggtgaacaagggcttccaacatgcagactgcaggtatactgctccaaatatcaaccccatgtaggcaggatgtttgatcttggtactaaagcaatatgagaaggccagagaacaacatcattgttagcacatccctgctattcctcagatgcccatcccagctgactgcccagggcatccccccagcccaataaccctggatccataggcgtctacaggctacctccataattagagaacatcaggtcaggaaaggtgttgagagcatgcattcccatgttctcaatggggtgaggcccaggatcccaatagtgacactgcttggggagctgcagagaggctgtcccaccaagaagaggggtctttctgaaagccccaaggcccttcagatttcttagtatatgccttctgcactgctgtcttgagggaattctattcagctacccagtctaaacttgaggtgcctttaaacaaagttccctaagagggtcctattagagatctctttcccattaagcccttttcaaaagcaaatgtaacagccgaaatgtttgaacatgtggaccttccccagggcttctttcctggcttagcccaaacctcactcaggctgttacttcttccttcacagctgccccaagcccacttttcccctggtaagaattttagagatcatcactaaaataataattcagcttattgactgcctattctaagccagctcctgtgtcaaatccaatacatgcacggtcccatttaatctccacatcaaccccatgaggaagacactcttatcacccccactttacagatgagaaaactcaggcttagagagttggtgaacctaactcaaggtcatgcagccactaagcaatagagctgaacccaagtctggtctcacgtctagtcccagcttcatcaccaggccttagtgctgctcatattgtattcatgtgcacaggagacaaaaaaaaaaaaaaaaaaaaaaggaaatatgggtgagttttagaggttccaggatctttccaagtgcttacaatcatccttcctcttctgctttttcctgtcccctgatggaaagtcaacagaaagcatggccctgcacaccctaatagcactgggggtacctttgatcactgtgcccctaggaactcccaatgggccaggcacagagcaggtgtccagcaagattcatggaataccaaagagatgagtggaaacccagagttaacctagttcttagctctgcaaatcttcctagcagtgttagactcagttctcttcccgcctcagctcctttcatgagggacgaaaatgtgaaccagactcataaggaaaaatacaatcagtattgcttgcttaaaggaccaggctctgagcctttgctggagcaccatggaggtcactgctgcctctctcaagaaagaaccttctgtggctttctcttcaagttcctttaggtccagggcagaatggtgccctttaaagctgtgattgcattcttcttctggggaagtaaatgctgtggttcagttcaacccagctagtccttactgaatgcctgtcctaagtcaggtactgtattagatgctggccaaagggcagtgaataaaatggacacatcccttcccaacatggagcttacagttaatggtaaataagacctcaaacatgtatttacagatgtgttgcatcttaccaaagagaacaatgtcatgtaatacagtgctgtgaagggggaattgagggagggtaccaagcctcaaggcagtccagcacatgtgcgtcaaccctgtacctcctaaccagacagctgggaagtccctgacacacagggagttggaccaaaggtcagcttgagcagggctgggacaactgtgtgcagtgctcttctttcctcacagccagctgacaaatctgcaaactcttgcttagggggttaccatcacctctgtgatatagatctcagccggcaatgctcagcttaccttagattttaaaagtgcacattagtacttaagcaagctgattagaatgagttataattgtaactgcccaaggtctgctgggcatcccagacccatgtccaagttctgttggctgggatccctggggctgggatgcccaacagaccttggttcaaaccttgctcttacacagctcttacacagcatggggctggatgcccaaaagaccttgattcaaaccttggctccagtacactgtgaccttggtttccatttctgtaaaatgggactaaggtgaagggattaaatgagactatctgtgccacatgcttggtacacagtctagtgttagcatagtgaagtggttaggaggcaagcacttgagtcaggatgtgtttgaatcttgtctccgcaattcactagctgtgaaagaacaacctttggaaagttactcatctttgtttgtctctttcttcacttgtaaaatggaggataataatcgtaccaacctccatgggttgttcatccattcagtcaacaaacatttgagcattctagtgttatgaccctctggtctcagaatcttacttcttgtagcaagcgtcaactaagtaaaatagagcaaagtgtccagtcctttaaaatgagagaacaaaaactgctcaaatgaaaatgaaagaaacgtatggatcttgaattgtggtttgatttattgatctctgcatacagaaacacaaaaatgtgatgaaaagagatgtttcaaactagagatcaccagagccatgtttctattttctagagcacttcattgattaaaaagcacttccagccgggcgtggtggtgcacgcctgtaatcccagcactttgggaggccaaggcgggcggatcacgaggtcaggagattgagaccatcctggctaacacagtgaaaccccgtctgtactaaagatacaaaaaaaaaaaaaaaaaattagccgggtgtggtggcgggcacctgtagtcccagctactcgggaggctgaggcaggagaatagcgtgaacctgggaggtggagcttgcagtgagccgagattgcgccactgcactccagcctgggcaacaaggcgagactccatctcaaaaacaaaaaacaaaaaacaaaaaaaagcacttccagattcagttatctgacttaaagtgaagacaggttgtaaagtggtaggattatctctctaatgaggaaactgaggggcagagagactgtttcacttactcaacaagtatctattaagcacctactacatgccacacagagaggctgcttgcctgatacagttgtggtccagaaacatttgaattatcacatgtgccctaccctgggcagagagcaagagagcagcaatgcctcacccattaattcaagcaagaatttgttgggtaacaactatgtcacagataatgcaccagctaatgaagatatcagacaaagaactagcagggagacacacatgcccacccaactatgccacagtgccattagtcatataataaaggtagaaaaccgataataaagtgctatgtgagtgcagaggaggggtgatcagttctgcgggcaaggggcatggaaggttaaagggatttcataccagggccatttcagctgggacatgaggaaccaagtagtgggaaaagcctgaaaaaaaaagactaaggctatgaaaaaagcagggcttgctggcggaatggcaagtaatatgggatagccacagtttaacatgttcacaggcatggaagatgatcttggaaaggtaagttggggcatgttttataaagtcttgaatgctctgctaagaccttggagttttatttatttaaagttttactttattcaaagttttgttcctctgttcttttaagacgtagctcttgttaaatacaactgcagtgatgcgtgtggggttctcctttgtttgacagtatatcaggagtttgaccatctcttggaggagcagtctcccatcgagtcctacattgagtggctggataccatggttgaccgctgtgttgtgaaggttggtaaaccggcacctagcgggcagccttgggccctgcagcccaccactgccctctgtgaacttggccaagacaaagccctatggtaagctatctgaacagggttttgaggagaggccccaggaggtggaggggtcaggaggcaggactcttgagtcttccatccctgattcaaccaggtcagcatctcttttatctgctctatacactgagtcttggtataagatttcattttttaaagtttttttgctgctacaaacaaaacaaaaaccattgctccatagcattgactttgaagaccataagccttcctgtcatttttctgtatttatttatttatttttgagacagggtctcactttgttgcccaggctggagtgcagtggtgcgatcacagctcactgcagccttgacctccccaggctcatgtgatcctcccacctcagcctcctgagtagctgggactacaggggtgtgccaccattcccagctaatttttgtattttttgtagagatggggtttctgccacgttgcccaggctggtctcaaactcctaggctcatgcgatcatccgcccaccttggcctcccaaagtgctgggattacaggcgtgagccacttcaaccggcctcatttttcaaagagacagtaataaatgaaaggtcaagtcgaccactattaaagccatttactttcttgtaggtggctgccaagagacaagggtccttgaagaaagtggcccagcagttcctcttgatgtggtcctgtttcggcacaagggtgatccgggacatgaccttgcacagcgcccccagcttcggtaaggccaccccagccctccccatctccaagcactttttcctctgggcacggagcccagaggaatctaccacagtctaacttgctgtttctgcaaggtcatcaccctgaaacacatctcttctggggagacatgacattgttaggactttcagggagagagatggcattacatgctaaaggtggagtatcaatctgaaaatgagtggttttgcccacagatagtactatctgagcttaaagaagaataaattgcagtggctgtactccccatgcctagatgttcccagtgattgctgcttccaaagcacaatttcatagaatcccgtatttgtgcacttcccaagactgggcacatgaagaaacctctgagtttgaacacttgcaaatggcttgattgaccatactcttgctgtgggcagatgaccttaagttttctttaaaaatgtactctagtctaatccctaaaagagggcatttgcattcactttcccttttgtttcactgaccctttaagtcttcatcacctccaggagatatccccacctcaagtcttcatctgctgctttctagtataacagggcttgaaatctctgcccaaaggtactgataacagtctctgcgggcagcaacctgattactgaatcggggtgaatgttatgatacattgtaggacagttttctacttttcaccagaaagaaagcagtatgtactgagtccaggtcatcattggcaaactgagatgggacttttaggcattatccagacatttgaaatcccaaaacattttggtttcaattttctaggcattttcggcaaaggggcattggtaaattttctgggtaattgcttcagttctctatttccctttgcaagtaagggttgtggttttgtttctcattatctccaattaagccaatcagctctgggttttgctgtgggtttaatttgacacttttccatctagctttttatggtcttgtcaccattttccagttgtgctatacaacgaagtaaatatgtgggaaaacaaagaaggcactattttttctaaacagccctgtccatgaaagactgtgtttacccacttggagaagtgttttgttgtggatttctttaatctcagcattggaaggttctctgaacctgcctgcaccatggctacagatggaaattctctttgagctgtatatggaaatgctctgctgactgctacctgggcagtgccatcaggcatggcattttgatgacttccagttcagcacagttagtgttagcacatgttacctctagctctggaaaaatcattcatgcagaactgttttcccttaagtgaactgttggaaaatatttgagatttcttcattgcttccaagtcagagaatcaacaatatcacacacaaacacacatatccacatccacacagcgagcatcctctccatgctttatcctttactcttcaatttgcttattcttaaactgaccacgtatggtagcaggtgcctttcattagacagggaaagtaattcccttgcaatattctttgaaattcatctgtgcttactgagttaacagtcaatgtaaaaaagaaagcttgagcaggagaatgattaggctttatgaatgggttgaatttattactaagaaatatggttccttgaaatgtgtttctttttgaaccacacactcttttgggatagatatactggaaactcaggcaaatggcaaaaaaagatgatcacaaatcacttagaaaaggagaaaaagagatattaacccagtctcagttttacagtatttctcaaccctgagtgggttgaaataatacctgtctccaagtccatttagcaaactatctgaaatggcccagctcatctgactcattgttgaattttgcagcttggggtgacaggcaagttaaaagagtttgcagcagacaaaagcccagctccccctttctgcttatatatgtcaaagacccagttggtggttgtgtttgggtcatgtgttccctgtatgaaaacagctaattaggaaaaagagccctctgttccttggtcccctcccccagccacaggggccagctctatatatcttataactcccacatggtccttgtcgctgtgaatgggtacagggtttgtgtgtcagcgtagcaggctgaccattacaatgatcgtgtggaatatcacaatgatcctgtaggggactctatcacctcttcccagaacagcctctttcaaaggtagttgactcctttcttctccttaattccttttcactctcttctccttaattctttttcactgaaagaacctatgctgtgaactaaagtagccagactttctttctttgctgcaagcagtgtttctagcaaaattagttaccaaaggtaggctatcaggcaaacttttagtcctaatgaagcagagcaaatcaaagttttgtttttaaaaaacaccatctttttagtcgactgatctgatttcagttcctagagtacctagatctcaagttggtgccagcgcctttaccttttcattctgggttttcagcaaatgcctgcttatctcactgttatgaacatctggaaggtaataatagttcccggaagtactccagcatatatcagtttataaagcagcctgggtgtgacagctgaggggcacaattgcacaacacttccacagtttcacttttttacacacctgttgtctgacctagcatcaaagctcactcacttgggcagggctggggagaccatgtgggcatgtgtcagggagcggctcccagaacaagaggccatgaccaagccttcccaactgcttctctatgcttagatggcctggcccagctctcttttagacagaatctgctaaattgcaggaccttaatgttcgcaatgtcattcaggcccccaccaagcactaagagacaggaattgctttccctgtagtcaggagtggaagtaaaaacccagagaagagaggacttgcgtgtggactcagggaagtggcagattgaattcaacccgcaattgttcccatgctaaagctggagtttttttctgccatgctacactgccaccacctcatttacctttctttaggtaaaagaaaattaataacaacacagaaacatgtattgagggccgaatatactttagacattacattttctcaattacttctcacacaaccccgtgaggtctgaattactgccctcaatatgacagaccaggaagctgaggtagtacttgaaggatttgcttaacattagagataagaatgaagcaaagacaagataatgatgactattataagaaatattttggaagcacatactatcattgaattcttgcattaactctgcaatgtaggtaataatagacactttctaaagaggtgagaagggagcttggagaatttccttgcacaagatcaatgcagcaaatgtcagaattctgtttcaaaatcaaacctgcctgaccgcaaagcccattcctttttgattatcacaattaaggcaaatactctgggctcagatgcatgccacaatagagctagaaaaatttatttaatccacattgatggtattaatatttttaaaatatccatggattaagatttaaaaatttaaagctatgagagaaaagaataattattagactgtcatgagcagtaagagatgccagaagacaatggagtaatatcttttaagtgttgagaacaaagaactgtcaactattattcaagagtgagggcaaaataaagacataatcagttatacaaagacagaatttggcacccacagatgttcacttaaaaaaacaacaacaaaaaactattaaaggatgcatttcagctgggcgcgatggctcacacctgtaatcctagcactttgggaggtggattccctgaggtcaggagtttgagaccagcctggacaacatggtgaaaccccgtctctactaaaaatacaaaaattagccgggtgtggtggcgggtgcctataatcttagctactcgggaggctgaggcaggagaatcgcttgaacccacgggggcagaggttgcagtgagtcgagatggcaccactgaactccagcctgggtgacggagtgagactccatctcaaaaaaaaaaaaaaagccatagctgaggtctagaatacaagaaacaacaatgttctagttattgttgccattgctgtgtaataaattacctaggcttaatggctttaagacaaccattttattatgtttatggattttgcaagtcaggatcatgtgtcagctcacagttccacgtgcaagtgccccaaatgtgaagtcactttgcttttatgatcccttcttagatacagtgtaacttccctcatactctattggtcaaaggcagtcccaagcctaccatgagtcaaggaggcgcacagaccccaattgttaatggacggcacatcaaagaatttagggaccctgttttaagatgaaagaaatttaaaaatatgtaaacatatttaattaactattgaatgtaatttaaaaactaaaaactaatttgtatatgtgttttaaaaagttaaaaataagttctaggtaaaactataacatggagtaatgagaagagaatcttcaaggaacagttaaagcatgctaatgtctttgtcttttttaggaatactaggtaactttaggctttgttggagaaatttacagtttggatttaataaatgtttagcatatatgttaataaattaaggtatcattactaaaagaacacaatcatgatttatggaggaaaatggaaaaatatgaaaacttaagagacaaaacgttaaatggaaaagaagaattgagaagataaaagaagcatagaaaatggatggtaaatgaaagcacaaaatagcatggtagaaataaagaccaaatgataatcacaataaaggagaaagtctcttcctccaaaaaaaattaggcataaatgtttttataggcaagtttaactaaacttataaaaaatgtaaaatctttagtctatgaaaataaacatgaaaatcaatatttcaaagaataaaagaaaagaagaggccgggcgaagtggctcacacctgtagtcccagcactttgggaggatgaggcgggcaggcagatcacgaggtcaggagttcgagaccagcctgaccaacatggtgaaaccccgtctctactaaaaatacagaaattagccgggcatgttggcacgcactgtaatcccagctacttgggaggctgaggcaggagaattgcttgatcccgggaggcagaggttgcagtgagctgagatcgtgccactgcactccagcctgggcaacagagcaagactccatctaaaaaaaaaaaaaagaaaaaaaggaaaaaaaaaagaagaagaaaatctgttttcagtgactgcaaagtttaggacatcctggcccagcctaggatgtctgatctcattgtcctcagtgctgctttgcccacctcattcccttcaataaaatggtttgacctgcccccgcaaaataaggaaatgattgtattcttttagtaatgataccttaatttattaacatatatgctaaacatttattaaatccaaactatgaatttctccaatgaagtcaaaaattacttagtattcctaaaaaagacaaagaccttagcatactttattccttgaagattctcttctcattacttcgtgttatatttttacctagaacttatttttaactttttaaaacacatacacaaattagtttttagtttttaaattacattcaaaataaagaaatatacaactcattttacaaagctaacataatctcgatttcaaaatctggcaagaaaagcagaggaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagcagatcaaatttagtggcaaaattttttaaatcaatattagactatgccaaaaatcctagtaggaaaaattaccaattaacatactatattaataaaaagagaagaatcataaaatcatcattatagatacagagaaaaaaagcatttgatacatttcagctctcaggtatggtttttaaaaaaccttttagcaaactaggaatagaagggaatttaatatcttaaagggcatctacaagtctgcagcaaacatcacacttaatggcgaaatgttagaaaatttcccatttctatcatgaaaagacaggaatgccttctaatatgatatctaataaatatgtactggaggtcctagccaatgccttaagaaaagaaaatgaaatagaagaattagaaaggaaaacacaaaattgtctttatttatagatgtcatgattgctggcaaaagagaatccacaaactaatagaaccaatgagaattcagtcaagttactgaatttagtttgtttttttttttgagacagagtcttgccctgttgcccaggctggagtgcaatggcacgacctcagctcactgcaacctccgcctcctgggttcaaaccattctcctgcctcagcctcccgagtagctgggattacaggtgcgcgccaccacacctggctaattttttgtatctttagtagagacggagtttcaccatgttggccagccttgtctcgaactcctgacatcatgatctgcccgcctcggcctcccaaagtgctgggattacaggcatgagccaccgcgcccggccctgaattcagtttttataaaatcattggcattcttaatttcactaactcgaaaatataacttaaaacatacacattcacacaattcataatagcaaaagaaactaaaatgtacctagaaataattctaacaaaaaattggtggtgattacactggtgttcattttagaattctctatatttttctatgatgcatatttttcataagaaagatgaaatgctttgattctaccaaatgcaatcaactatattaccatataacaataacaaaataaaatctccttttgtctctaatcctaatgcctttttccataacaggctctgctgctccctagctctgtgactttaagcaagttattcaagccctctgagccttcatgtcctcatgtattaactgaagataataccttctttgcagtgttgttgagaagttaaaagagcttacttagcgcggtgcatatggaagtagtcaatgcttgcctatttgattcatacatctaacacatatccattgagtctctattgtgtgcctggcaatgttgtagtcactgggtataaagcactggtcaagacagaaaaatctctgcaagatagagcttacaatctagtggaggaggcatgcaataacaattaagttaaatacaggttatagtatttaacttcgatggtgagaaatgctaaggagataaataaagtgggatgttcgctgtaactgcctctctcctcttgtctttggtgtctctctgtctctctcatcagtctttctgtatctccttttcattttcctgtcttcatcgatattcactatcctcatcgctgcgacactctggcaatgaactgtttactgcccaataatcttaatgattaatttctgcttagtaagaacacttagcttctgtggagtctgagactgagctttatgcctcctttgtactcagagcacttagcacaatggtaagcaggtagcagtagctctacaaactcttgttgtttgaaggattaaaatttagaatggaaaattaacagacaaactggtagctgatcagaggcattaatgaagagagcttgaaggcccatgtcaaatccgcactttccctaaagtaccggcttccaagttcagctctgatgttttctaagagtaatcttaggcaagtttcttcacctcatcagatctttgtttccttgtcttataaaacaagagaatggtataaaatgatttctaagttgtttgttcatcctaaaactactggtttggatttttatcatccaagctttccatgctaattcattatttcatagtacatttctctctttctatccatgttgactttagatcaacatcccagcaagtaatttcttcattttggagaccctttccttatttgatgctatcttttgacttgtttgactctatgaacaaaacaatcatgtcatgagatcttagaacatagcagcaaaagggatcttagcaataataataatagctaccaattattaagcatctaatatacacttttactcattttagtacttctgtaatgtacattttactgtccttttggagagctgtagcacataacgattgaggagcaacttcagagtcagacagtccagggttcaagtcttggttctgccgcttaatgactgtgtgacattagacagctactttacctccctaagcctcactttcttcctttgtaaaaggaaagtatcacttatctcacatggttgtgatgaggattaaatgccaaaataaatctctggtggtttacacagtggctgccacagaggcagaggtcaataaatgtcagattttgttttcagtatttataaggattagggagggtaaaggaactcatctaaagtctaagctactaagtggcagagctaggatctcaacctgggcagtttgatcaacagcgcatgtaattacccacacagtgctgtacctcctcagtggttcacaggatcccatttcagagaaacagttggaaagtttagttttagagactgcatctcacagtgattgagcagaacctggactttgctgaataccaaatggcattgaaaaacagacatagtactggagatggaagaaggatgtgaaggaggtgcaggacagtggaccttggccttgagctctgtgggaacaaggacaggagtttatggcaggctgtagagagagggggtcatgttcatgacctgctgagcatctagtggccttacagttaagccagggatcttcctctctagcctttctagaccaaaagaattaactgatctgagatgaagggtgtgggtgtatacagaagccaggtgcagttaaggagaaaatacataaatttcaccaaggagtgctccacaagcccccaactagcctccactaccttatgtctgagacttggagagacctagctcccagctcaagtggcccctgtaggggccaagtcacttatgccatctgggccttattttctcatctgtgctatgaacatattgaactaaatgacttataggggaatgggaacagattacggagccagaccaaactgaggcaaatccctacttgattactaatgaagagactcatttcctcatcggtaagggaggataataccatctacctcacagtttgttgtaaggaagaaacatatgttcagtgcttagcagagtttttggtacagagtaaacactcaataaacagtagatgtgatgatgataataatggtgatggtaatgatccatgatgaagacagaatgacaaaaaaaataatgccagagagtcccgtaaagtctctaaaaggctgggcgtggtggctcatgcctgtaatcccagcaccttgggaggccgaggtaggtggatcacctgaggtcaggagttttagaccaacctggccaacatggcgaaacccatctctactaaaaatacaaaacttagccaggcatggtggcacgcacctatcatcccagctactggggaggctgaggcaggaaaattgcttgaactcgggaggcagaggctgcagtgagtcaagacagcgccaatgcactccagcctgggcaaggtagtgagactccgtctcaaaaaaaaaagtctctaaaaaagcaaactagaaggaaatgggaaaaaagcaaacagtatactggtcagcttggagagaggtgagaagttttggacattttaaagggactgcaggatatctacatggagatgtcctattgggacctggaaacatgggatgggagataaaggcttggcccctctctctgaccctgggtccatgaggccttgattacagtagacattaactgagcccctaccgaaggtgcaccattccactgtgcatggtagcagcatgacatgcaaaaaaaagctggttttgaaataatgtattatctattaatcgtgtcatcttgcataagtgcttggcctgcaaaataagaataaaaatacccaccttgccacatggttgtagttattaaattagagaagataagactttgagcacagagactggcatataggaaagtctttaaaaatgactgttcacattcccttttacaaaataatctactctaaattgaaaaatgaagactgccacttgaaaagaccaactatttttaatgaattaccttttctaagaaccatgtgctaaatgaggtcttgaaaacatttagggaaataagtaaataacttgttgcagatttaaattttcaaattggctcctagaattatgtcaggtacattagtagatagcaatacaaggcaaagtccctgccatggacatacttaaagtccaattgggggaataatatgctggtggaagagataaaaatgagagacactatgttaataaatgccgaagagagtgagcggtgctcacatgaggatgaggccagtgggtaagcaagagctcagagatggctcggtgggtgccatttttgatggtgtcatactgatataacttcagcaaggaaaagattcacttgccacaaagtgttaatgacacttaccttatgccaagcactaggctaaggtgaggatacagccaagaactgcaacctatgaccatgaggagatcataattgagtggaaaattagactcttgagcagagcatttagaacactgtgtaacttgtgcagttgaccagacagagggggcatacacgagacagcacgacttactttctgtttgatcctttttttcaccagggtcttttcacctaattcacttaatgtttgatgactacgtgctctacctgttagaatctctgcactgtcaggagcgggccaatgagctcatgcgagccatgaagggagaaggaagcactggtaagccagcattttcctgggaattgcaccacttggtaatgttatttgtatccttacttctgtgctttatgtttctttaactctgtatctcaaagaatttagttatggtgaacaggttaagtggtatcaaaccaatcatgtctttttcctctttaaagtgggcatgtgggctgggtctggtggctcacacctgcaatcccagcactttgggaggccaaggcgggcagctcacttcagaccagagttcaagaccagcctagtcaatatggcaaaaccccatctctactaaaaatacaaaaaattagctgggtgtggtggtgcacaactgtagtcccagctgctcaggaggctgaggcacgagaatcacttgaacccgggaggcagaggttgcagtgagccgagtgtgcgccactgcactccagcctgggtgacagagcaagactccatctcaaaataagtaaataaataaataaataaataaacaaattaaataaagtgggcatatttatatacagaaattgccttgagtgtcatgatggtgatgggaaaccatcgaagagtttgacaagagagtgacatcacacagattagaataatatttcactttttaaagtcttttagagacacttgcctttacatttggttttaaaaacttaccctatctctatccacagcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggtaatggaaagtccttcaaaaactttgggtagttaatgtttgaagaaagggctttctgccagcctgggcaacatagtgagacttcatttccacacacacaaaaagccagacatcttggctcacacctgtagtcccagctacttgggaggctgaggtgggagaattgcttgagcccaggagctacgatcgcaccactgcattctagccttagtgatacagtgagaccttgtctcaaaaaaagaaaaacagggctttctggaaaaacattcttctcccacaatctccaaaagataatgccaaaacctgggtatcttcctggatttgtgaatgacgtacaggtattcatttattcattggtacacattctgtatgctgctgttttcaagttggcaaattaagcatatgataaaatcccaaaactaagccactgaattgattataatgctatat

SEQ ID NO: 12159 - DNA, 7234 bp, Human
tcctcgtacgattttttccatcttgaacagctatgatttgaacatttccttttgccacacatatgcaaatcagtaataaacttccgtacagtactttagagcttagaaaagacctttcatgtaagagtcacataatatcctatgaggctggcaagaaaatacatgttactcttattacagatgagaaactgggactcaaagaggtgtgaagctagtgtcccaacagttacttagcatttactggataagcccaggctctaactgggtctcctgacagaagtccagctctctctctctgctgcctctttgtcagaactcctggcctgccagcgaatttaactgtctatgagtaaattctaacatctaaggttctaagtataaaatatattgaggtttacagtggtgagaaaaagcaagtgtctgcgtattacagacagctgataaatacgtattgagtcatcagaaagtgaaaatagatgtaggactattatgcaaagcataggagaggaagagcatatgcttaagaaaaaatggcattcctagagttaacaagcatgtttcaaagtatctattactgaaatctacacgattttcctttccacaataaagtccacaactgttgtcttaaataataactgcaggttttgccctccaagtcaaacttggagctccaactactggcagctcaccgtaagaatatattaattatttccaatttccttttaagaagtcgaatacaaagtagagagaatatctgcagcttggttgcaaagccgcttaaacatttcactggctagttctggtaatattatccgaaatcaactcattttgtggttgaggtaatctatttgtctttaccaatcaagtcgttttaaaaccttcaggagtagagatgatacttgaagaattaacaaataaaacttaatcaaggaaactgttaactcattctcccccctactttttgccagttattaaatgttctggtaaatcctaactcaacaagaatgactcatgaggaaatcctgactccttgaactcactgattctggtgcattacagctatgaaatctctatgtctgcagctttctctcccaccataaggaaatctgtgatttctattttggcaggagatgtgaccaaggactcctgaggaatgaccctatagacagacccagccacgtgcctagtagtgatcaaaaatgcaaacccaattaaagcactgtcttctgataaagtcactttctcttgttcaatccctaatgttcattctcaaagtgttccaagacgccccagcaagctgcagagcagatcccaccctgcccctgggcaatcaacgtttcaggttactccttccttaagttaagtggcagagagaaacgggcgagggtctccccattgcctcagttcacagaccagggggtgtcgaatgagtcctacagcaggacagcaaacaagaaatgaggcgcggggtcagggaacgcgctcaaaaaaggaagaaaaatcccactcttcattcgaaatcaggccactgcactccggcctcgtggcgggcgacctcctcctgccagggaatcgccgctctggcctcgggctggggagcccgtcagggtgggtgagggagcgccggcgcccccgcccggccgccgccaacttcggctccctccctccgtcgcaaagccctcgagcccgcccggccgccacgcttcagcaaaaggtcgtgcgcagcggcccacactgaagactctccatctgctcccacacctgccccagctggccgctgctatgtggcccgagtgcgcaagaagccggggccgcagacgtcagcagcgccccggcttcgagacccttcggcagcagccgtgactgccgccggcgggcgctgacccatccccgtgccagtctgcagccgaccaatccgcgtcctcttgaggcggggccggagccgcgaggccccgcccccaagccgaggcctcataaatgctgcgacgcacgcccagccgcaaacagccggggctccagcgggagaacgataatgcaaagtgctatgttcttggctgttcaacacgactgcagacccatggacaagagcgcaggcagtggccacaagagcgaggagaagcgagaaaagatgaaacggaccctgtgagtatggctttcttccctctcccgccaccccctgccccacactgcaagctgcaaacgcggtactttcgggctcgcctttgacgttaggaaactagcctgagcctatgcagggaaaaaaaatcgaaaaggtcaatttgttaagtaaggttaaatctgggtgatgctcgggtacagtttaagaaccgagggagacagttgatatgagggcggtggttgatgcgctaagaaattgcgggttggctttttgtcctcctgcattcaaaatgacatcagaatcctgcggctgaagcgcgtccccagcattcatacgttgcatgatgagttctcatcagcttacacagctactggaaggtgatgctcttgctggttctgaatatactcgtttaaaatccatttttgttttttaattatagagcagatctcacccagtccgaatgtggaacaaataattgttatgcagcgtctgcttaaaagaagtgtcgtaggtggggaaggaagagcgcaggggaatcagtcacccacctctttgtacagtctctggcgtggtccagaacctcctgctctaaagagagaagcgtgggccggctccagacagttccatgtctgtccttttcattaaagtgcaaaacgtctcggaattgtaattaaccttgcaaacaaactgatgccctttgtgagccagaaatagtgtctgccttttgaactaaattcattaacaattctttaaaataccctagtgattataggtagccctgcccttagttgtaaaactagtagatacggtcagattaatggacgaaactgctcagtacatgaggtttaaatgttaggtggataagacttatttgaagagttcttgctttgccttatgcggtttgtctctagttactgggtgactttatttggtaaaaatgcgttcagctgcagtagcatattcaagtgttgctagttagtaattatctttttaattttttgttttagtttaaaagattggaagacccgtttgagctacttcttacaaaattcctctactcctgggaagcccaaaaccggcaaaaaaagcaaacagcaagctttcatcaagtaagttgagaatcctgtgcttgcaaatatcaatagttagctgctgaactgaaaaggggaactctgatgtgcgtaagctaacatacagaacctctcttgcaggccttctcctgaggaagcacagctgtggtcagaagcatttgacgagctgctagccagcaaatgtaagttaactcttgagcttgagccattgctaacatcgcaaaagcctggaaaggctgcgtccacctaacaaaagagcagcttgcctgagggggattagactgcagtcactataggataaagcctgtttttctttcctttatttcccagggtttaacaaataaatgcatatattctctccaggtggggaagaaaatcagcctaaacaaattaaagtggcagttgcttatagttaaggttgagtcagtttttccattgcatacaatgttttcaagaggcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatgtgagggataggagaaacataaggaatcatttggtctctcagttcttcacattctgcatgctctcttttctccccccttcagatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagaggtaaggaaacaagttcctaatttcagcacaatctggacatctttagcacaaaagtgaaacaaagtaatcaaggacaaagcgggctaggaggggtaaaaagtccctccacgttgtagctttcagttatgttaaagttctcctgtgacttagctagtaaagctaatcacacataatttttattttttgttttcaaatactaaattttaatctttaactctgaataccaaataaacaacttttttgttttatttcagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacacttggagtctagatgtgattttatttttgataactggaaatgtggcagataaagggaaaacatctttatagtaaaagacatttcagtttttgtgcctgcccagtgagaattgacagtcttcagaactgagaaatgatagttgcagacagataattctttttttaaaacctataagcattatgcagacctaaggaagtcacatccttagaaccactgcatttatgctttctaatcttaaaaaaaaaatcaagcttgttaatgaaacactgatctaaaggattctgtatctaagtaccagctaaatatgagaagtaaatgtaatggagacaagcacaaaaattattcacataattaagcttctcaaatgaagaaagaagccaaataaggtcaatgtatgcctgtctttatttactttccattggttccaagctcccccacaagtaccagcatgggcttccaagatacatacctgaaattgttcccttccataatgtatcaatagaaaatctcagaattttcctgattttcatgccttcatttggccaacaaagaatctgttactttaggtaatgataaagtcaaaagaagtgcgctttcgtttcttagacttaaatccagaaatgtgcttttttccacttgagagaggaagcccttgaatctgttttcaaactggctaattaaaaagcaccccttcctcagcaggctgtttttttcaatgtccttgattatggtcttaataaaaaaggaggaggaaccctgattttagagttggaagaactgacgcaaagtaatcatttctcatagctttgtgaccttgggtgtccccattgtcttctctgactcttcattttagaccttcctgcctttctggttttataaagtagtaagggactttagaaatcataaagcactaagaacattttttttctgatttgccagaagaaaaattgacctccagtagtttactgtttccattgtgattgcactaattttcaccttagccagagtttctggcaccaacagacacaagctctattagagagactgccttgtctactgtatcacagcagccagaataatacataataggtgctccataaatattgattgaataaatgaatccaaagagtcattgaaacaaatatttctttggagaataaatgtgtcaggtctagcataatccttaatttggaaagattttgaccaacagaggaactcaggagtcatgccatatatcatcctatttgtcaccaagtcatttattttacttcaaacctctctacagcctactctctgttaccactctgatcaaagacaccaccatctgatgcctagattactgcaatagtctcatctcctctcacccactcttccccctctcccacaccaatgtgttcctgccttttaactctagggatcccttcaagacaaatctgatcttgtctccagttgcttataaacaccttgacaggttttgcaaacaattaggataaagacagtatctctaatatggcctaacacctgcatggcttgacccctccttttgttccaaccttgactctaccacatttctcccagctctttctgctaagccacactgtcctactttcctagcaggtgccatgcccactggcctcacaggaccttagcacctaatagttcctctgcatggaattcagttttagctcttactcatgcacatatcaatgcaattgccacttccttagggaagcttccctgacctccttacctcggtcagatccccttttagatggtcttatagcaccaggttctctaatttagagcacttaatggagttgtaagttctcattaatttgtctgattatttaataattctatatcttcctccaccaaattgtaggaaccacaatttgaggacccttggcctttttccgctcaccactgaatcccaacacctagcatagtgcctgctgtacaatgggagctgcataaatagttgttgaatgaatggatg

SEQ ID NO: 12160 - DNA, 119032 bp, Human
  misc_feature (1)...(119032): n = A,T,C or G
tacagtactacttagatattgagtaatgtaatttatattcattttttactcttttccatcaaaacataattttactaagtacgcatgttctgtgtccgtgttttgtcatcactgaagccacttttggagtcacctagtaatagcctttccactctatctagttctgtagcttttatgtgtgtaaattacttcaaatctgtttatgatcctattgctggaaactttatcccaagacacaaaaatcttttctattagaagttattaactttaaaacaattatttattttattttattttattttttgagacagagtctcgctttgtcacccaggctggagtgcagtggcacgatctcggctcactgcaagctccacctcccgagttcatgccattctcctgcctcagcctcccgagtagctgggactacgggcgtccgccaccatgcccagctaattttttttgtatttttggtagagacaaggtttcaccgtgttagccaggatggtcttgatctcctgacctcgtggtccacctgcctcggcctcccaaagcgctgggattataggcgtgagccaccgcacctggcctaaaacaattatttctttaaaaaaacataccctctattctattttgtgtcttcacaacacaatcacttactgtattgctttttaaagtgatctttaaagagtcttgcagaagagactacacagcaggcccgagaccatcctgagaggcctgtgtgcaaggctggccccccgctggtgtcaggacggtgcccaccaccctcaatgaagaggggctccctgtgcttagctgcttgtgtggggaacaaggtttgtgctgagaaccttcctttcttctgggagtccagagtctgggcacgaagcaggcagagggtgcccatgtgcccagcccccagtaaaaaccctggcaccgagtctctagtgggcttccctggtgacgacactgcacatgcgttgtcacggctcactgtgtagggagttaagtgcgtcctgcgtgaccccgctgggagaggattctggaagctcaagcctggtttctttgggacatcgccccatggacctctgcccttgctgattttgtgtggaatcctttcgctgtaatgaatctcagctgtgagagcacctttgtgccaagtcctgggaatcctagggaatcactggcctgggggtgatccgcggaccactgacaagtttgttctcaatgacaaccaatacttttataccccctggaagaattgagttaatatgacatttctgcttttttaggtggtggtttttatctagcctgttgagtggcctctgcagtattgatcgaggttgtttcaggctaatacgttttcccccacacagtatattcaaaataaattaatgtgggagggtcatggaatattaggtgacccctctcctgagggaaaactctatgtcaggggatttatgatcaactaaggggttagactcagtgttctgcaggtgcctttgaacctgaagcctgtagcaggccttgcttctcacgcttggactctgccatcctgtgaaacgtgggtttgggtgtgtttcttctgtgtggagcccgagagtctgcctttcagacgggctgccagtccacggaccacactttgagtagcaaggggctctttccatccaaacagggtgtggaagcagtgctgggaagcagtcctgcatcctcacacccgtggcaggtgggcctggcaggaacttgtgtggtaacaaggtagcagttgtgggagacattttctactccgaaaggaagtttcttagcctgacttgaagatttattatctatagacacttagaggctctttctgtggtggtttttattatgaattatctttttgtgtttagctaataccagtgagtggtggagaaagatgggctctttaataatgagctgttcgtttttctttcttagggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaaggtaagcctgccaggagccactcagcgcggaggcccggcctcctcacttagcagtcacggggaggtgactcccagtcaccagcttgcacagtcctggcttcctcctgctggccctgtggcctctgtggccatcacagggtgtctgcgttgcctgtgggctgcggactgtgtcttgctgggacctcttgccccctgccctgttcgagtccttggttctggttctggctctgatggctggtcctgggcaggacatctgggcaggactggtggtggcgagagggaagttgttgtcttggagctcaggataaggcccttcctccccttcctgctcctccctagctctgtccctgtggctccttgaagcccattttaggtctgaccccagaatcttcatcccagtgtcccacacccctcttgaggcgagaatattcttgaagcactgaaagctggttcctcgtgctgtttcctccatggggaatatcctgttgtgtaaaacaccagctggactccgcagtgggcctggggagccccacgccgcctgctcactgaggggtacctcaaggtgtgtagtgctgccttgaagacctggacccatcagcatccctttgggggccctgcctttaggagctaagtttggagcaggaaagagtaaatgagcaaagctgggaaccctctggaagggactttgtccagcaggaggcggtgctgccagtgtgggagtgtgcggggctgtgcctgtgcggttgggtgcagggaaccctctggaaggacttcctccagccagaggcggcgctgccgtgtggggctgtgctgtgtttggagccagggcccttgtgacaggtgatgggggtgggcacttagctccctttgtttcagagaaactactccggctgtttacgatgtaaagacacctttttagtgtttgttcacatcctgagaccatcctaagaagaccctctaaggctgctggctgggtaggcagggccggggagtaggaaaggccgtgtttgatgaatatttctacttgattccccctcccctagtgttttccatgatgaaatgtagcacctgagagcatttaaaggcaaggaaggagccggctgccgtggcacacgcctgtaactgagtgctttggaggctgaggcaggaagctcgcttgagcccaggagttcaagactgccgtgagctgtgttgcagccactgcactctagcctgggtgacagagcgagactctggctctaaaataaaataaaatttaaaaaatggaggaagaacagatttctcgttttatctcctcaaaatgatcactgataacattttgatgtatgtaagcatagaatttttttttttaaaacacttgtaatcatatggattttcaacatcctctttatttttggggacagggtctggctctgttgtccaggctcaagtgcagtggctctatcatagctcactgcagcccctgctcctgggctcaagtgatcctcccacctcagcctcctgagtagctgggactactgagtagctgggactacaggcacttgctaccatgcctggctaatttttatattttttgtaaagatgggattttgccatcttgcccaggctggtcttgaattcctgagctcaagcgatccttctgcctcagcctcccagagtgctgggattacaggcatgagccacacgcgcctggcctcagcctccttagaggagtcgttctgcagctgcacgtgctgctgctgtctttccttgtctcttgatctgagccctggtctggattctcagggaggtgccctcctgcccgccctgggcctcacctcacttctccgtggagcctgtaggtggtggggcagggccactcccagggagctggcctcagtgtgggctgcctgtattgggcagggatgggaggtgaagggccctggaaagtggtgaaaatgttctttggaatcaggagattcctcatctctttgagtacatatttaaaactgtgttttctccactgctgtggtgtagtgaaggttgacactggtgtttatgtggttctttgtggattacagggcaccttcacctgctttctccttgaaattcaaagtgacctggacagtggggagtatgatgccattttagataattggcagtggtgcttatggtcctcagcggacctgagagacagataatgctgtcgtccccatcccaccagtgaatggactcctccttggggcgggtgacatgggggaataggtggggttgtgatgccagccttgggcttctttgcagtgaagatgagggtcctggctgttcccacccacactggagcagagcagaaggggagctagcatgtcctcagggttggaaataacggtgtggcggtcactgctttgcagagtgcatccttaccttgataggaatcctgaggccatcaggccaggcgattgaggtttggctgtcaggtgacttgctcacagtcacagggcatgtgagtgctgggaccaagacagccctggcgctccgtgtgggatttggagtggccttcataatgtggcgtgatacactatctaaaaataaacaggtagtaacgtgttgtgttttatgggttcctgctgtaatctcttgaggtttaagtgttgctgtttactttgccaagtgggcctccctgtgtagttaggtgagtctgatcccatagcctccccagttagagcagcagaagcttccaggggtcatgaggcggccacaagatgggtccggacgtcgccgtggacaggtctgcagagtttcgaaggtggccgtgaccgtccgcagcgatcagggccccacctggacgctggcctgtgctgagagaaggggccagcagggatgcaggaagtgcctggaagttagaagaagcagcagagttggcacagggagggagagagcagaggaggcccctggagggtgccatggtgtcaggcagcgagcttcacgtgactccggattcttagtgacggggacttcagggctttactttgcacaaactcaggtggaatcagtcaggatccagccaggagacaggaaacgcagcagtaatttgaacaggaaaaattcagtatacagaatcgttaacaaaggaaaagaaggttagctgctgaaagagaaaagaaaggctaaggtcatcagtgtggaaaggggctgagtctagaaaagtgggcgtgggaggcttagatacccagagtaggggccttatctgacaggactgtgagtccatcgcagctgtgagagagtgaagcagctccaggtgaggattggtggctgtccccagtccccaggaaaaacgatgtgggaccctcacatgccagtccaccccactccatctgggaggcagtgcctgtgcccattgctgaacattgagcccctgggcaggagccatgtggtcttcaaggcccagtgccaggatcagaagctgggcacggcagggtgggtttggcgctgagaagaaatgccttggtgtctggcacagtgccccgttaggctacccagcgtctgtatgcacccttcttcagcacccccaagggcatctcactcccagcttctgcttttgagtccgccttggcttgcctgcaccccagggcagggttttctgtggctgtggagcagctccggcctggacagccacgtcagctcctccccccagtggactgcaggcatgtggtgtccagcgcgctctgaggcccaggcctgggcaggggcccctgctgacggtgtccttggcttaggcactcgcccttagccctagaacaatcttcagcattccctctacacagttattactagttctatgaatgttaaacgttccctttgaaattactggcaccagcctttcttaatctgtatgcaaaataagctgactattagaagaaatataatactgcatctagtcacaagttggtctctaaggccaatagttctgtgtcctaactgccaccagattctccattgttgtcctttgccaacgcttttgtcactgccgcctccatcctgctgtctgcaggctcagcccgggtttccgccctcagtggccacttgctcctgtgaaagcctggggaccagcgagccagaccccttgttgctcggcatttctacgtctccttggtgagatggaaagctctaaccccctgcacaccgagccacgtggtgaccttgtgccagctcatccttgtcagcttctccctcctctggggaggagcaaggaaggggagctgagttacttgtagactcgctgagggtctgaaattcttgaagtgggtgagatgatgtttggaagtggactgctttcccttttgtgtagtttgctctttgtctctgcctaatgtctgtagccagcacaagctggttctcatggagataagcattcaggcctgtgactaacaaaaggggctgatgtgaaagagaacccaggatctcgaaatgcttctgtcatcaaaaatgattgccttgtgtttcatttaaggcaagcgtgtttaattctgtgtctctgcaaactgactcaaagttatattaattaattaaattaattaattaaaatacctggttaagtagcagcacccaaattcttaaaatttccatacaatggattttggaaattttaaaaatgaaaatatgttatttgtgatatgtaaaggattgattggtgtaattttgaaatgaatgaatacatatttttaaattcctcagtttaatttctggtatgagaaacatcagtagctgaaacccacaaaaataaagactcgctgaggtgctcagtcgtttgtaggtactcccaggagtcctgagaccacagcacttgaggactgctgcccgcagaaggttggatttgcaggagtgagttccttctcaactgttgcttactgagataagaccattaacagagaatggagaaataccttatgggtgtactggagtacccgagagctacatctgagtgagatagtggtacctgcatcacctgaagtacatctgaaaatcgcgctcataaaaaaggcaaaatacagaagcctcaagcccgtgagcagcgcagtctgctgtccagggtggcgcgtgcccctcggtgggaggacaagccaggggcgagcgggaggacgagcaagcaccaggctggggggcctctcccgggaggggtgccgtggcgcctcgctcgtgttggtgcagttttatttcttgcggtgcagtgtgttggtgggtgctcatcatctcattctccaccatttgttcatgacgacatacccaaaggtacaatcacagacacaatgcgaacagcactgtaagagtcagagccttagatgctgctgctgcctctgccccgctccgcgcggggagctgcagttcagagttcgcttcctttcatggacttactctgtttgcacagcctcttggatattctcttccttttccttccctttattgaaaatacatgtgacatactgctgtgagttacttttttctaaaacaaatttctcatgtacatagttatatatcaattttaaaaactcttcttcattgtagtggccacgtggtattatgtcatatgcctgtgccatttcttactgaatcagtccccagttgatggcaaccttagactgtttctatatttaataataagctggattgcagtaaaaattcttaaagttctatctttgtatatatgtgagttttcttttgggtaggttcctagatgtggaattgctgtttttaaaagtgtatgtgcattttaaagtttgccaaattgctcaccaaagaggttttctagtttatatttttgtcagtagtgtgtgtgtgtgtgtgtgtgtgagagagagagagagagagagagagagagagagaatgcccccttttttattgaaggagaatttgtgttattttgatgtacagaaaactcaacagtgttcatttcacccagtttattggcaggttctgtggcctttgccttttccagcttggcaacgtgagccacagattttggtcccagagctagctttcccagcgatggcagatcttgtcatatctgttgtcgtgggtcttgatagcttccaccagcttagagctcccttgtcttccaagttaacctgtgtgaaggcgacagtggagcagactcgttggtcctgcgggcttgacgccctcgtcaggccttcccttgacagtgcggtcgggaacccccatctcaggacgcaggcaggcaggaagacaaccagctcagtgggagccacgtcacgtgcgatcaccacccgctgagccttctcgttctccaccaaggttgtgacagtatcaacccctgctggaaggacacgtggtccatctcttagtggggatgtcccctgtgccagtgctgtcttttagtccaggccaacagtctctgcttcttctcttgcttgtctctggttggtactgtgggccagcgtacgccattgggtagctgcctgtggcctgaggcctgggtgaaccagtcaatcacaggaggtgctttcagccattcatggaggatggccctttgccactgcagcctgatacagcagggcccttgacaaagtgggcaaggtccctgtaatggctggacgtcctgtccactgcagaaattcttagggctttcctcagacgtccatcttcttggccatctgctgctgcatggtggcaggggccagggcctcctccttccctttggccttcttccctttcagcatcttaggtagctggagaagaggcccttttcttcctacccatgtagctctggagttttatcagtgttttatttatttgccaatatgagaggaaagaaatagtgttatttaatttcttaaattgagcaattttgtatcttaatagaccataaatatttctcttattgtctactcctgattcatgtaccttggccatttttctacctgattgtaggcctttttcttattgattagtaagagctctttgtatgtaaaagaaattagtgctttggtcaaaatattttaaactagttataaaaaaatctgccaaaggggaaaaattgaaaatgaatgaatttttggtagctggaggtcaaatagagagtgggaattttcttgggaggagttttctgaaaggtgatttatgcatgcttggagggtaaaggataggattccttggttcaggaatgcggcttaagttttattttgatttgtttgatatgaaccttggcataaaatcaattagtaaatttggttacttttataatttattatatagattaaaagctacataatagggatatgctatggtttgattgtttgtcctctctgaaactcatgttgaaatgtaatccccaatgtgacagtattaagaggtgaggcctttaagaggtgattaggtcatgaggactcagccctcatgaatggcagaatccataatccattcatccttgatagcttgtcacaggagtggattagttatcaaaagggtgggtctgaataacgagcagtgagattgaatcagtaacaaaaacatctcctaacaaagaaaagtccagggcaagatagattcacagccgaattctaccaaacctatgaagaactagtaccaaccctcctgaaacggttccagaaaatggaggatgagggatttcttcctgactcattttatgaggccagtatcaccccagtacccaaatcagacaaggacacaacaccaaaaatacagaccaatatccctattgaacatagattacaaatcctcaacaaaatactagcaaactgactcaagcagcacatcaaaaagataatacgctatgatgtgttatgtgccagggatgcaaggatggttcaacatatgcaaatcaataaatgtgatatatcccataaatagaattaggaacaaaaccatatgaccatctcaatagacatagaaaaagcagttggtaaaattcagcatgataaaaaccctcaacaaacaaaatatagaaggaatatagctcaaaatagtaaaggccatctatgacaaacccacagccaacatcataccaaaaggggaaaagttgaaagcattccctctaagaactggaacaagacaagaatgcccactctcatcactcctattcaacatagtactggaagtcctagccagagcagtcaggcaagaggaataaataaaaggcataccaattagagaagaggaggtcaaattatcgtggtttgctgatgacataatctttttttttgagacaaagtctcgctctgtcacccaggctggagcacagtgctgctatcctaggtcactgtaacctcaaactcttggactcaagggatcctcccgcctcagcctcccaagtagctagaactacaggtgcatactaccatgcctggctaatttttaaatttttttgtagaggtggagtctcacagtgtagcccaggctggtctcaaacttctggctcaagcaatctgcctgcctcggctatccaaagtgctgggaagtgtgagccaccgcccctggctagatgtgatcttatatctagaaaaacctaaagacttgactgaaaaacttagattggttaaacaaattcagcaaagttgcaggatacaaaatcaatgtataaaaatcagtagtatttctttataccaataatgatctagctgagaaagaaatcaaggaagcaatcccatttacaataactacaaaaataaaatacctaggtatcaattgaaccaaggaagtgaaagatttccacaaggaaaactacaaaatactgatgagagaaattgcagatgacacaaaccaatggaaaaacatccatattcatggattggaataattaatatcattaaagtgaccatactgtctgaagcaatctacatattcaatgtaatccctaccaaaatacctacgtaatttttcacggaagtagaaaacgcaatcctaaaatttatatggaaccaaaaaagagcctgaatagccaaagcaattctaagcaaaaagaacaaagctggagatattacattacctgacttcaaattatacaaggctgtagtaaccaaaatagcatgttactggtataaaactagacaacaaaatagagaacccagaattaaagccacatatttacagccaagtgatctttgacaaagttaacgagagcatacaatggggaaaagacatccttttcaataaatggtactgggaaaattggattgccctgtgtagaagaatgaaactggactgctatctctcaccatacacaaaatcaactcaagctggattaaagacttaaacctgaaactataaaaatactagaagaaaacctagggaaactcttttggatgttggtctaggcaaataatttattgttgaattctcagaagtacagacaacaaaaacaaaattggacaagtgggacttaaagaacttctgcacagcaaaagaaataatcaacagagtgaacagatagcctgcaggatggaagaaagtatttccaaaatatgcacctgacaagggtctaatatccagaatatatgagcactcaaacaactcacagcaacaaaataacgccattaaaaagtgggcaaaggatacgaatagacatttttcaaaagaagatatacaaacgttcaacaggcatgtgagaaaatgcccaatatcactaatcatgagagaagtgcaaattaaaaccacagtcagatatcatcttacctcactcaaacaataacagatgttgtcaagggaactcttatacactgtagttgggaaggtaaattagtacaacctccatggaaaacagtatgtagatttttcagagtcctaaaaatagagctaccatttgagccagcaatcctactactgggtatctgtctacccataggaaaagaaatcattatatcaaaaagatacctgcactcttctgtttattgcagcactatccacagtagcaaaggtatggaatcaacctaagtgtccatcggtggatgaatggataaaggaaacatggcatctatacccaatggaatactattcagccatcaaaagaatgaaatcttgtctttcacagccacatggatggaattggaagctactgtcctaagtgaaacaagtcagatacagaaagacaaatcccacatgttcacatttataagcgggagctaaatgatgtgtacacatggatggagagagtggaatggtagagaatggagacttggaaaggtgaggggtgggaggaggggtgagtgatgagacacttctgaatgggtgcaacgtatgttgcacagactgtgcatagactgcacagacttcagcactgtgcagtctatgcatgtatagtaacaaaattgcacttgtactccatacgtttaaacaaatacattttcatcgtatctaagaaaactagagagtgggtctgtgaagagccagtttagctccctcaacatgcgatgccctgtgctacctcaggactctgtagagtccccgccagcacgtaggccctcaccaggtgcagtcccttgacctccaggacggtgatgaatacatttctctttttaaaaaataaatgacctagtctcaggtattcagttatagcaacaggaaatggactacgactatatatacatacacacagtagggatagagagatacaggtatagatatagtagttttgcagttaggtagtaatgcagatggtagtgagatttctcttactctagggttctacgcaaagtcagccggagctgtgttgggagtgttggtttataattttctcctgtaaacttagaaaacttttgacctggctgccctggttcttcaaactacatgcgactgtgtcctaaaggaagcaaagtcatggggtgtgtgggcagctctgtgagcagagtggccatctgggatctgttacctggcctgacttttcctcccccttgtctactaaccatgtccagtctggatgggaggtcacagggtcacctttaactccaaggggaagttgtcaggccaagaggctcagctgttggattccaggttggagagctgagggttccgatgaaaggcacaaagaccgagctgcacactgcgagcatcagtacttcctttcctaccctccctgtgagaaatgcctgagctgtgggtcaagaagaggagaattggagagcaccagggggtcaggtgggtgggaggagccttcacattccactttgagttccatggtggccccgatggaagctgccctcatgtttgggacccaggagtgcaagagatctgttttctttggtgtgtttagaacttggagggggactgccccatagaaggtgggagtggggtcagggcaagggatgactctgagtggcatgagaagttcctctgggctcctgggggtcacagagcttgagagagtgtgttgcacaggacagtaaatgtgctcatgggcctgcacccaggccaggcagtgggagaaggagatgagcacaggaccaaaccaagtgacacctgagaggctggtggccttaccctgtgatgttgaagcaacagttacacaaacgtcccctcatacactgaaactgcagggaggggaacagtgcggcgcacccgagagggcttgagtgtgatgcgactgaagcactaaagagcagaattgatggaaaagttaatttgactgtttacttagaaatgactgaattaaatctgtatcaggtgtaattttggcttagagttagaaaatcagattgggttatataaaataaaggtacattttaaagttaaatgtcttacaaacctgagtccatgagtgcaaaatttcagtctattacgtttagttgaggaaggagtaagagaaggaattcctttgcctttttaaaacaaattttccctttaagagaacacagtgataaaactgttaggtgcagcttttgggagtcactgatcttattgcatatcaagcttcctaataatttctaggacacatgtaatcgtgaggctttatagaagcagagagaagctgtctgccaagtacaccgcctggttctttcttgctgtgtgaggatgtgctctggcccagatttcacatgggaggtctctaagcaaatgcacctgcttacatcagtcacatggaggaagctgttgaccatgaagtatctccattttgtactctgagagctgcatagtttatatggcatttttcagggatccatactccataactcctaggattccaagtttatttactgtgagcaatcctagacacaccaagtacatcccgctgaaggcattccacagataaggattctcctgctagcaaatatccttgggtttgccaggaggtctttcattagcaagtttacagggagatttgattaggtcacctttcttgtctggggtaaccccagttaaagtgagagaatggactacaggctcctcctccttgccttcttccttcactcagggagagaagatacctgtactagaagggcgtgaagaattgtgatccaggatcttattggcagcctgttcgcaacaacagcacctagaacagtgcctggcagttagaaggcacttaatattttttttgattgaatgaaattgtctgttgacaatggagtaaaaaaaatgtagtatttccatactatgggatccatacactcattttaaagtaatacgagtttctatgctataacagcacaaattaaaataatagtggtttagataaagaagtatagtttgagtaaaccctccagagctggtgtggaggctccaccctcctcaggaacccagggtgcctactgttgtgtggttgctgctctccacatgtggcttttgccctgaactttgagatcgctcctttagcttcacttccccatttccttcagcaggaagagggaggtggaggcacagtctggaagttgcacacatctcattggacagacttagtcatgtagctttgcctagtgcaaagggctgggagatgtagtccttagctggacagccgtgtgtctagctaagatttctattcctgtggaagaaggggagactggttcttgcaggaatggcgagcagcctgtcacgcaaagcggatcaatacattactgataggaaaagctcccaagggcatatcgagtggaaaatgcaagtcacaaaaacacatatatttaatatcctgttttggtgtaaaaaattctaacacccctcaaagaaacctatacattttaaagtgcacatatgtttatatgtaaatatatggaaagaatacaaaggaaacactccaaatgggtaatagtagttatctcagaggtagtaaatgaaaactgggaagaatccagggaatttttatcttgtgttgtttcaacttcttatgatgggaatatgaacatatttactaaaaaaaaacttcctttgaaggaaaagtaaaaattatttaaaaaattattttaataagaacaaagtcggtgagagatggccttggaaacaaactgtacttacatggtgtagccaatgacaggctccttggattgcaggccaggagagtttcaggttcagcacatagattttacgctgcttttccagtacaatgagaggaagtttcaaaatagattgtaaaaaaaaaaaaagtgtggataattctaaaagggtcacagctcaggccccatgatgtaagtctctctgggaagggtggcgttggccatcacgctgtgtaaacagggatcccgggggccagcatcgcactgctctccatccccagcgaaaggaagggaggcagacactgggcagcggcactcggagtccacccagtcctgggaaggaacggcggctccagggagaggagcctcatgggcctgcggcagagctggggacctggggctttgtgccacctgcaccaggtgacctttcctagtccctgcagcgtttgcccatgggtttcatcctgaccacggccaccgagtgcgctctctggggaatggtatcgcagtgaggacagcttcaggcctgtggaggggctgggaagcagtggacagaagcccccaccgtcctggaatagggcaggggctccctgagaagctgggatcactaggacagatggcttgggggccatggaggtagaggatccctgagcaaaggggcagagaccagtgtggccccttcactgttggctcgtgttctatggggtttccaggaaagtgagactgttcagggcaaggtggccgccacatccctgcagaaccggaagtgtcttaagagttggaatcggtggcggtgtattgattcgttttgctgctgcttcagttttatagaaatggcttaataacacagttgtctgcaacttgtttttaatcacttcatgttatttcagtggtttatccatgatgttattggtagtcacagtctgttcattttaacactgtataatccattgtgtgaatctactgctacatacacagagccactaaagaattactcataacgcactagtgagcattcttgtacctgtctccaggtaggcttgccagacttttaaatcttttgctaatctgggagctgtaaagtggtgtctcatgtggctttgatttgcattcccttgcttataaggctctgcgtttcctctctgttgaggcgcctactcaaaccttttggtccctctctcctcttgggctgtcttttcctcatggactgcgggaatgatagacgctggctgttagtccctggctggttgtgcacttcgcacgtgtccctgccccgggcatgactcctgttttcactcttctagccagatgtataatcttttctcctatggtttacactttgtgtcttttatatatgtatatttttgagatggagtctcactttgtcacccaggctggagtgcagtggtgcgatctcggctcactgcaacctccgcctccctgggttcaagcgattctgctgcctcagcctcccgagtagctgggattacgggcacatgccaccacacctggctaatttttatatttttagtagagacagggtttcaccatgttggtcaggctggtctcaaactctttttttttttttttttgagacggagtctcaccgtctcccaggctggagtgcagtggcgcgatctcggctcactgcaggctccgtcccccagggttcacgccattctcctgcctcagcctcccgcgtagctgggattacaggcgcctgccaccttgcccggctaattttttgtatttttagtagagacggggtttcaccgtgttacccaggatggtctcgatctcctgacctcgtgatccacccgcctcggcctcccaaagtgctgggattacaggcgtgagctaccgtgcccggcctggtctcaaactcttgacctcaagtgatcctctcccgccttggcctcccaaagtgccgggattacaggcgtgagccactgcacccggtctgtgtcttatttaatacatttattactacttgaggtcaaaacagattttctccctttttccccttaaagtttcttggagttaatgtttatgaaaagaatcaggtgagacgaaagttaacttttttctctgtgggtaaccagtggttctagcactaatctcgtccttccacgtggatcagcagtgctccctctgtcatggatcatgtgttcatgtgcgtgtgggtctgtttcttagttctgtgttccttcctagtcagtatccccacctatactttaaaaaattactatagctttataatacgtctttctgtcttctagggcaggttttcttgtctgtgcttgggcctcgctgttttatgtagattctacaaccagtttacaaattccccgaaatgctattgatattttgtgttttaatctgtagctcagtttgagggaattgatatctttaggagatcaagccttcctatccatgaaaatagtatctctcttctctctcattttggcttatttcagtaaaactttgtaatttccttcataaacatctttaattaaatttattctctagctagatttatttcttggtaccttataattttatttgccattataaatggtaccttttaaaaattgtaaatgcttcaacctgaggaagctggttgaaaaaggaattaaaatagaataaattatgcatgccagctcttatgatatgtggaagtataattgactagttgctttttatatctagctaccctattaaggttaagagagttcacttcgttactacttgttaatatttgttttcatgaataggtgttaaattttagctgttttctttgttattttgcattcattgagatcatgtttctgccttttgatgctaacatggcaaattacaatgattgattttcaaataatagaccatacttgcattcctgagataaacctaacttatgatcattttttatacactgatgtatttggtttgctactatttttgtataattttaaagtctgtgtttgagtgagactatctcgtactttcccttctcattatctttgtcgagttttggtatcaagattactgtagtctcacaaaacaaaaaattaatggtagaacttttctattcctcttccttctcttttccctccctttcttctccttttcctcgtatattgaatcttatattttatttttatcctccctccagaggatttcaataactttttatttaaaaattttaaaattagggataaagcctgttttgtctattattaatctggtgaaagcagccttttctgagtcagcactcgtctttttatttaaacttttccatttctgttttcgaattgttactataagtggcagattgttctgacagctcaagaagaagatcaggcagatgcgggtcactgatgtgttgggtgactggcacattgagtcttggctctgggatattactgcattcttcctgtgaatccactttttctaggttctccctccctgctttcttgccttatgttttgttttgttttgatttcaagcctggttggtttatttccttagtccacacccacctcctttaccggtgaagaaattatgtgctttgtttctgtcgttaaaggttctagtcctagtcaattgcttgggacatcataggccctaagatattttggaataatttaaattaatatctctacttaaatgtcttttcatgtgtaatattcatctttttctttcttgaataggacacccagtctttgtgcacatttttctccttcctttcacaaaacgtgctttgctatgacccagaaacctttctttggttccttacacgttactctgtaaccattgctgtaagtttgtctagttttatgtttgaaatggaattttgttgattctaaaatagttttgcttttgggcttggaattcttcctgccgcacagagttttgtaacagatttaaccaggtgtgccggttactcagcttactgccctcagccctaagcccaccctctatgacaccgacagggtctccgcatcaccttcctgctcacagctgcatccctgtcaggctctgtccccaggggcgctccccggagctggcaaggcaggagtgtcaccatagcaacgtttcaccctcacaggggcagttccttcccctctcagtttgcagtttgcccagctcattgcgccaaccttctggcccctcagaaacaatggatgggctgggtgccatggctcacacctgtaatccgagcatattgggaggccaggaattggaggttacagtgaactatgatcgtacccctgcgctccagcctgggagatagaatgagactcccaactctaaaaattcgaaaaaaactgggccgggcgtggtggctcatacctgtaatcccagcactttgggaggccaaggcaggccgatcatttgaggtcaggagttcgagaccagcctggccaacatagtgaaaccccgtctctactaaaaatacaaaaaaattatccgggcatggtggtgcgtgcctgtagtccccgctacttgggagactgaggcaggagaattgcttgaatctgggaggtggaggttgcagtgagcccagatcgcaccactggactccagcctgggtgacagagtgaaacgctgtctcaacaaacaagcaagcaaacaaacaaacaaacaaaacccaagggctggagccccatgtcctgtccctcggtggtctgggccccagctccaccggctgttttcctgtgagctgccaagttggagtaattccttctgcttccctgcattttcccagccctggggtggcagcggcttcccgaggttgctactccatggcatctcagagtccctctgcctttccatccctcaataccaagctaccccttctctacatagtactctctgttagaactacgggtggtttctgtctcctgagtgaaccctgaagaatatagcaggagatgcgaagatgtgagctagaaatctgactcctcgtaagtctctatattgcctctttttggaaataccttcggatgatctggtctctcttttaagctacatactctcttgtgtacagtctatttgttcagtaagtattcattgagtacttggtatgcaccaagcactgtgggaggggtgggggtgtagtcgtgaccaggacatggtccttgccccactggggcttagggactagtgtttatttagaccgaattggttaggaatttttagttctagcagtgtgggtaacgaaagaaaaaaatacataaattgcattacatcaaatgtaaaaactctacacattaaaaaacgcaacccacagaatgaaggcaacccacagaatgggagaaaacatttgcaagccatgtatctgatatgcagttaatatgcagagtctatagagaactcctataactcagcaacaggaacaaacaacccagttaaaaaatgggcaaaagtccagtgtgaattctgtgaagtagaaaagaaaataaagagaaattaaaataaaaaaaaatgggcaaagatccagtgtgaaactgtgaagtagaaaaaaaaatgaagaaaaagaaaaattaaaaaatgagcaaaggacttgaatagacgtttctccaaagaagatacacaagtagtcaatgggcacgtggaaagatgcccaacatcatcaattattaggccagcgccaactaaacacacagtgagtcagcaccttacactccttgggatggctactataaaacaactgccaccaccatcacaagagagaaaaatgacccgtgttgggcaggatgcggaggagttggagtcctggcgcactgctgggaatgccaagtgccgcacccaccatgggaaacagtgtggtggctcctcaaaaaaccaacagtacaatgaccacatggcccacagtcctacttctacgtatatacccaaagaattgaaatcaaggtcttgaggagatgctctttatacacatgttcatagcagtattatttgcaatagctgaaaggcagaagccacccagatgtccatcatcaggtgacggataaacacagtgtggtccatccataccgcggaatattattcagccttgaagaggaaggctacaacatggatgacccttgaggacaccatgctcagcaaaatcagccagtcacagaaggacacacactatctaattccacttatgtgggattcctagagcagtcaaattcataaagacagaaagcgggagagggggcctgggggaggggaatggagagtgcgtgttaaatgggggcagagcttcgttctgggaagatgaaaaattctggaggacggtggtgatgcttgcataacagtacgaacacacctaatgctactgagccagctaacttggtaaattttgtgttatctggattttaaaatcagattgaataaatattttgaaagtttaataaaaaacggcagtgcagtagtacagcaggagctgggtgttgtctcaggtcagccacgagctgtgtgaccttgcacggacttgcttccctgacttcccagttctcatctgtggattgaggcgttggaatggttcttacgccaaaatgattcttcgctccgaactgatggtcgcatgggatgattcactgttttgttttagacagagttttgctcttgttgctcaggctggagtgcagtggtgtgaactcagctcacggcaacctctgcctcccaggttcaagcgattctcctgcctcagccttctgagtagctgggattacaggcatgtgccaccatgcctggctaattttgtatttttagtagagacagggtttctccatgttggtcaggctggtctcaaactcccaacctcaggtggtccacccgcctcggcctcccaaagagttgggattacaggcgtgagccactgtgcccagcaattcattgttggcactgagagtggccaagaaatttggtacctgagcaggggttaaggttctacccttcccctcccctcatttctagcggttttactttggagggaacccgatgcttttctgggcctgtgtgtggtagtaatgccggttgaccggccgtcccttgggaccctgtagccaggcaggttgattggcctgaggcccttggttctccctgaagccggctggctcaggctggctcactgcatcctggatgcctgggggccagggtgaccggcctctgtggttggcgggcgggcggtgtctgctccactcagtgcccttgagtgctgggtgtggtggccgaaggctgggaggtggagatggtgccctgggggccacctgtcttctcagacagtcgtgaggagtcttctcaacttaaaagctggagtttgaaccaagtggtcttttaggccatttttattgttgttttccctgtttagtactctttggggaagagtcaagattatgtcacaccagcaggggtgctaaatcggcggtgatgatctgaatttattaatttacaaaactttgtcaatttgagaaacacgagtaaacgctggtctctccctgctgtggaagttgtcacatctgttactggccctcgttccatgagttgatttagtgctttgcaagaattgttttctgtctgcttgttagacttttcctttctcctttacatctccaaagtgcacagtgcatccacgtgtgggcaggcgtcagacatcctttcttttgcctgtgctgggaacaagttgcaaggctgactgtggaagggccgctcacctggggcgtggtcagggctgccaggtgtggtggctcacacctgtaatctcagcactttgggatgctgaggtaagtgattgcttgagcccaggagtttcagctcagcctgggcaacatagcaagacccagtctctacaaaaaatacaaacattagccgggcctgttggcacatgcctgtggtcccagctactcaggaggctgaggtgggaggatcacttgagcctgggaggtcgcggctgctgtgagccatgatcatacctctccctccggcctgggcgacagagtgagatcctgtctcaaaagaaaaaaaaaattaaactctcttatcactgtccatctaaataacagagagaggctctctgaaagaaatgatgtttatctgggagcagggcattggagtaggcagatacttgccatggtctacagtgcatagctggggaggccaaagaagacaaaggcttttaaaggaaaaatgaggatcacatgattgttttgagataattatccttgccacaaggatcagcaccaaggatgataccaggctggaggtgggcgggcggttgctgggcagatgtcctcacagtgtgttttgagtgaggctgtgatggcctgtgtgcatggctgtgatttgcacatctttgtgatggatttgtttttcgcaggcacactaatgtgtgagccctcccttcatggccctccccagctctgtttgttagggtttttaacacaagtgattcattttgattctgacagccttaatctcacaaagccatgggttcattccccacccttctcaagagcagaaaatacagaatagcaaatctataatgagaacaaagtcactcattgctttagcagtggactgaacatttcccgttattgctgttgccgcaacacacgtctgcatgccgtacaggtgccctgcgctccccattgttgggcagtcagtcccccgtgttgtggcctccgtgtcgtgtgtctcatgagcactgcccagcgccttctcaggcctcccctctgccggggccgcacacctgccaggagccgggcgctgtgctgggcagcaagttttcagacagcatcagacgaagcgaagggcgctgctgctgtcgtcccatggcagtcccctgggggagattcctcatggctgacagcggtgtcactggtgggaaggaaaagacccaaagactgggagagaggacgctggggagtcttaacttagacgggggcttaaaggtctcttacaagaggggttgtttgggttgaggggtcaggggagggaagaacatgcacaaaggccatgaggcgggcgcccggggtgtggacccagagcgtggacacggacgccagcctaagcaggagggagcgggggtggcaatttatcagtcaccacagaagagcacgctggcaggacactcaaggtgcctgccatcaggagcagagacaccaggaagccacatctgtgtcctaatgggaccacaggttccctccaaagagtgtcttacaggctgatttacagaaggcaggagctggcgggagcctgagctgagccccatgggagcagcaggcaggtgcaggcaggtgcaggccggtgcaggccggtgcaggccagtgcagtccgttctccagcctcggaggcacggcgtgcacgggggcctgctccttagtttgaaaacaagcagttgtgccactagtgccttggagtgagctggcaactgtggcgcctcagcttggagtgtgcttgacacctgtgttggccggtccatctggcacctggccgctgtgcttctaggcctctgcctgccggctgccctctgctgggcatcgccactttcaggatgacagccttagagccttctctcggcctggtgggggcccagtggtggcgtccctccccgagcatcctctcgtgttcccggcagccacagcccctgggtgctggacctctcacctgccaagaggatagtgacacccctctgcccgtctttaggggctgtgggcggaggggagggtggagagatgggggtgtgggcagggacaagggtcgagagatgggggtgtgtgcggtggggaggggacaagggtggagagatgggggtatggggggaggggacaagggtagagagatggggtatggggggagggagggtggagagatgggggtatgggggaggaggggacaagggtggagagatgggggtacggggggagggagggtggagagatggtgtgggcggaggggagggtggagagatgggggtatgtggggaggggacaagggtgtagagatgggggtgcggggggagggagggtggagagatgggggtatggcggggaggggacaagggtggagagatgggggtgtggggggagggagggtggagagatgggggtgtgggcggaggggagggtggagagatgagggtgtggggaggggacaagggtggagagatggtgtggggggagggagggtggagagatgggggtgtggggggagggcagggtgcacagttgggggtgtgggggcagggcagggtgcacacatgggggtgtgggcggaggggagggtggagagatgggggtgtggggagggagggtggagagatgggggtgtgggcggaggggagggtggagagatgagggtgtggggaggggacaagggtggagagatggtgtggggggagggagggtggagagatgggggtgtggacagaagggagggtggaggatggaggtgtgggcggagggtaggggctgcagaggccccggggtgtggggtggtgtggggctggcccgtgacaatgggtggggtaggaaggacttttcagttgaggaggagcagcgcagtgcagggagacccaggcgggaatgggtctgaggacatgatggggtgtgtcagcgtggtggtcaaggagaggggagaggcgggagggtggcctgctccatctgcttccagaaaggtgcaggcatgctgtaggtttccctagggactctcaaggaattgtggcaaggttttctacaagactcttatgcaggtggagagacaaaagtagctgcagagcctcaaaatcttgacataaacaggttcccttccttcaagcctgaaattggtcacttaggattccaagtcctcaggaaagcagagctcccaactgtgatgctttttgtttttaagaggtggcgactgatttgctggagccagcttctcatctggggaagtgtctagcataatgatgggcacaacatagatgtttgtcgaattgaattaattctggtcatttcctggaggaggagagacaggatgttttaatagccagttatttcctgcgccggagttggttgggtcttcagacaccagctgaatgcttagggattctttcatttcctaaagtgcttacaaaattatgaaaaagcacgactttgctgaaaacctgccttcatctttactaatcatcatactagtcatctttactctcagtgtactgtgtccactttccaagcacccttgcacgtgatttcatttgatctgggtaacagccttgtgggtgggctgccgtcatcctgttctgtgtttacagaggtggaggctttgtcagaggcacacagttggcagagcaaatacttgacgatcctgggatgactgtttttttttcaattttgcatgtttttcttgtataaaatatacctaagatttaccctgggatgacttttaaatctctctttttaaaaagtctttgttccacagtattccttgattttctgctatgccatgcattggacaagactaaacatctctttgcaaaagaataacctgatgccttttttcttcgtgtttagggctcaaaatttgggcggggaactggactcactcagccttctcaacgcacgtctgctcggagatcatttgggagatccaagagattcagtatcactcgctcccttgatgatcttgaggtaatttaattttcatttttcttcttttctccttcaagttttaaaaaatgcaagtccaccttgcagatacgtctggctgttttttgagtccctgtggtcccctcccctcctcctctgtagtggtaacccctgttttctgggggacagcgtcccatgcacatttgggaacctttctaccctgcaatgtgtctgagctgtcacagggctttctggggtgctcttctgtgtgccagactccagtgaacacttctagaaatgagctggtttaatccccacaaatactctacgaggtagggcctgtcattgcccccttaaagacggggcgtgatccacagacatgggtaagtgtcattttgtgtggctcgtctatctgtgtttcttttgtaaagaacaatgaaaagattttattttttatagcagttttaggtttacagaaagtacagagagttcccttatgcccccacccacttgttaaaaatgcgccgtcgggatcattacgtcctgcattggtgtgggtgtttgttacagttgacaggccagtgtagacatatgattattagcttaggtccgcagctcacacgagggttcctgcccgtgctgtcctctctgtgggtttggacaaatgtccgtgccgtgcacccaccgctgtgtatcaccgagaaagccgccgccctggaaatcctctatgccccacctgtttaccctgcaccctcccgttgaactctgacaaccactgatcctttgactgtctcatttggcatgttttaaaattttatacaggtgcagctgtattctatgtcttcttattaatgtcttattctagaacatgtgtcatgttttcaagatttactcctggactttcagtccagtccttttacttgttgtatggcattctgctatgagtatatgacgatgattgatgccttccgctatcgatagacactcagtgggagtgggagagagtctgcccttacggcattcttgtacatgtctccttcagcgcgtgtgggacgggcgagagtgttcttagctgggaaggatctgcatgagcggtgtggccagactccgtccacagtgactgctccagctcctgctcttccaggagaaaaggtggcttcagggatggcaggggtcctggggattggcacgttgtggctgcaaataggaatctgcccttggatggcctgtttagctttggtctctccggggaactcgagggcaggtcagggctagcgtgctgtatctgggcgggcagcaatcagaatcggctgcaatggggtgctcatgctgctgatgaagactcaaaaggggtgtgtgctacctaaggcagggcctagcttgaggctgaggaccccgggaccatttttggctcatactgccatgctgagctgaccatctgtgcacaagtcctgttcattttcctccttttctgttggtcatgaggaactcactgtgtggccctaggtttgggctgacagagctgtgctggtgccctggtgaatgatatgtgggtctgggccacgtgctctgcacaacctgccccttccctgctgggtgtaaacttctatctcatggtggattgctgctgggtgtgccccatgccagggtcagtgccatgctcctgatagacagctccagcgtctaatcactgggtgtccccagtggatgctccatctccaccagggccctgctgctttccacatggcttgtggtccctgctgtctttgccccacaccttaaacttcctggctgtaaatctcttactggggccaaggaggatggcccaggtggcagggctgcctgtccttttctgtgtgggccctgctcgctgctggccgccttccatgactccttggagagggatctgagcagccttcccaagtgaggggtggtttgcctcttgagcccatcgtcctgaataacacggaggaaggctctctgtaagaaaacgatatttattaatatttgggaataggcattgcaatgagaatatgcatgctgtagtaaactatgaatattcagggaggtcaagaaagacagcagtttttcaaggaaaaatgaggaggatcacaggattgttttgagataattatcttacaaggatgggaccagtccaaggttggacaggcagttgcgggacagatgtcctcagaggaatatttttgtatgtgaggctgagatggcctgtgtgcaaggttgtggttttgcagtcttttgtgatggatttgttatcaggtctatgagcatgagaaccctcccttcctggccttctctggctctgtaacactttgttagggtttttaatacaagtgactccattttctttctgacaactttcacatttcccccttttaattgagatctttctccaaaagcatagctgaccagtcatcctgcagtcaggctttgattgccccttggtgctgggatggagctgtcccagtttggtgtggtctggttccacatcatcaggaagtgactggtgaccaggagtcagtgtcagagctcatttagccacatttgagcaaccagggaggtgtggagggagtggccctcaggcgcagtctacctgagtccactgttaagtacggttttgtctgttccatgggtgttggcatcatctcaacgcgctgggccagcacgattctgttaggagttgtacttctgcagagacttaagcaacagataaaaaatttataaagggaaaatgcagagtgaaattaataataatatgacaatcctagtttgcataatgttttgagtcatgaacataggcttaaagacaaccagttgaataaatcaaatgaccatagggaattgggtgagactttttataatatatggcctgtttccttttttggtgtgtgtgtactttttcctttttgtggagaatggggtttctcatgttgcccgggcagatcttgaattcctgggctcaatctgtcttcccgcctctgctgagattacaggcatgagccaccatgccccgacctgttttcttattttgggtatatggtccttaattttcccagaagaatttatccaggtatagcaggtagtatcagcaatagcacagacatttccttctttacgcaatggataatttagagcaattttatcatctagtgtcccatgactgagttggattaaagcagagtgagcaccagttgtattagggatgttcccaaagtcacccactagggggactcaaggatctcttagggttctatctagttcccagcagaagctactgattgtgaaatttcgattacaccattattctgccgagtcaaaaaggtaggcattaagaggggtaaatgtgtctttataatatggactcttattccagtgccttggagaagctgcccacagcatgaagctgtcggcttctagtcctgtcttgtggtctaagtgtctctggttgtggcatcagtggtttggtgaactcttggtgtggcccacgcatcaggaatgggattttgtcccttaacatttagtttcagcttatagggcttcaggaatagagtagttctctgcttttagtgattctatgggagaaagttggatgggaggaagctggaagaattgaggagcttggaaacagtgcacagggctccagtctaataacaggagtattgcagcttttcttcagaaacatggctgcttctctctacattgatcacacaagaaaaaaatcactccgattttaacaacctcctgaggctgggaagccaaaccaaggcagactatagattttgcctacagtcttaaggtttctgggcctgatacgaagtgacagtttttacttacccgctgtaagtctaggaacccttgaagcagggtattctatgcacgttctcaaatttgagattccagacaaggcattgggaacagaaccactggtctcagttgtatcctgctacaaagagggaacagatttttttttttttgtaaataaccacattgccataagaatacatgtgaacagtttccaaattttggagggatcgagtagggagaaaaagcaaatgtttttacttttgttttcacagaagtatactttaccagattgctgtaagttataaacagtttaagaaagataacgttctggccaggcacggtggctcacgcctataatcccagcactttgggaggctgaggtgggcggatcacaaggtcaggagatcgagaccatcctggctaacgtggtgagaccccgtctctactaaaaatacaaaaaattagccgggcgtggtggtgggcgcctgtattctcagctactcgggagggtgaggccggagaatggcgtgaacctgggaggcggagtttgcagtgagcccagatcccgccactgcactccagcctaggcaacagagtgagactctgtctcaaaaaaagaaagaaagaaaacatccttagatctggaaaacaaaacatttaagtaaagaaccaacaatgtttcaaataaaagtcataaaaacatctcatcagttatttaatctcatgtaattaatttttgttctgcttgatcttgataagtagtttcacaaattcatctgtttccttattagagttctgaagaattttcagttagtctgtcgatcttaaagttattagaaacctgtatttaagagtgcttcttagagtcttttccatgaatctgattgcaaatgcttttagagaaaaatcaaaacaataacaatggataaggaaaacagaatagctatggtttaaaatctggtggaagttcattataattagcaattgacaaggaaatctggctatttctgtagcatacaacataataactagagttatggcatattaggtttctgagagttttatacaattttggaacattcctataaaaacacacccataaatgtaactgaaagaaggtctagcatcacgtatcattttacagtgttttttatacaatttaccagataagcctaatcatttaccagacgtaccagataagtctttgtaagatgagagatacgtcctttgaggctctccagaagcttgactggaaaatactaaagctaattatgggtcaaaaagatttaatttagaatttatatcttggggaagcccatcaaagatgccaaaagatttaaaacgcctgatcaaaacaggagcacaggtcactattagataatagtcattcatttaaccagaatgagaaagacttcagaagcaacacagggagttccatgaatgtaaacaaacaacccactcaaagctcagttttcctacaaaataaaaaacttaataaagacaacacaggaaattatcttgataaaacataaaatctttgtttcgtaggccagttaccaaaaaggtaaagaaaaacctcctgtggtgtgattgcttctcctcatgggaagcccgtttggtttgcctggaagtagaagctgatgaaaagtacttgaatttaatgagacataggaagagggtgtccagtattacgagtgcgcaccgtattatagaggaatgtcaatgtgacagttagtggcttgagcagggcagtacagggctctaagtcacagtatgggaagttttctggttccatggaacaattcagacacatccagaaaagccgaatgtacagaatcgagttatacaggcggaaaacagtgcatcagaccatagtaacacagttaaaactggagaaaaaagttccaggagctgacaaaaaagttgaaggaaagagtccttgccctagccaagcaagcagctgcagcttctcaaggggagagagtggaaggcagtgatatgcggccagcaggtcacacgcagcaaggccaagcccaagccgaggctgtcagattcacctggagaggaagaccctgcctggagaaatgaaattgccattctaaatgaagacagcatttctaacctcatacgagggaaattagatggagactaaaatagaaaaaagctgcagttcagaagcttgttttataaacatacttcagaattaaaaatcaaaacgtcctgcagttttactaatagccgatcaatacttcaggaaaaccctgttgttctaacataagcgaccacgttttttgctttgtattagtgtatttttaatattaaagtttggtctttagaaggacttacacataattttcttctaattataaccaacttaatcatataaaatttatttcgtaaatttatctttcacagacttttatgaccaatataggccttcgatgacatccttaagcctttctgctttgttctgtacttcctctttcttaaaacaacaggcattttactttaggacaaaaatttaccacacaggagtctttgtcatacaaaattattcatttttgtttttaaccttccttactaagatacatctacatacctataactttcttcacatctctcgctctcctacttagtggtttctttctctttgctttctaaatccatattttgaaacaaattttaaataatctccaaactagacaaaattactctttttttcaataaagaacacatttttattcctctcataatttttctcatcagaaacataccttacttttcgtatactttgtatactgaaatatatatatgtaagaactttaactcttagtaactgtaatttttagtgaaaaccttggaatcagtattttatagatgagaaccattttataatttttggaaacatgttttcccgttacataattactttgtgtattaacaggcaaaaatatatttagtccttctctaaaatttaataagccaagaacaaacttacatttgtgttcagcaatgtatgttttagtactttatcttatatggaaatgacttagacattttatgagtatcatttaatttaacatagcataactttaagatttcagattacatgacagtctataagcactttcccatctacgtttacgtactttatttatttttaataattatacctaggttacttatgaaaactgagatatagaaaaagctagtcttcatttcaagttatttcccttttcaccatttgtatagcctatgagtatcaggttttcacctgagaaacttaaatataggggtattttgctgataacacagaagatacagcaattttgattaaactaacagtgttagtcttagtcattaaaaagttatacaaataaagataattgtgtctttagtctggatttatacttttataaccttaagacatctagtagagataaatataatcctctctgaccagtaaagctgggcaaaaatgtatgctgacagttttgaagacacttctatttttattttatcaacaaatttaaaaccaacttatttatccaagatttacttaagtcagctgggtgtggtggctcatgcctataatcccagcactttgggaggctgaggcaagaggattgcttgagcccaggagtttgagaccagcctgggcaacatggcaagatcccatctctacaaaaaataaaaaaattaggcaggtatgatggtacacacctgtagtcccagctactcaagaggctgaggtggaaggatcactggagcccaggaggttgaagccacagtgagccatgtttgtcccactgcaccccagcctgggtgacagagaaataacctatctcaaaaaaacaaaaaacaaaaaaaacaaaaaagatttatttaagtcacacgaactaaaaagcatttgggttaattactatatattttacatgagtgcttgtttaagccaatccaaatagaatttcttaagggatttctggctaactatgtcagattttatcatgtagatgtaacatacaatatgtataaacatacataaaagcaaatacagacacaaataaagatcttatggctttcattttagaattttggtcatgaaacagaaaaacatagtaatacaaattcactggtttataaaatatagttggatcaaattatatttttgacaaaacggaacttttatctgtggctaagttctgtttaccctgataagtaattaatgaaggctgtggaccagaattatggataaagcagttttcatagcagtttgacttttaaaaaccttttaatccttttttcagattcaattgaatttagggttgaatattcaaatgtttacattttagctaggcctggctaaattgtattaaaaaaaaacaacaaaattttcaggttgccttgaattagtaacaaatctttttgtttgtttgctttttctggctcttaagtgtcagacaaaataatttttatgtcagacagagataccttttagtattgctctgagcttaaggttttaacctgtttgatctgacagcccttagcttatataaacatttataaagttttttttttagaatatcgatttttcaattagctttttcatcaccctaagcaattgttagacaaacctaaatttacatttccaaaaggtgtctgcatcgttggttgccatagatttggcataatttataaagccattagtttgaaagccctttaacacttaaaagaaaatcttagtttccataagcaatgagtttatcttaatgctggcagaaaagtcatcagattcaaagttggcagaaaaaagagatggagagttaaccctgtagttagttgcagtttttgacaagcttagacagaaaatggctgtccagtgctgcgtttttcctgatgtagtttgcccatcaccacacgagaacggaccacagtatagctggccagagtcctagaagacttggtgtgcctcaatgtttaagaatcccatttcatttcttattaatctctcaagagcaaagaaaatcctataattcctgtcagggagtttagactggtgccttatgtggtgctgactgcccttgttaattggccatcccatacccattatttagaatctttatttttgctctcagatcatggccagaatcaagcaagggaaaaaagagccaaatcatatacagatgtgtgtaagcaaatcaaaataaaacaaaaaataagtgtgttcacagaaattttaagccaggcatgcagtccaaacaaaacattaaaccgggtgtgcagaaccagacagaatataaattctgtagtaaccagagggacattgtccttataccagaaggggcttgccagaagagacaaaaggtcttttatcatccgagacagatgcaaggtcctttattaaggtcctttattaactcagatcccaaatgaagtaaaaaagagcttctaacaaaaaatgggaggcttggtttgagaggagactttcaagggcagaagaggcgagtcatggaagcagagagctcaaagggctcagttgagtgcctcataccagttctaagaattgatgattctttccacaggtgatccttctccacatcccacttctgacaccatttatgtcatcctaaataacaaatagggagggagactctccaaaagaaaatggtatttattcaggaataggcattgcgatgggatacacattatggtaaactatgtgcatattcagggaagtagtggaagataaaggtttctaatggaaaaatgaatatgattacataatcgttttgagataatttttcttggctacaaggatcaataacaagggtggcatgattctgaggctggacaggcagttgctaggcagatgtcctcgcagaagtaatttgcgtatgtgtgtaaggttgtttggcctttgtgcaaggttgtagttttccagtcttttgtaataagtcttgttatcaggcatttgaaccctgccttcccaaccttccctagctctgttgatcagggtttttaacatagtgactccgttttgaacctgacaactttcacaaacccaaagaggcctaccagccattggcttctgtctgacagacaagagttgtgagttaaaataatttgtccctttctttggaagggatgtttgactcctaaaactttgccgatggggcaggccactgagtctctctaggttctgtctcgcaccctccagagtgcgtgtggtgtgccaaggcctccggcgtactttccgcttcttgctcatctgctccagttagcctgatgttaaaggtataatgagccactgtgatgttctgagttgaaccagatcatacaggccctctgggactactttgctggagggtgggagggttaacgaggcctggggcaggactacaaacgtacactactgcctagcctatgtgagagtgaactgagtttcatctttctgataggaatggaaaagaaggcattcctagatcagtgtgtgcacactgcgtcctggggggatgttactgtactctagcaaaggtaccacatctggcacagcagctgtgaatggcgctgcttcttagttaagtttgtggtagctcactgtcatcaccgtgatccatctgaactttgtaggaccggactggtatgagttaacttgggtatgacagggactaccactttcaccttttttgaagtcttcgaggatggtaccagtctgggctgtttcttccctgatgtggcattgtttttcactaaccgtcttggtttgagttgggggaaggagactgtgccacgggcttctccttgacttttccagcttagtagctcttacctagtgagtgaaggaaccaatgtgagggttctgccagtcatttcatgtatatatttgggaactagggaaatgaccatgggtggatctgtggatctgttgtgagctagactggggccaggactcccttcataacctggcttccatacgccccctctttatagggagaacgtggtagtgctttgggtccacagatagtgtccattcataccctaagttcaacaaaaccagaaagctctgggcactcccctttccttaacacactacttcccaagcaagtggccaacagccctatggagaaagactggggaaatgactattgatgacacatgccttggtgttacagggacctgcctaattctgttctggcgttcctttaattagtggcttccaggtttgagaaatggctcacatttttcaaattggacaaaggatcatgactttatgggggttgctgccctaggccttgattctttaaaactgtgtaaattaagcaatacccttgctggctgcccagccagcttgccccaggaacaccttgttttcctcccgcaacatgggaagcctggtggagctgagaattccacttattggaggctctgctcacctttacaagtcctgagtggggctctgccatgtctgccttctggctgtaggggattagggctttattagattctgccaggtacacacctgcctttcacattttgtctttagttggtacttaatcatactgggtgtgttgatgactctctctcccaaatggactttcatgtgatgccacactcagtaagtgcattcttcctaagcccttggaacattaacaaaagctgatgaacctgggcattacatgtgctggaccgtaaagcaagtctcaaaaatattcaagcctgtcctgcagaaactgtttcctgccacagtgcaggtacactgtaaaccaacagcaaaatgtgtttgctaagtaagcagtccattgcaaaataatccagagttcacagacgcaatcacaatgggagctagaaagcgttttgaaacaaacatcaatgagaatactacatatctaaacttgtgggatatagctgaaactgcacgtaaaggagagttcacagctttcagtgtatacattagaaggaaaatagaatgtcatctcaagaagttagacaaaaagttgtagaacagaattacaggacgtcaaagctaggcaataataaaaggtaaaagcatcaaataatgaaacagaaaaatgacaaactaacaaaaaataaagaaagattatttcccaactcattttatgaggctaccatataaccttggtatcaaaaatctgacaaaggacataagaaagggaaatcataggccaagcttgctaataaacatagatgtgagaatcctaaacaaaacattagcaaggtgattccagcaatttataaaaagggtaacatacacatttgtttcaaggacacactattttttaacatttgaaaatgaatcaatttaacttactattttaacagaatacataaaaaaagtattatctcaacagaagcaggaaaggcatttggtgaaattcggtatccatttatggtaaaacaaagttaaaagaattaaagggaaattccttaatctgataaggatatctaaacactgtgtggcatcataattaagctttccctttgccatcaggaacaagagaaagatttcaatttaaatcgttaccggaagtcctggttagtgtactaagaaagtaaaaacaaaagtttaaaaagcttgcaaagaagaagtgaaaatgttactgttctcggatgatgtgattgttactgttctcagatgatgtgattgtaacagaagatccaaaagtcccgtggtggctcacgcctgtaatcccagcactctgggaggctgaagtgggcagatcatttgagttcaggagtttgagaccagcctggacaacatggctaaaacctgtctctacaaaaaatacaaaagttagccgggtatggtggtatgcgcccatagtcccagctgcttgtggggctgaggtgggaggattgcctgagcctgggaggtcaaggctgcagtaagctgcgtttgtgccgctgcattctaggctgggggacaaagtgagaccttgtctcaaaaaaaaaaaaaaaaaaaaaaggaaaaaagaagaaaaagaaattccaaagtatctgtagatcagttattaaaatgaattaattcaacaaggttgctagatatatggttaatatacaaaaatcaattgtatatacatttagaaaatgacctatagattcagtgcagttttaatcaaaatgccaagaggtttttgattaaagaagatgattctaaaatcttcatgcaaatataaagggcagagattatctttttcaatttttttttttttttttttttgagatagcttcttgctctgtcacccatgctggagtgcagtggtgtaatcttggctcactgcaacctctgcctcctgggctcaggcgatcctttggcctcagccccctcatatagctgggagtacaggagtgagccatcatgcccggataatttttgtattttttgtagagacagggtttcaccatcttgtccaggatggtctcaaactcctgagctcaagtgatccacctgccttggcctcccaaagtgctaggattacaggcatgagccaccatgcctggcctttcaatttattttaattgtggtaaaatacatacaacaaaatttattattttaaccatttttcaatatgcagttcagtgttattaaactctttcataatgtgcaaccatcaccaccatccatctctagaagttgtttcatcttgttaaactctataccccttaaacactaattccccattccccccacccccaacccctggcagccaccattctactttctatctctatgatttggactattctaggtatcactagaatagtattcactattctaagtgaaatcgtacagtatttgtctttttgtaactggcttatttcacttggcataatgttctggggtcatccatgttgtagcttgtgtcagaatgtccttcctttttaaggctgaatgatattctactgtatggatatactcacattttgcttatctgttcacctgttgatagacacttgtgttgcttccgtgttttagctattgtgaataacactgctatgaatatgggtgtataaatacctgttcgagttcctgcttcccattcttttgggcatatcccaaaagtggaatttctgtatcatacggtaatcctatttttaatttttgaggaaccaccgtactgttttccatagtggctgcaccactggatattcctaatgacagtgcacaaggtttccagcttctccttgacaacagcactttctgttttttgatagtagtcatcctagtgagtgtgaagtggtatctcatttttttgatttgtatttccctaatgtttagtgatgttgagcatcttttcatgtgctttttggctatttgcatattttctttggagaaatgtctactcaagtcctttgcccattttttaattggattgtttgtttttgttgttgagttatagaagttcctctgtatgtattccagatattaaccccatatcagatacgtgatttgcaaatgttttctcattctgtgggttgcctttttactctattgatattatctttggtgtacaaagttcttaaattttcatgaagtccaatttatctattttttcatttgttgcctgtgcctttgatatccaggaaatcattgccaaatccaatgtcttgaagaaaaccctgttttcttctaagttttatagtttcaggtgttatttatgtgtttgatccattttgaagtaatttttgtatatggtgttaggtaaaggtccatttttattcttttgcatgtggatatccttttcccggcaccatttattgaagagattatcctttccccattgaatggtcttggtacccttgtcaaaaatgatttgactatttatgtaaggttttatttctgggcttcctgttctattccattagtcttatgtgtatgtctttttgccagtgccacactgttttgattactgtagctttgaaatcaggaagtacaagtcctctagctttgttcttctttttcaagattgtttgggctatttagggtctcttgaaattccaagtgaattttaggatgggtttttctatttctgtaaaaaagtcattgggatttcaatagggattacactgaatctgcagattgctttggggagtattgacatcttaactatatcaagtctgtccatccatcaacatgggatatgttatatttacttatgtctttattcctttcagcaatgttttctagttttcattgtacaagtctttcacctccttggttcagttaattcctcagtattctttttatactattgttaatgtaattgtttttataatttccttttcagattattcactgttagtgtagaaatgcaacagatttttgtgtgttgactttgtgtcctcctgttggcagaattcatttgttagctctagtaggtttttttttggtggaatagtctacataaaatatcttaccatctgtgaacagagataattttacttgtttgtttccagtttgggggcctttcatttctttttttgcctaattgctctggctagaacttacagtactgtgttgaaaagaattgtcgaagtgggcattcatgccttgttcctgatcttagatgaaaagctttgtcattctccaatggagatgatgtttgttgttaatttttcactaatgccttttatatgttgaggtagtttccttctatttctggtttactgagtgtttttttttaagtcatgaaagggtactgaattttgtgaaatttttttgcatcagttaatgatgtgattttccctcttaattttgttaatggggtgtattacaatgattgatttttcatatgttgaattacccttgcattataggaataaattccacttggtgatggtgtataatccttttaatatgctgctgaattcagtttgctagtatttggttgaggatttttacatcaatattcatcatgaatattggtctctagttttcttgtattgtctttgtctggcttgatgtcagggtaatactgtcatagaagaggaagtattcctccttcccctcctccgcctcccccttctctccttcctcccccttctcctcctccttctcctcctctctgtccccccctcctcctccccttcctccccctccccttcttcctcctcctcccctcctccctctcctcctacaccctccccctccccttcttcctcctcctcccctccccctcttcctcctcctcccctcctccctcctcccctccccctccacctcttgctccacctcccctcctccctctcctactaaactccccctcttcctcctcctcccctcctccctcgcctctcctccccctcccatcccccctcctcctccctcctccccctcctccccctcctcctcctccccttctccccctcctcctccccttctccccctcttcctcctccccttcccctccacctcctcctctccctcaccctcctccctctcctctccctcctccccttctcttccccctccccctcctcccccttctttcctcctccccgttccccacctcctccttctccccctccccttcctcctccccctccccctcctcccccttctcctcccccttctcttcctcctccctctcccccttcttcttttagaaagagtttgagaaggattggtattagctcttcaaatgtttggtagaattcaccagtgaagccctcaggtccagggctttcctttatcaggagatttttctttattactgattcagtttgcttactagttataggtctattcagattttctagttcttttttcttttctttttttttttttttgaggcagtgtcttactcttttgcccaggctggagtgctgtgacacaatctcagctcattgcaaactccacctcctgggttcaagtgatcctcccacctcagccccctgagtagctgggagaacaggtgtgtgccaccatgcctggctaatttttgtatttttagtagagatagggtttcgccatgttggccaggctggtctcgaactcctgacctcaggtgatccgcccacctcagcctcccaaagtgctgggattacaggcatgagccaccgtgcctagccatacttttacattttttttgtagagctggagtttcaacatgttgcccatgttgtcttgaactcctgggctcaagtgatctgcctgccttggcctcccaaagtgctgggattacaggcttgagccactgcgcctggcgagattttctgtttctttatgatttggtcttggtaggttttgtgtttctaagaatttaaccatttcatctaggttatccaatgtattggtgtagagttgttcacagtactcctctataattcttgctatgtctgtggaattggtaataatgtcccttttatcatttctgattttagtaatttgagtcttctctttttttcccttagttcattgagcaaaggatttgtcaattttgttgatcctttcaaagaaccaactaggttttgttaatttttttcttgtttttctattttctatttcattgatctctgctctaatctttattatttcctttcttcttctagctttgggtttcgttttttgttttttgttttttccctagtttcttaagttgtaaaactaaattgttgatttgagatcttttaaattttttatgtaagcatttaaggctataaatttcccctttagtactactcttgctgtgttccatacgttttggtatgttgtattttcattttaatttgtctcagatattttctaattgtccttatgaagggcaaaagaaagttacagatatatcttcatgatattgaggaggcaaaagcttttaaaacagacacaaaaggcacttactgtaaaggcagactgatgattttgattaaatgaatattaggaacttgcactcatcaaaacataccgttcctagaaagaagggcgagaggacagtgcggctaacccacaaaggccgacggaccctgagaatgcagcacgtccatgagaatgacaaacggctcaaatgcacagtgggcaagggatttgagtagacattttactacaggtgctagccaaagtcacatatgagaaagtttccaggcaaattcctagagttccatcatgtgtaccaagagcatgtgcaagaattcaaaatagcagtattcataagatccctacacggaagcagcctgactgcccaccagtggtggaaaggacagatagcctgtgatttattcttgcagtgggatgctcggtggctgtagaagctaatggactatggctgtcttaataacatggataaacatcacagaaagatggcagatgcaagagaacgcacctgtgtcattccagttatagaaatctggaaacaggcaagactgttgaaaaccatggttttaggttacatgcttcactggtagcaccataaagaagagctggaacatggttctgcttttcattgtgaacggggtgagggctacgtgggcttcacttcatgataaaccaccgagccatgcttttctgttttgtactcttctgaatttgtgttatagttgatgacaaaaatggcagcttgattgtgagtacttttttcccgcccttttgaatggctggggcatcagcccggagcaggctgtgttagcgtctgggatgagggtttgaaagtgggcctgaaagcaagatggggcctgggacctgggcgcatgagcagaaatggcgaggggcaggctggcctgtgagccgggtgggatggaaaccgagggcatgaactggcgccaggtagcaggagcgagggaaggccctcagtggggagcacctggaggagctcccgaggcaagaggtggaggtcagaggatgacatagctgctctgggaattgcaggggcgagttttgtttgttctgcaagggaggcagtgacaggcctgttgaggaaggatgcagtcagaggggacgtctctgccttccaggtgttaagtcaggttcagacagagatggtctaaagtgttggcgaaatgtcttcgagctacaccaagggcctagaagacaggcccacgtgcatcagtgcctctcacaggacaggctcctggtagagctgtgttcttgggactgaggcttgcagggaacaatgcccccaacctgcctggggaagtcagtgttgggagccaggagccagcgtgtagcgctccccctcgtcaccctcacccacagcaggctgcggccccgagggggatggagggcggccgtccgctgtggatggagctgggctggtgcacttgggttttgttcacaggtttctccacgtgtgttccctgtctcaaagggcagcggcagtgaaggaggggtagggtgctggggaccgaggtgggggacatggggtgtgggtggggttccagaccctgcccaagccaggcaggactgggtctgcaggacctcctgcgagtgccaggttgaggggcacattttcccttagctgtcctgaccagtgtgtcgcctcatgtcatgaagagtgagagtgtgtgcgtgtgagggtgtgtgtgagggtgtcagtgtgtgaggatgtgtgtgaaggtatgtgagggtgtatctgtgagggtatgtgttgtgcaagggtgtgtgtgtgagggtgcgagggtgtgtgtgagggtgtgtgtatgtgagggtgtgtgtgagggtgccaggatcagtgtgtgtgagggtgtgttgtgagggtttgtgtgagggtgtgtgtgatgtgagggttggtgtgagggtgtgagggtgtgtgtgagggtgcgaggatgtcgtgagggggtgtgtgtgaatgtgagagtgagggtgtgtcagtgtgggactgaggctgagtgtgagggtgagggtgtgtgtgagggtgtgtgtgaggctgtgtgagggtgagggtgcgaggatgtctgtgtgagggtgtgtgtgaagatgtgagggtgtgagttagggtgtgtgtgagggtgtgtgtgaatatgagagtgagggtgtgtcagtgtgtttgagtgtgagactgagtgtgagggtgtgtgtgtgcgagggtgtgtgtgtgtgagagcatgtgtgcatcagtgtgagtgtgcatggcaaggccatttggaacgcgaaggggtgtgtgtgcacgtgccagtgtgtgaaggcatgtgtgtgagggtgtgtatatgtgtgagagtgtgcacgtctgtgagtgcatggcaaggccatttggaacgcgagggtgtatgtgtgtgtgtgtgaaatagtgtgtgcgcatgtgtgaaggcgtgtgtatgtgagtgtgtgtgtgagagtgcgcatcagtgagtgtgggggtgtgtgtgcgcgagggcgtgtgtgtgagtgtgcgtcagtgagtgtgcatggcaaggctgtttggaactagcagttctgtccctcttcttaccccataaatcctagtgtttttggaattatttctgcaaagtggcattatgttaaaatggaaaaagtgatcggcgattataattttctattgtttccgtcatcaaagagcttcagctgttttaaagagaaaccatttttaaaaatcctgtttcagcttggctcatgctctgtttctttgacgttcgttttgggctccagcctccccgagagaccccaggccttgtggttagttgactcccggtaaggagccgcggggcctgaactgctgcttgttggcggtggggagaagtgcagcggcaagaggcgagacggacaggggtgtgcgggttctgcgtgtaggagaatctgcttgggaaaccacagccctgcctgccgtggagatggacgcagcgtcccgctcacccggcgcacactgcagggctccatgcgggagtgaggcggcagcgcgtggacctgccggccctcctgggttggggcaggcttggcgggaacagcccaaagaccaacagtggttcccaacaagagctgggagggagtggggtcaccagagtgaagggaggcagacagaacccctgggacccaggggtcagggactggaaggaagcttggtactagaaacctgagggtggcctggagggctgggaggtacttgaggagtgggcgggggaagctggggaagggcagtgccgggatggggagggcacaggccccccaggcttgcagaagccatgctgccggagaggccgggcactgggagtctgggactctgctcagtcacatggtctgtggtttcaaacgcttccctctccgattctgcacgtgtcttgagatggccaggaactgtattttattcatatttgtgcttttctctattcaccaggaaaataagcaggatttatcttagatgaatcttgtaactgtttgtaagggttgctgtataagccctggggatggccttgtcatctcttgagttctggcttggatgtcaccatccgacactagcaccgcatcactggctgcacgtcggggctcctgggctcgttacgtccatctgccgtaactgtgacttggggcctccgtgtctgagggcagcccctgcagcctgtgctgagcttcctggcactgggctcctctcacccagaggccctggcagggtgggtgtatccgcagaacctgctcctgcagatgtccccatggaggtcgggccgcactgttcctgagctgcggttcagtagagctgggccaggcaacgtcctgcctttgggagcttgccctctgcttgggagagttgaacaaacagcagcagcagaagactgtccaggggctcgtggcccccggaaacgaggccaggtgatgtggggagtgcccgacgctcagagggagccagggcaggtgttgggacacagcccagggcctggggcagctgggtgtcccagggacagagggagggagagccgggctgacacctggacttagatattttaagtgtgacagaagctttgggtaaatttattgccgggagctgaaggagagggcgactgccctgtgtgtggcttggagaatttgggggccttggctgatttcccatcacctgacttggcggtcgctgcctgggagagccagggcctggctgctgcaggaggaagcttggcacctctgcttggaaggaccctccccgtggcgagaggaggctgggcagggtgcgggacccagaggggtgcaccctacacaaggcaggcagaatccaggtggtcactggatggagcctcctgcacccagggcagaagctgcacctttccaggggagcagaaggggcatcctgggtgacaggaggatgaggtgacggcggtttgcaggttccccgggagctgttggagccaggagcctgggctggagcctgggagagacctggactcagggactgggcagagaggggatgttcagggccagggatggcagaccgcagtccccggccagatccactgcctgttctcgtaaatagagtctccctgggctgcagttccgtctgctgttttcatgctacagcggcagagtggggtcgagtgcgtggtgtcgcctgcacagcgggcagtgcctactcttggccctttacagggagtctggagggaggagggagacaggtgagaggagggagggaggacaggtcttgagggagggaggagggagggaggtggcaggagcttttgcgtctgtccccagtgagttgccttgattccatcttgaggcctgtactgtgatcttgcccatccagagctgtaaatcccagcaaaaaccgacggagccctgagtccgacctaagccttggtgtgagtcggacacggccttcttggctgttgggttgataatgttggcttcttcctggcctcccactcacctctgggacgacgtgccgcacgtcacattgtgtaggaatgagatcctcacaggcctttcagaataagctccttttaccctgtctcttaggtttgcgactttgctattttcagaatttaacttagaaatctttgcttgtcttggtctttcacacaccagtctgctttttaaacccattatatgggaaattttctgaactgtccttaagatcctgtgaactccggacatgtaataggattcttcagtgcttcagggccttctcattgagtgaatgtttgttgaacacctactatgtgcccgacattattttggctctggggaggcagtggggaacatgctcagtgttgacccctccctgccttgtggagctggtcctggatgggctgcatggggcaccgttgcgtggggcgtgctcgaggtggagacggctgtgagcagctgcaggccaggcagtggtgggacctcatctggggggtgctggcctgggcagcaccatgacccacccgagaagggcaatggggaaggaaggcaggcaggcaggacagccagactgttaggggttaggggttaggcacagggctggggcgggtgctgggcagactgcaaagggtcagactggcatatggcggccagctgtctagttggttatgcggggtcaggggtggagggcaggaggatgggagagcccagctgggggagatttgagggccctgcccatagaggagccacacctgggcctttggcttggcgaccagaggcctccagggttaagagcagggagagaatcagggcctgtgctcatatctgtgagctctgcagatgtctcccgggcacagtcagcagaggcgctcctccagttcccgcctctctgcctcgcacgccctcctagctgagagtgaggtggtccggccccatgaaggaggcagcagggcttgcggccgggatccaccagggccgtcccggttcctgggtgttccgcgctcgtctcctttctgctgttgagaaaccttcaggagagagtgcttctgttccctccaggtcgagctgtgcgccaggcatggccggaaagctcaggaggccctggttaggctggggcatcacgggatgtgtcctctagcagagactggtgtgggtgggcgcaggaactggtgagagaggcctgggagacaggtgagcctgtaaggaggcccagagtcaaggaggagctctttggcaggtcctgaagaccctgggtcacccacaggcccctttgccttcactggaactttccagttagccaggcctctcctggccccaggacatagcccacgtgggtcctcacctctgcccggctcagctcctccccgcccagaatgccctctgccccgccacccccatcatccctgctgccctggctggacccagagctcccatctgcgaactcctccaatctagccctgcccccctgctcaccctgggtttccagctcaggacagacccctggggaggtgaggggctccctctgggtactcaggaagcatgtcctgttgtccagctgggcggtgatatgcaggcctgagtccccgctgcaccacagctgcctccaggctcacatgcccacttgccgagctcaccacacgggggcttcgccttctctgggatccgcggtgggcctgcgttggagggctgagaacggctcgccctttccgagctagcactctgcccactttctcttcacgccccgtcctggtgaggcggtgcctgtgcagcgcatgatcgggtgctcccgccttgcggtgctttcttcctgtgcccagactggccatgcatgtgttggtgaagggctgtgctgggcttcccgggcccggggtctgaacccgactcccaccaggcactgagtaaacacatccatccaaacaagggaggtggagcacgaagcaggggcaatgggctggggcccagaatcttctggggatgtggctgtcagcagctcctggacctctgaccatgtggcagggggctcatccccgtctccccagggcacttgctgctggggccctcaggcggtcacaggagttctcccaggcgtgttctggccctgccccatccctttcctcacccatctgcagaggggagttactggctaggcaggggaggtcagcagctgcaggaaaggacaggctcccacaaaagaggagatggggggagcctagagagagacaggagaacccggaggccctgttgttggaggccctgttgttagtgaccggacagcaacaggcggacccctagcagcctgggctgctttgtgggctctgcgaataaaccacgtagacaatgtgaaattgtgtttcttcctttccgtcctcgatggaacacaatgggatgaagatgtttctgtctgaaagaactgaggtgaaatcagtttagcacttaggtgataacccctcagcagaaggccccacgcatgcccaggctgccttcggttctcaggcgctggtggctgttcccagggtctgggggccctggggggccaggatgctgttgtcctctgctcccgcctggagaccactgtctcctccaaagctctgtaaactgtcagtagtgcaggcccctcagaagccaatgaggttaacgggcaggtcagcgtcaggggctcacccagccaccccagaaccccttgctgttgttccagaaccttcagattgctttctctgaaagtgtgcctgtgtgtgtgcctgtgtgtgtgtgcacctgtgtgtgtgcgtgcctgtgtgtgggtgcctgtgtgtggggggtgcctgtgtgtgtgtgagtgcctgtgtgtgtgtgggtgcctgtgtgtgtgtggggtgcctttgtgtgtgggggtgcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgtgctccgccttctgtcatactgcctgccatgcctgtcgtacctaatgtagaccctctggcccagagcccaggggaagtgggtggggccatggtaggtagaggcggggcctgtcgaggaacagggcttctgaggccactccagacctatggggctgaccgggggtcccggtagcttgggcgggagccccttcctgggctggtgacagaagtggaggtggcacccctttcagcgaggagcagctgtgcagagggaggtgtggctgccttggagtgattcctctgcttgctgggggtgtggctgggcgcctgcccaggcccctgcagactcccccacacttttgttacgtgcacagctcctgagaaaagccttctaaggaagcttgagctgctgcgcattctgcaagcagccattgtgcatttctgaaacgaagtgtgtgtccagtgctgtgggttctgctcactgaacactctcgtgcggggaatgctcatgttcctccacagaaaggcagaagcagagctggcacagttccttcccagctggcagcccaaccccagaccccagagccatggacctagcctggtggccctgtgggcattgagtttgcagttcctggcaagaagcttccccaggtctaatggcgaagcttccctcaacctaacgtttcagggttaggactcctagagcccattaggacgagactctaggtggcccatgctgcatgattttgacagcagggaagcactttgggatgagcagtttacccctaaatctctagaaaattaacagatgattttgcagtgatccctaggctttacaaatagttttctttttctttcctccttcctttttagagccaggatccatcatggttcactcgctttctggttgtttcatatatttggagggtgggcagagcagatcacggaatacagatagcactgagagggctttaggcgtgtgccagatcccgctggctgccacccagtaagctggtgcatgtggaggcttagaatagattcattggcagctgtaattaaggttgtgaactgcaccacgatgctaaaaaaaacaaattctctgcagctgttttactgactgagaaattacccctgtcggccgaagttttattcttctgatttggtagaggaaatagtttaaaaatgatctcacagcgtgatttatgtaaacggcgcttctttctttggatgagacaattgagatagagtctgaaaccctggcaagccacagcttcctgcagtgtcctgttgccatgggttacgaagggagcgagagggaacttcatcggaaatgcctttaaacttttctcacacgcacaagctgcggtgttgaatggtgtgtcttagacccgggtgcctagtgtggctcggtgccttacaatgaatttggggaaagagttgtcaaacgaaacccatgtttctaatgaccagcaggtaagtagttccggctttttcttttcatttaatcagtggtaggaaagcgtggcaccctggctatcctgttttagcgagtggcagctgtgggacctgcaaatgcttgtaaggataagctttggaaatggttttcatgtgtctgcaccacagctcaaagcgagtgctgcgggggctcagcccaggctctgggaccgcagcacgtcccgggcccgacgcacccggccgccggcctcaacccctcgggagcccaagctgccaggttttaagtcagaacttacggaaagcgtcagatgtttttcctttaccgtggtaattctcatagatttgaaagatgtgagtgaattgattttgttgaaatattaattttaggctagataaatacattaaaatcttaggctctttaaatgatggtagcttaacatttctaaatatgatgagttgatttggctattgtgcatatagatagctactatagatcatattggtgattactatataagcttatgaagttgaagttactctaaaatggctttttaaaagatttgagatgaaataaaaataatttctattttcctcttaaggctgtgttggtgcaaagataaaaataaatttaaattatgtacagaagtcttagtaattactgggcactgatttcgaattcattcttttctgggaattgtataatcttaatgtttttctaatatctaattaaagtcttctgtagagaagcgaaggacaaactactagtttagagatgaggggcatggaggggttgggaacaggaaaatgagccgcgtccttccttttaagtgggaaatagacatgggtctgctgggcagggccagcatgagcctgatgaaatcaaccggctttctgtgcacgtggaaagctgcttggaaggtgaagctgcgtgaggctcggggagcagctctggtcttctttggggcgtgcctgccgcgggccgcctctggctgtcttggggcagggggaatgtgttcctgtaacctctgtttcatatcctgcgtcggaaagtgaattttggagctgtcgtgggtttaatgggccagttaatcagttagccatttgtacttatttgtaggcagcactttcatctcagtgtatatccaggcaaggtgtagaaaattttgtttttttattccgagtaaagtcattaaaaacctgcctttgtaagtatctgtttacatgatttggacttccttttgaagctcttgcaaatgcttacactggcagataagttgttcacgggagtgtattggaatctggctgatgtggtcgtcaggcatcagaagtgagcggctccccctctcgcagtcagaggcacagcgggtgggtgggcgtctctgctgcagctctgcctggctgggtcctggccagcagacgaggggctggaaagcctctggggtcggcagaattgcttctccttctaagcctcaggtagttgttctaaaaaatgggagggtcagggaatgctggggtgccgccgtccgtgtccgcagcagcgctcttttggagttccgtgtgtctccagctcccctcatcttgagggggaggatgcccccgcctttctaggagctgttgcccgactccattcaaagagcacgcgggggagctgccgggatttccacttggagagaatggaggctctggctggccagatcagtcgatgcctggttccctggctttggcaggccgggaagatgcccgtgcctgtcacctaatcggggcacctcatcctgtttcataaaccatgtggcgtcaggtgttgcaggctctgacactagttagatgctgagaggaggcacggagaccccagccccaaagaaataggaattgcctggaggaagagagcccttgtggtctgtctgcgcacccctcccagggtgccctgctgtggggtggccgctctgggctggggggctgctgcagccctgggcagcccagcttgagcctccctggcaggcagcggccgttcagccagcctgtggctgtcacagggtcctgggtgggactttccggggcagttccacctctcctgtgagttgtgggaacaagtccccactgcaagtgagtgcccaggtgaaggccctgctggtgcacggctggacaagcatgacagttgtcgcggagccgcccgagctgttggcttccccgatgttccccctgtgctcgagctaggggtttgactttagtcctcagctgtcagaggccgcctcgggtgcatccacgctggcccccccaggtgtgccctgtgtggccggcatggaggtggcggcggccatcagggtgtggttttgtgacgtctcagggtgtcctttctttccttcatgagaagaagttctgcagtgtcagacacttggcagaaactttgtttctcaaggcaaagccctttagagacttgggagcacatgaggtgcggtgtagatttgtcttcatttctctcagcacggggttgtcttcaggctgccagagcgtgacagaaagaactttctagagaccacagggcttctctccccttcaggcattgacgttctgtttaatattttaaaaatctttaaaaagggttgcactgtttaaaaacgtggaatattctcttgtaggcagtgtggaggccatggtcgctgaggaagggcaggagggaggaggcgtgggagctggtgcagtctgcggcccggcgtggctgcggtcacacagaggatgcggtgagacctggcagcgaggctcgaggcagacagacgctcatgcagggcagagggcaggacccgtgttggagcctggggaagtgaaaggataatgaggaagacggagtgtggtcacgagggggcggtggccgctggcgacacgcagcagtcactctggctgcagccttgggccccatgccatttgactggaaccttcactcttccctcgcgagtctaccacgggcgggccggctgggccaggctccagggtcccccgacagagagtcccagcccctgcgggaccaggttgtgttagggcctgaggctggtggcagtggtgcatggctgatggccgccgcaggacacaagagggtttcgggggcgtgcctgggctgacgtgtctgtggacacctctgctgggtcatttctgagtctctgtagcatgagcttggtgggccatccgggaaggtgttcgcatttcaccgtgtctcttttccagcctggattaacccagtctctctcatcagtgtcactgaccgcgtctcttaaatggccctcgtgtgcccatgctcctttgggaccccgaagtgcagtgctgactggtgctgggatcgcagggcgtgcacaccctgtgtgctgtggccgtgtgcctggcctctgcccgcctgtgtcctgctgtatcggtcagcttacctttcgccccagacctctgttgccctgagcctggtgcaggagggcctggagtctgtgccggcgagcatcagcgcgtcccacttcagatgctggttgcagattcttctctcgttttctgacactctgagtctcgtcatctatataaggaaagatccaagtatatttgagaaaaactgttttaatacatttctattttcacctcttcccccttcttttcattaagaaattggacaccttgtgctgtaagctgtccgtccatgttacatagtcagaggtgtatctttctcgggccaaaaacccccagccctttcccctgggtcctgaggaggaaggcagcgagcccgcttggcgaggcccttgagcactcagcaccttctcctaccatgtcccacgcggctctgtgaacgcaggcatccctgtctccgttgggcggatgtggaggctggttgaggttccttgcaacgcttgccatcctacgcatgatgcagggaccccggccctccgcagacagcaggagctgccgagctccgagtgctgggccagcttgccttgggcttctgcagcagcgccctccgggttcccctcctctcctccgactccactggcttttcaccactgtcaggtcttcacgggggaggcctaggctgggcggggaccggtctccttccgccaccaccttccacgacaggctcgattcgtccctcgcatgctgccctcccagcctggccctgcagcagacacttctgccctgggccccggtctcagtgacaggtccacatcttctcaccgtctctcctcggacatccaggaggcccctcagacttaagtaccaaacaagacttggattctcccctcgcctccggtgtacccctccctcagtctgccacatctcaggaagggatgtccctgtcccttctgcttgagcccacaccctctgatactccacgtcagcaagctcctgggctcggccttcaaaatccctgagtttacactttctcacccccattgctgcagcctgccctcgtccccatctcttgcctggagcaccacagagcctccagctgcccctgccctgccctgtccatgcacctgccagagtgagcagcgccatcctagccgcccctgctctttgccccatggctttctgccttggactgggctctgcggggcagggctgccagtttggggtttgcatgttgattttgtacatccagcatctcaggatggctcgccacgtcatgggggctcagcagatgctttgccaagtgagtgggagcgttctcagcttgcgtttgccatgcaccgcctgtccctgtgggcagagcagttcataaccccgtaaccaacccatgggtatgccagacaccgccaagggggctgccaggaggggtcggagctcaggggccagactgagggagacaggaggctcagagaccagggtttagctgcacgggaggtcattttgagacagtcgctgagtcttggttcatatgaggaaacgtttccctgggcgtgaactccagcctcatctccagccctcatctccagccctcatctccagcctcatctccagccctcatctccagcctcatctccagcacgggatgagctcctggtggccagctgtgttacgccagtccctgtccagaacctctcagcacagctgacttttacactcatctttccttgcggggggttggcactgacacattggaaacctgagtcacgaatgtcggcctggatgcctggcagcctgccacctgtctgcatgctggagggcccttggcttctgagactgggcgagctgaggagggcaaaggcctgtgtggtgtttgtcccaacagagggttatggtgtgacaaggaggagcatcccaaagtcagatggcccctactgctgtcccaggaggacactactttgggctcaaaagttgtcagaatatattatcttaggctccgccaaggatatgaaatgaatattagctgctgctgctttgaaaggctgtcattttggtttttgccctggttcagttccttctgattttattcaaggttgaaaagctccttggaacacacacacacacacacacacacacacactttaaagggagaagcgcaggtctgtgtctcagccccaggtgtgctgccctccccgcagaccgtggtggctgctctgccaggcgaggttgcacgtgggagctgggctgcagtgaggagggcaccatgctgaggagtggagagggagatggaacaggaggggactgggtccctctgtgcaggggccatcgaagtccttgcgctgccaccctggggggagacacgtgccctccaagaccctgctcacaggcatgcacatgcactgtgtccacacacagacttgcagctcagaagtggggttcacagacagcacgggcctggagacatgctgcatgcttcccttccgtgttgttctgtttcatcccatttcatttttcaaaaaatgctgctcacagactgtgaattgatttgccggtcccttggagggtcatggctgggtctgaagacccctgtgctagtggagcagagagcaccccagcatgtgggagtgcagtgagccactaagccagggcatcttctcctgaacactcactctgtgctgcactcagccttgcccgcctcagagaccctcccagatgcacctttccgaggcctcagtctcagcctctggcgtggatgctgtgctcttctgcatttagtccagcaagagattgccttgaaatatgaatgatgaaattttaaaaggtaaagcatatattaggtgcaaattggattgttaaattcttttttttttttttttgagacagggtctcactctgccacccaggctggagtgcagtggtgtgatcacggctcactgcagccttgattttcttccagcaggaagggactgggtccctctgtgcaggagccatcagagtcccagctacttagggggctcaagcgatcctcctgcctcagccccccaagtagctggagctataggcacacaccaccacacccagctaatttttgtattttttgtagtggcagtgtcttgccatgttgcccaggctggtctcgaactcctgagctcaagtgatcctcctttctaggcctcctaaattctgggattacaggcatgagtcacgatgcccagctgattattaaattcttaattcatttatttatatttcttctctttgtattgaaaacatttagtgcatttgagcaccttgcaggcctttggtccgtttttttaggaacatcaagtggtgattgaatagtttttatgttcaaggtagaaaattttgtcagtggctgaaaatgaaaaatgtatattacagtatattactgtaaaccaatagaatttggaaattatgtgttttaataattccttttgtctagtgttactaacaataaaccttaataaaggttagattcctcatgtgacactactcatataaataatttaaaactttcaaaacattcatttcaaaatatccgtgaatgtgggtggcccagacagactgcctgcagaggagcagttgagtccttgtcagctgagctgccgcgttcaagagacccaccgaggagcagaggttgtgtggacttaagttacattttaaaatacttcgtcagtttctttaaaacagaaatgtgtttacttgagtgtaaattccaattctggaggcatgttatagaaatttttagagctgtttaattacggtatatgtttaaattgtaagcaccgaaaagtgctgacttactggggtctttttccatgggtggctttgtttttgtggctgtactttttttgtaagtataatgtgtatatatggaaatttgggaagaatccaagaagtataggccaatgaaaacaagttattaatacaaatagtactgtatatgagagtacacattaggaatgctgtgctttaatgcataaacatgtttacagtggtccacatgtgccaggagatgtgggaatggctacccctgaagtcatatggagaaatggggtcctcatcgcacaccatacacaaacatcatctcacaaatggattaaagacacttaagacctgaaaccaaaaaaactcctaggagaaaacacaggggaaagctccatgacatcagtttcggcgatgatttttttttggacatgacactaaaagaacaagcaacaaaactaaaagtaaacaggtgggattacattgaagtaaaaagtttctgcacaacaaaggaaacaaccaacaaaatgaaaaacgaacctgtgaatgggagaaaatacttgcaaactgtatatccagtaaggggttaatatccaaatacataaggaactcatacaactcagtggcaaaaaccaaataacccaattgaaaaatggcaaagagccatagtagacatttttccagagaagctctacagatggccaacaggtatatgcagaggtctcagcatcacccatcaccagagaaatgcagtcacaacagtgagctgtcactgcatgtctgtagaatggttgttatcagaaaggcaaaagataacaagtgtgggtgaggataggagaagagggaacccttgcactgttggtgggaatgtaaattgtacagccattgtggaaaacagcatggaggttccttgaaaaattaaatatggaactaccatatgatccactactgggtatatctccagaggaaataaaatcagtctctcatagttgtgctcccatgttcatggaagtgttaatcacaatagctaagatatgaaaacctaagggataaaggaaatgtgcgatgtgtgtgtgtgtgtgtgtgtgtgtgtgtgtgtgtgtgtttagagagagaatgagaatagcatattctgccttaaaggaactcctgccatttgcaacaacatggatgaagccaaacatgtgtggcttcacttacatgtggactctaaaaacattgaattcatggacgcagagagtagattggtgcttaccagtgcctggcggtagtggtggagagatgttggacacaggatacagacttccaattataagatgaataagttctagagacctgatgtacagcttggtggttgtagttaataatgctgcatttattgtatgcttgaaatttgctaagagagtaaatcttaatttgctaagagaatagattctcaccacacacaaaaaaggcaactaagtgaggtggtggaggtacatgttaattcacttgattgtgataatcatattacagtgtatacatatattaaaatatcatatcacatacattaaataaaaatttaatattacctgttgtattagtctgttctcgtgctgctatgaagaaatacttgagactgggtaatttttaaaggaaagaggtttgattaactcacagtttcacatggctggggaggcctcagggaacttacaatcatgatagaaggggaagcaaccatgtccttcttcatatggcagtaggagagagaagtgccaagcaaaagggggaaagccccttataaaaccgtcagctgtcatgagaactcactcactatcaccagggggtaactgcccccatgattcaattacctcccactgactccctcccatgacacatggggattatgggaactacaattcaagattaggtttgggtggtgacatagcgaaactgcatcgttccacccctgacccctccaaaatctcatatcctcacattttgaaacacaatcatgcccttccaacagttcccccaaagtcttaactcattctagcattaactcaaaagtccaagtccaaagtcttatctgagacaaggcaagtcccttctgtctatgagcctataaaatcaaaagcaagttagttgcttccaggatacaatcggattacaggtattgggtctatatccccattccaaatgggagaaattggccataacaaaggggctgcaggccccatgcaagtccaaaatgcaatagggcagtcattaaaccaaaatgatctcctttgactcccatgtcccacatccagggcatgctgatgcaagaggtgggctcccacagccttgggcatctctgcctctttggctttgcagggtacacttcccctccaagctgctttcacgggttggcattgagcgtctgcagcttttccaggtgcatgatgcaagctgttggtggatctaccattttgaggtgtggaggagggtggccctcttctcccagctccactaggcagtgtcccagtggggactctgtgtggggactctaaccccacatttccctttcacactgccctagcagaggttctgcacgagggccccacccctgcagctaacttctacttggacatccaggcatttccatgcatcctctgaaatctaggcagaggttcccaaacctcaattcttgacttctttgcccaataccacatgtaagctgccaaggcttgaggctttcaccctctgaagcaatggcctgagctctacgttagccccttttatccatggctggagctgaagcagctgggattcagggcaccatgtcctgaggttgcatagagcagggaggccttgggtccagcccaggaaacaatttttccctcctcggcctccaggcctgtgatgagaggggctgccccaaaggtctctgatgtgccctggagacattttcatcattgtctcagtgattaacatttggctccttattacttatgcaaatttatgcagcaggcttgaatttctccccagaaaattttttcttcttttctgtcacatcgtcaggctgcaaatttttcaaacttttatgttctgcttcctcttgaatgctttgctgcttagaaatttcttctgcatgacaccctaaatcatctctcttacgttcaaagttccgcagatatctagggcagggacaaagtgccatcagtctctttgctaaagcatagcaggagtgaccattactctacttcccaacaagttcctcatctctgtctgagaccatctcagcctggacttcgttgtccatatcactgtcagcattttggtcaaagccattcaacagatctctaggaagttcaaactttcacacatatttctgtcttcttctgagccctccaaacagttccaacctctgcctgttacccagttccaaagtcacttgcacattttcagatatctttacggcagcaccctacttctggtagcaatttactatattagtctgttatcatgctgctgtgaagaaatacctgggactgggtaatttataaaggaaatgggtttaattgactcacagttccacatggctagggaggcctccgggaacttacaatcatggcagaagggaaagcaaacacgtccttcttcacatggtggcagtagagagaagtgctgagcaaaagagggactaaccccttataaaaccgtcagatcttgtgagaactcactatcacaacagcatgagggtaactgttcccatgattcagttacctcccaactgggtgcctcccacaacacgggattattggaactacaagatgagatttcggtggggacacaacaaaaccatatcacctggacatcaaactgctgtcctccaagttttcatactttcagagaaattggtcgtgacttttcctgacaagattacttaatttgcaaagagatcatttataattaccatgaatcttactgcttttgtttaatgaatatacctgggagtgagagagctgtgcactgtgtaaactgaggtccagccacctgtatgtgaaggccagaggcttccctgccagcacccagcaccactttgtacaccacaaagttttatttgtcaaaaaatagtcgtaacgtcaccgttcaagggcggttgactgctgttagctttggatattgttcctttgtggctagttacgtcttttcagtatttaagagtgtattttcacagatcttacattttaaagaaaattttacatatttgtgattataccatgatatcattttgcattattttttccacttgcattgatgacataacttctaaaagttcttgtcagagatataatgtccctttttgaaatgaagaaaggaaccgcaaggtgccctctccttccctgcccttcctgatgctgagacaagccctcagtccctctgcctcctcctcagctccactcctgagcacagacaagcccagccgtggcctggaagcgacactgatgattagtatatctgtgctgagtgccgactggatgctgtgctgagccactgtggtgggtgtcttgattcctgtgaccaccttgggagatcaacatcatgggatccactgaaaagtcttgctggcttgcattagtcctgctcacagcaccatttgtaggtgacggtcttcaggagttctccacagtcgtttttgaatctcagatcctgaggagaccacctcagttctctgctgctctctctctctcctccttattttctctgcccatccctctgtactgtggtcagtgtaattgttttcagttccatcttccagttcccaaatcctctcttcaactgcctaatctctgtttagccttcctattgaatctttaacttcacttactgtattttcactgtcggacattccatatggttctgtttccgacctgcactgtgctcgtgttctgcttcagcctttgtttctcgacagcttcacagatggttactcaacgctctgcattagattgttcccatgtctgagactctgctcattgttgtctctgctgatacccactcatgctgggcttctccttgggtttttcatagtgaactcatattcgagtgggctcactatctggaactcctgagggcccctgttgggctgttttctttctggaaggatttgcattaatatatgtggcttccaggagtgttgcacctaggacagcactactccccgagggccatggctgagctggatggaggatctcaggttgaggggacaaccgtgctgtggctgaggctcactgcgggctacccggccctagtggcattggcattttctaactgcttccccctctgttccttcctcgtctcttttcagggatttccctttactctttttggagtagcggtatattaaaaagcatgtttgggtggggcatggaggctcacacctgtaatcctagcactttgagaggtcaaggtgggaggattgcttgaggccaggaattcaagaccagcctgggcaacagaatgagaccccatctctacaaaaaatacacaaagtagctgagcatgttggtgaactcctggatcccagctacttaggaggctgacatgggaggattgctcaaacccaggaggattgaggctgcaatgagccatcattatgccactgtactctatcctggtgacagagcgagactgtcaaaaaaaaaaagtatgtgtatctctctactgtctttaaaataattttttccataaatttaaagctgtttgaaaaggtaaagtttacttttaaaacagctctacactttacctgcatccgtgcactgtcttagagcctcccagaggctctggtctagccctacgtgcccgcagcctgtgcccatcacaggagcagcgatggcccatgcccatattctttggcctctcagtgggcatcacacactccctggccaccttctccttcagtctgtttggcctctgggacactcctctctcctggttctcaagtttcagctaatttgggggatgtaaatgctgcgtgtatagaggttttctagagcactttgttcggcctgccagattctgagaattgaattttactcatgagcgtgacatgaagtgaaacacctccttcatatttatgaagtttacattttatgatttatctttcagatcttattgacagcatttctgattttgtgtatggccttgtggattttcttctcataatctcaaaggtatagattgcctgtgatattatttatttattttaagacggagtctcactctctcacccaggctggagtgtagtggcacgatctcggctcattgcaacctctacctcccgggttcaagcgattctcctgcctcagcctcccgagtagctgggattataggcatctgcttccacgctcggctaatttttatattttagtagagacgaggtctcttcatgttgaccaggctggtctcgaactcctgacctcaggtgatccactcacctcggcttcccaaagtgctgggattacaggtgtgagccactgcgcccagccttcctgtgatattatttagattgcgacatgattgtggatgatttattgcgggcatggaaggaatgacagccttccaaaatgtgtatgtcagcatctgtgacgtggctgccccagagcctctgataaaaaccagtccctgcggctgagggccaagggccacatggtggcttcaggggtgtgtgctctttccccttcctggccaatgagaggacagtgaagagatggatgcaggctgctgtgtgttttcactactgggaagtgggttggggggcaggaccctccgaagctggccccaggtggtctcacacagtgcctgtcagggggcttactttgggtgccagaggacagactctgcgggggaggaggatgcgcatagctggtgtaggtcgcagggccagggctggcagtggaccccggatggccaggctgcgtcggggcatggttgcccttgccggcaggctgggaggcagggctggggccctgtgccgaggttggggtggtcagacaggatgtgcagaattccagtgggtgtaccgctcgtgttaaaacccatacagtgtgtgtcccggagggccacacggtaggggcagcagctggaagccctggctccttttccttggtcccctcccccttgggaggttcctctgggcctcacttgtttggactttggcgtgggggggtcttaaagccccagtgacctccacttctcgggagtggccaggaggtaccaggttgcccatcacggcagcaccttctcgttcgctcccctggccctggcagccctcgccttggcagagaggaggacagaagtgggtccttgccaggccgtctgggaggtccccgcaggaaggggttcctgcctagatagcagcagagtgcctgcccagggatcagatcaaacacgggtttgtccagcctctggagctccattctgctcaccccctctcacttcctggcatccgtgtcccctggtgagccagcctcttctgattcctctccttcctgggctgagtcctgggcttgtcccgtacctgcctgacggctctgcgccctgggcccttcctgccagtgcagtgccaggtcgccctgatcagggctcccgttggggccgccgtggcttcctgttcttttcggcttcctcctggctcagctgactgtctcgagttctcggcctcctcctggtcacgctggccttccggtaccgcctgccacccctccttcataacttgacttgtctgttcttgtccctggtgcctttaagccagccaccctgctctcctccagccccttccactgttccaagccccttcctcggaggcgtctccccaaccctcctgctggtggccgctcttgcactgcttgggtgggcgggcaccagatccggggcttggctctgggcttgactcctctgctgccaccctgagtggtcattgcgcctctctaggccccgttccactcctgtgggagggcagtgatgctggagagcgtgaggggcggcgagtatggccctgggtggcgtcatggcacacaggcactgagtggactgttggtggctgcccccgagtgtggtcctgggtggcgtcacggcacgtgggcactgagtgggctgttggtggctgcccccagtgtgtgtgtcacttacagggcatgatgctactgaagtttgtgaagttggtttcattgacgctgttactaagactgtaatgtcagacatgttgggatctgttcttttcacatgaaaaggatgacttcctcttgttgggtgtcacctagtttgggcggagtgggagccgtgactcttgactcattgggccgtctggctttcccgggacacctccacctggagagtgcctctgagaacctcccagagtctgccccttgtgttcctcagatggacttttcgtttcctggagttttgtcatgaggcttaattaactcatgtctctctctcttttctttcagtctgcaactgtgtctgatggcggtaagtcacaatttctgatgtatatattttttatttttcataaagttttcaaattgtgaaagtgtatttgccatttgatgccctcaggaaggacgggttgtttgcctttccctgtctccttgtgggcgggttctaggtgagttaattctgggggcgctttctgtgacacccaggtggcctcggcgtgtgttttggaagctgtttgttaagagaactgccatggccctgaacaccagtgtgatagagcgctgtgtgtctgaggagtgcacccacccgcctgcctgtgtctgacaagttaaaacgtgtttttgctcttcccttgttgtataaccagcttttaaaccagcaagttaagatttcaaagtgctttctgaatttgagcaattcaggaaatttgggtgagacccagaattttctcaagaaaagtataatagacgaattgagagtgtgggatgaagaggaatcaaaaacttactttctgtgtttaaagaattttgtgcacagggattcttttcatggactgattgaaaaggaagtaggcaggaatgtcttatttcactgaagatttctctgatgtcatccttatcattttggttcaatgatttaaaaaaacctctccaaagtaaggagagttcctccgaaatattcctcttttcttctaacactcctgacagtccgcaggctctcgggtttcatcgtcacctcacgcttttgtccccacttctgtccctgagagctggaataggtgcacctggcatcgctgtgggccagggatgggctgaggcacaggctgtgctgcagaagctgcccaggggccggtgggtttgaggtgccactgtatttgtgcgttaaagagaaaccaaatgtcgttctctcactttctgtggtcctgcagctgctggcctcagtcctcggcctcggaaagggctgctgtccccaggtaggcagacagagctcagagccctcgcaggccagccactctgtaggaaggccaggaggaccccaggtgggcagacagagctcagagcccttgtgggccagcggctctgtaggaggaggagcatatcttgggttacacacgcactggcacctgaagccgagaccagagggatcccgacactcgtgtggtggagatgtattttgtagaataaaaggaattctatttcctattttatgtacaatgaaaatcatgtcatttaatcagtcttaaggtggagggaggataaacttccttaatgaaaagaaacaggacccggaaccaaatccaggataaagtgaccggtgttttgaatgatctgttcatgctttctctttctgccgtgttctcacttctcctttctggcagaagacattcatttcttgcaggcaatttatacatgaaagatttgcctaatatgtttagtttcaccatatataataagttttatttgcctccaaaagattgcttctgtcagcaatagatgcaggaacccagagttgtgttatgtgtccattttacagttgtttaaaaacctgcacctcccaagggtgggaagtctctagctcctcgccgtgctggctctgtgtgtccctctgaggaagtgtgtcctggctcctcgccacgctggctctgtgtgtccctctgaggaagtgtatcctggccacgcggagatcccctggtgctagggctttccaccccctgctcctccttcttttcccagtgtcagaccctggggccactgggacaggcccgtccctccatggagagccccagtcacagaggaggagacgggagggaggaggagacgggagggaggagacagtcatcagcacaccctgaatttcaggaaccgcagtgggcgggctggatgtttatttagttcctttttgtgtttttgttatttttccatcttcagtttctttgcttataagagtaaaaagagccagttatcttgtttaatgtgcacatgagctctagatcggtgtcacattctgccgttgttagatgtagggcaccgaggcagagtggggagatccagcagctcacagtagtctgcaggtgagatggccagactcaggcctgcaggggaaagccctggctgagaggcccctccaccctggctcccacccaccccccagccctgggcctccacacgcccagccccatggtcctggagagtcccccgctccagccctggaccctccagcgcctgcagcccctgctgccccttctggtgcctcaggcagaaagaggccccctcccccacaccctgccctccacggcagtgacaggagcctgggcggggtcggggtgggggggtggtcccagggaaactctggctgtgtttccacacagagatctttttataggctgtggtcagtgggagactcagtgcactgaggtgggcctgggaactccagcaccccagtgtttttatgggaaaaatgctccccgagttccaaggagggactgaggagttggcttggggagcaatctgctcagctgggctgtctctgcctggtcatcctgtctagttttggtgattaatagatcactcacttagaaatattttgtgttcaacgagccgtgccagtgagagagttcgtgttcatgccacggtttcattctgtgacgcgtatcgtgcttttatagcttaggctctcgctggagagttttagttttgtggctcggttttaaggaagttggactatgctattttggcaatctttgtcaagttggagtgtgttttttcactttttcagaagaaaggggctgataatggccacccgtttgtagccaaagagtgccctcgggaaaaagggttacagctggtctctggggggcacggcagggctgtgggtgggggcagggagcagattccagctggagagaaggaagcacattctagcattatagagaggcttagcaggggaatggtctgccttgtgggaagttattcagacagaagtgtgaggtcgagctggagggagatggggcgttgtgaagaaatgagaaaaggaagatgcccggttgctcctggaaaaaggaacctctcacctctcctggtctggctctgcacagagctggagccgcggccgcacagaagcccgttcttgtgccttcctccgttggtcaagctctgtgccaagaggcctgccagaatcccctcacccactgcagcctccacaggtggatgttcccgctgtgaccacctcaccttctgaagtcggggtgtggagactatcggggagctcccagagcgcccacctcctcctgcgtacggcgtctgtgccagcaggaaagccggggaactgtgcggctctggctttgggggacggtggcaggtccacatgacaccccacatacatgaccccggtgctccagctgcttctcaaacactccgttctcgcagcctcaccctggggacccccgacacgtactagtcgcagtcctccatccccatgtcctcctcatgccttgtgcctcagctctgccctgaccccactctgtccactcagctgcccccctactcgtcctccatgcagacctcagtcttggccctgtctctgcagccatcctcccgctcccttctcctgaacgctggtggttgcccccacagcagcagcagtgatctgcccagcccctgcactggacccctccaccagctcagagcccctgttcccccaaccatcctgcgtcccaccctggtctccaatggtgcctcaggcacatgcggtttccctcttcccttcctgaccacctgcccccatcctgagcgatggccactgtcaatttcctgcccgtgctaggggcagcttccatcattttaattattcatctgtgttggtgcttttgtccccccagctggtgtgacctccacgtggcaggtcagagttgtcccggcacccggcacagcggctggcacgagagctgtctgttgagtgaatgatcgggtgttcagcagacatcagccagagcgtcagggcgaggcttgggcggggacagtggctttcagtgattttccttttagtcgtgaaaccttctcaaaaagcacacacaagcacagaagcagaaactcctgtgtgactggtgttgcggggtggacccactgccgccgcctcctcctgggctgctctgcgcgcctgccaggctcttccagtgccttcacccaacacgcgggcctttggagctcagacctggccatggcggaagattcgggctccacctgcagctccacagctgacaggccgatctcttggggcaagtcactttctctctcctagccttgtgtcttcatctcgccggtccttgttagcgaacaggcactgaggcctggggagctgtcacaaacggctgcctgatgggggagggttaccgtaattgccggattaacttgggggactttaaactgcattcctctttaaaatataaagtataattgttgatatttttggcaaatgccaaaatttgtattctatacaattttgaaagagaaagggaaaagcttgagagtagaaccatcagtacttacatagaattagttgataaatttacattttcctcatcagaaaaacagtgcagcctaattgcacattttccaaaaatgtttgctaaatagcagaaacagaatgttaatttgtaatgcgctattgtgggagtggttgttttaaccagaaccctttacttgatttaatatgtcacattcttttggtttgcttttggacttcaaaatgatgctcagaatcacacagtgtatttgtagggtgtggaataccgtattagtatttgtaaacaggagtcagactggagattttcagttttggaagtgtggagacttgatttctgccaggatgccttccgatgtacttgtttctttccaattctacaagatatttggagagtttttattactagtttttaatattgtgaaattattttttcaagcaaacaaattcaaaggtaataaaaccactaactgcatacctatcttccagagttaacgtgtgctagccagggggcctgtgcctgagaattgactcagggctggggtgaccacagaagcccttggtgcccctgcggctgcatcccctccccagaggccacacttggaagcaggcgccaccccttcccactccaagggagtttcttagttagattcttggggaaaagataaaacaaacgaagaactcctctcatgcaaccctaggcgtgagaagcagtgtccgccctgtttggtggtctggaggccatgtcagagagggctgcctggcgtgtttgggggcctcgtcagagagggctgcctggggtgtttgggggcctcaccagagagggctgcctggggtgtttgggggcgtcagagagggctgcctgggtgctccagggaagctcctcctgctcagcttctcggtctgggaggatgttcacctgcaaaactccaccaagccatatgctcataatctgtgcacttttctgtatatcttaatagtttactaaaataattaatattttaaatttctggaacttttaacctaaggactttcaaaatggtctgaaaatgttaatagatttgctctcaggagagtatgtatgaagtttgcagaaagaaagcattatgtagattggattgaaaatcagattggccaaaatgatttaaggaaaaggtctagaagtagatcctgagtgtggggagagctcaagggcttttctcagggacaggacctgtgcagttttatgcagttgaggaagatccttcccctacccccaggctagatagactgtgggaagagatcccctctgggcataccacctaacagaaagcttttaagactttctccttattgtcggttttcagcaatttgattatgatgagtctcaggttggtttttctgtgtctgttgtgtttgggatttgttggggttcaggtatttttttcattgtttcccacttttgagactctaattatgcaagcatgttaggccacctggttttcccttcagctcatggaggccgtttcatgttcaggcttctgtgtcgcctgcatgcttgccatttcattgtttctcttgctctatcctgcagttcactgatctgtcattttagtgtcagatatacagctcattccctcctgtgagggaattcctgccgatcagcctgtcatctcagagactgtgttttcatctttagcagttccttctatttttttcatttctttctactgattctcttcacgctttgctttaaaaccccaaaaatgttggctgggtgcagtggttcatgcctgtaatcccagcactttgggaggctgaggtgggcggatcagctgaggtcaggagttcaagaccaccccggccaacatggtgaaaccccgtgtctaataaaaatataaaaatagctgggcatggtggcagatgcctgtaatcccagctactcgggaggctgaggcaggagaatctcttgaactcaggaggcagaggttgtagtgagctgagatggtgccactgcactccagcctgggggcagagtgagactgtctcaaaacaaaaacaaaaaaccccaaaatgtttgtatatttataagacatgtaaagcccttagatgccagtgctatcatctctgtctttctgggtccctttattgactgacttttctcctggttatgggttacatttttctgagtattcatttgtctggcagttcttgactgagtgctgaattttgttgccttcctttaaaaaatacagaggtttgtaaagctacatttggggactcctctaaaagctggggattcacccagaactggctggaactcgggaaccccctgaccctgtgtgagttctggcagctgttcccgccgcagcccccggctgatctttgcctgcctcgtggggtctcggctgtgcatgcacagcttagaactcagccacaggtggaggctcctgtgaggtccctgggcactttccctgctaggtctctcctgcacctgcagctccagccaccctggccttccccgattctgacctgtctcctcagctctggacggtggttctacctgggccccaccttgtgctgtggttcatggagtgcctctgggctgacagctctgggtggtcacagggctcaccttattaattttttcatcaggaattacaccccttctggtgactgtggtccaattttgggaactgttgcttcgcatattttgcttttcttttttctgtcttttcccgcaggttctgatgctctgcgtattttgtctactattctactgtctggcaggaggggaaggcctgtcccaggtgctctcccacggcagatagagttctgtgatataatttttttcaccttacttgtgggatgtggtctgtaaagttcagaacaaaactcaggtcatgacggcaccttgtacaaagagcttcactgatttcccaaaagctgcctcacaacccagaaagagcaggttctcctctccccaggcccgtccctggagcatctgaggccagcaccatgctgggtctatggggaaatggctggaatttggggaggaagctgcccagcccaggttggacttggcctggctggctccctaggtgaagtgcagagaccaagcctctgcccggccctcagagcacctgcgactgacccttcctgccggcatctctctgaacgtggtgcccttccacggcatttcatccgtctgctccttcagcacatcttttttttttttcttttttgagacagagtctcgctctgtcacccaggctagagtacagtggtgcaatcttgactcactacaacctctgcctcttgggttcaagtgattcttgtgcctcagtctctcaagtagctggtattgcagatgtacaccaccacgcctggctaatttttgtatttttagtagagatggtgtttcaccatgttgcccaggctggtctcgaactcctgacctcaggtgatagacccaccttggcctcccaaagtggtgggattacaggcgtgagctaccatgctcagccgaatatgtgaaatgtaaataacaaatctagaaaggaatgtaggtaacaaatatctaatgagaatactctattaggaattgcattttatattaaatgatactgatgtagaaaggtggctctattctgctcacatttcgtgacactatttaaacacttcagatgcatttttgttgcaattgtttttcaagtaatgaaaactttttattgaagaatagcttacacgctgaaaggtacatacatgatcaataagcaatttgagagattttcacagaatgaacacatgtgtgttatcagcactcagaccaagagacagaacattaccagcagcccaagcgcccctgcaggccctcagtcaccagctccggaagggacctctcacccgacggctgttgcctgttttcaaacttaaaaaaaaaagaagactgactgggcacagtggttcacatctgtaatcccagcactttgggaggccgagacaggtggattccttgaggccaagagttcaagaccagcctggccaatatggcaaaaccccgtctctaccaaaaatacaaaaaaacaaaacaaaacaaaaaaaaacattagctggatgtggtggcgcatgcctgtaatcccagctactagggtagctgaggcaggagaatctcttgaacctgggaggtgaaggttatagtaggcagaggttgcagtgagcagagtttgcgccactgcactccagcctgggtaacagagtgagagtccatctaaaaaaaaaaaaaaagactcaacgcagcgtatgctgtttagtgtctagcttcctttatttaacataggatggtgcattttgctcctgtgagtctatcaggagctgtttactctcctagctgtggactgtccatggtgcaaatatggcatcgttcctccattcttctcttgatgacatcgtgttggttctgacttttggccgttacagatggtgccatataacatgcttgtacaggtcttttgggtgggcatctgcatacatttctgctctgataggctgggggtttgtatatattcacctatagtaaatactgccaatttccaaatgatttttacagtgtccacattgactagcagtatataagaattctaggtgttcaacatcctctcaacactttccctgtagccacatacatagggctttaattgtattaatagttttagttctcagtcccctgatgactatgaattgatcaccttttcatatatttttggccctttgaatatcttattttgtgaagtgcttgttcaagacttttgcttatttttctgttaggttatctgcctttccttattgatttatagaatattttaaaaatatattctggaaatgattttatggtggatttacgtatagttttcccttagtgtctctagggaattggttccaagaccccttgaggataccaaaatctgcagatacttgagtccctgatataaaatggtgtagcgtttgcatataacctacccataccttcctgggtactttaaatcatttctagattactgataacagctaatacaatgtaaatggtatgtaaacagttgttatactatattgtttttatttgtattttttgttgtattgttattttttttccattaattttttttccaaatattttcccaaatattttccatccacagttggttgaatctgtggatgcagaactgtgggtgcggagggctggctgtattagatataccttgtgttttggatttatgtgtttgtgatagatttatgtatgtagttaagcctttctataccttacctgttcattctcttagtggtatcttgtgatgactgaaagttcttaatataatccagtttatcatttttccccttagggtaatgcttatgtccctttagagcaggctttgcccttcccaagaccatgaaagtaaatctgttttgttttatcttcaatatttaaatctctgattcatctggaattggtatttttgtctatggtgtgaggtaggggtaagattcattttttctacatggtattcagttgtcccagctccatgtaatgaaaagacaatccttcccaataacttgaagcaacacctgtatcaggtaatcatatatttgtgggtctgtttctggcctctgtattctgttccattggtctgtttgtctatcattggatcaggacttcatgtcgtaattctcgtccctggcatttggatatctagtgctatagtcttcattttgcttgtctttaagattgccttggttattcctggcccttgcatttccttatatattttggaggcaattttcaagtcactggcagctttccagagtcatcttcacttttgtccaagctggttgagacatagcatttctggaatctgtgttgatgcttttcctggaaatgttatcacaagccacatgcagccattgacatttggacaattggggttttttttttttaattgctgtaattatacatatgtgatcttcaatatgtagttactcattcttgctctcaaagtcttgagaccattcctcccaggaataaatactaaatctggcttggtttgccttttaaaaaaccatctcttctggatgaatgacctctataagtatctaacaccagcattaatggagatgatttcaggctaatgcatcaccctcaaatagactcttgctcgaaagaaggtgagggagcagcctgggacacacaagaccttgcaaggacttgagaaaaaagggactggttgcatcagagaagccagtgggaagcccctgtgtgcctctgggtgccgaggtgggctgtggtgggatgccacactggctgcgatagaagaagaaggagctgtgcaagtgcgtggccgggccagagcccaccctgtggtcaggatggccgagcagagctgagacctgacagatgggtgaggattaaccctcatatgagtttgggaagacaggaagaaccaggaaaaagctgagatggcagccagggggtcgcgaggaacccaagagagagtagtcgtgtgtgcacatgtccatgggaggagcagtggaacgacgtgagaggggtcccaagactaacctcagggttttgcctcaggcagctcggaggatgagggtgtttgcagagatggggaagactagggtgggaggagcagataggggggtgataaccaagaattctgctttggacatgggatttttgagatgtttattcaaaatctactggagatattgtgtagacagttggataaatgagtacagaatgcagaaaagtggttgggcttgaaaatagaaatttgggagtcatcagcgtttcaatgaaactcattggcttggtaaacttgagtaattatagatcatgcagaaaaggcgagtctcaaacccataagacacatgggaaaccagaagatgctgaagatgtggtttgagaggcaataggacatagaacaattaagagtatggcctctggagccaaattatttaggtttacatcctaattctgctacttcctagctgtgggtctcatttctctcatctgtaaaatggaataatagtaggacccattacttacagacttcttacaggaagtaaatgatttaatatatgtgaagtacatcggacaatacctggtacattataaggagttatataaatgataactgccattatttgtaatggcattttaattgcattttcaatataattgaccactggaagtgaataaaattatttagagggactgggtagagaaaataagccaggaggtcctgaagaagcttacaagatcaacaagagaaagagcatcagaggagaaaaactctccactttgattgttaaaaacccaattttaaaataagcgatgttgaaccaggcacggtggtgcacacctataatcctagctgtggattatagggaatgcttgggaagctgaggcaggaggctcacttgaggccaaaagtttgagaccagcctgggcaatatagtttgactccttctgaaaacaaacaaacaaacaacaataagtgacaaaagtttgaaaacaactaaatgagaggatataacaagcaatattaagaaaaaagagaagtggcataacaatattaatatcagacaaagtgaaaaagcaataaaaagaacaaaaaagacagtgtgcaccaaaagtagcatgagatttgcagaacagaagtaaatggcacggtatcaacatgggtaagtactccgagggggaattattacacacctttttcagaaaccaagagatcaagctgaaaaaaaaaaatagtaagattacaaagtatgtgaatggaaaaatgagcaaattaaatctaacagacacatagagagctttgtaccaaatggaaaatacactttttttctaaagtacgtggaacatttactaaagttgtggcatacaatatgccacacatgcagttgctacaaatttaaaaaaattatagcatacagagaatagctcctgacagcagtgtatttgaatagaagtcgatcataaaatgataacaaaaaagaattcatacattttaaagtttaaaaccatacttctaaataatccatgggtcaaggaagaaattaaaatgggagttatcatacagtttagaaccatttatggttctatactacacatcatcaccagtagaatataatcaaagtgattttcagtgaaaaaattgtagcattaaatgtatatattagaaaaaagtttgaaaatataggaaataagttttcaacagaagcaagtacggaaaaaaggaaatgcaaattaaggaaatgaagataaatgcagaaattatcaaaatagaaaaaaccaaacagtatacaactaaaagtatgaacaaaagtataatcaagaaaaagagggaggccaggcacagtggcttatgcctgtaatctcagcactttgggaggctgatgcaggaggatcacttgggcccaggaatttgagaccagcctggacaaaacaccatctctacaaaaaaagaaaaagaggaagaggacaaagataacatcaagaatgaaagacaggtcctaagtacagttagagactaagaagtaacactataggacaattccattaacaactttatactgtacatttgattaaccggacaatctttaggaaaatataaatgatcaaagttggcctaagaagaagtagaaactgattagataaatcaacataggcaaaaatgatttggaagtcaaagatcaaaacccccataggcaccatgcccaaaccaatatacagatgagtatatcagtcagcttaggctaagtaatattgcaataacaaataacaccaaaaatcctggtgggtttaacaaagcagatgttcatttcttacactacattacatgcctactgcagtttggctttgtttttgttctaagtgttttcctccaggagccaggctattggagcgcttcctaaatggggcactgcaggccttgtggccgagggaaaagacggcagggcagaatcaggtcatggctctcagccatactgtttcacattcattggccaaagcataacacatggtttgcctgacgtcagtacacagggcttgaatgatcttccacaagggggggcaacaaacatttccaacttaatattgtctttacacagggcatagaagatgggaagcttctcacctcagtttgcaagactggcatattcctgataccaatattggagaaagatggcacaggaaaattgaattattggccagtttcacttatgagtaaatatagaagtttgtaaataaaataattagcaaatcaaatccagtagcattttttaatgcatccttgtgaagtttggtttacacaagaaatgcaaagatagttcacccttagggaattttccattcatcccaccattcattcaacagtgatttttgtggggctctcacttttcttcaaaaaactcttctaggaactagggatacattggtgaacaaaacaacggattgtgttacattaatagattaaaggacgaaaatcatattattaccacactggaggccaaaggagcatctaatagaattactgataaaaagcactcattccttttttaaaaagttatacttaatagaatacatgaatgtactctattaattattatatattatatattctattagtaatagtattagttttagtaatactaactactagctagtattactattagaattagtattagtattagtaatactaattgcttattagtattagtaatactcattagtaatactcattagtattaataattagtaatagaatatatatgataatgaatagaaaaagcactcattccttttttacaaagttatacttaatagaatacatataataataattatactattagtaatagtatatatattagaaaaattcctattagagccaggaataggcaaggatgttctctatctcagcaactgttttaacattgtattgagattctggccagcactacatggcaagaaaaaaatattaaacttgggaagaaaaaagataatcatcatttacaaataatattattatctaactattatacaaaaccgaaagcatagcccatggccaggtccaacttttaaacctggcagagttcagtgagatcaaccctggcggctttcctaagcaaaacacatgatttccatgggagcatatgtatgttggtaaaaatgctttaaaaattcgacagaccaacaccaaattaataagatggattatctttggggagggggtataggaccagaattttaggtgataagcccaatagggattttagatttatatttacattttttcaaggaagaaaatattttatgaattatgcattataatgtcagtttatatccctttcagcctgtagtctctcattagctgttacttgggacaagcaatccacttagtcagacgatgttattggatgcctaggatgtgcctcgcactgtttgtcacagtgttcctttcatgtcagcatagacgcatagttattatcccagctttataggaaagttaagtaactcgtaagttacttggtgaggaggggagttctcacgctgtccctgtgaagtccgagcacggtttttactgcggttttacagcggggggagtgtcttgcccagtgaggaaggagcggagctctgagtcagatccaaacagtgtgactctggaaccacgccgtgaaccggcacactgtggactaggtaacaccaggctgaggatccacctcctagaatacagcttgccatagagcagacatcccgtcagcacctgtgaatcgtgagaaggaggcggtggcctcatttaccgcatgctcaccttaaacttgcccacccggttttaggaagagaatgggcagaatggctgggttccccatggaggagagccctgccttagcctcgtctcttgctgcgtaaaagtccagggctttgcagagcctctccacagtcagcaaggagaagcagtctccagaggtggccccctgagccccagctccacccctgggaaggggccagaccacaggcagcaggccctggagcccgtgagcgctgcctacctccctgggccagtggacatgggaccagcatggtgaccagatttttggaagcccggtttaggacaaatgactttttaagtttgattgtttgatatcagaagttatataaaaggtacaaacattgcattatgcttagttttacatctaacatattatatttattattaaaattatgtgaagtcatcacagtcccagcaaataccatttatatggccaccatggctgagagcatccaccatctgcccctgatgtgtagagtaggccttttttccgtgtcttgtgttacctctttttggcttatggggtggcctctaaatgtcacaaatcctttatgcttttacacactcaggcccttcctccttccctgaagcctggtcctctggcctcagtcctgctgggtagggtgccctttcgtcctctctatccctggactctttcagtggaagcacaggtccccaggactgtgtcttcagttttctgtgtgggtggccccaccttggcttgagggaagggtttaggaccacttttgagtcttcctcatgaggtcagcatttggggcccctgggcttctgcattgggtggcgtcctctgcgttgggtggcgtcctctgcgttgggtggtgtcctctggtggggccaagccacaaccagaaggtctgaacttcctgtgtggccactggcacaagaatagaagaagaatgtctttacaaagtataaatattttattcatcaaaatgaagtaagtcagtttcacaaaggaattaaccactaaatgagtaatgtgaagttttttcagctcaagtaagcataataaatgaagtcagttagggttgatctttgaaaaatgttctgtgtcttttcttggagcatcctgagggctccctgtggtcagatgtgacctcaccaactacttatggtcatagttggtagctctaagcctagaatcctaaaaattcagagtgacaagtgacataattcactcgtctttgcacatcgcctaacacttcccacactgaccttcgcaggagccgctctgctcactcgcatggcctcatgggctctggcagcatttcacccccgcctgttggcatttcactctccagaaggacttggtgtcacttcagacgtagagagtttgttttgctgggctctgccagaatagttataaatcacacgtttctagtactgactccaggaaagacccagaattcagatttctcctgtttgggcccacatttcttctggccctctgaggtaacgggaagtacactatatctcgaggggtccgtgagacctgccaggcatggcagctcctctgcagggctgtgaggtctggctgtgggggccagactcacggtcagcccagaaagtgctgctggggataccgggacctcaccatggagaatgtggagtctgggcccagcatagtcactgatgtcagcccaggcaggtcatggaatgttttggacctcagcagcttcatctgtaaaatgggctgattgactgagatcgatagcatgtaaacacttttctgaggaggtgctattccagatccctgttttctaaccctcagcaggctctgctgttgtggcaggcttttgttgagatgcagagctgggccggcctccgcagcctgtgctgcttaaagcagagggggcctgagcctaccctacctgttcttgcccgacatgtccttcttcctccgcaagccagcccctcacagggattcccgtaagatttctctgggaagaaaggcctcattgctttaagtttgaaaagcatcttccagttgataactggggaatgaaatagatactctgagacccaaagggggctattgacgtggggtgatgtgacaaaatgtggatacaaaatttcacaccccagtatgaggctggggtgaagctaagggagtaaggagggggctatgggctgtggcagccctccctgcactaccacacttctgtgcagaacttaggttccagaattctaaattaaacctggccttccaggttgttggagggtagcgagatggcatatagcttatttaacaatgtgttagcctttgttacaattttccagcatttagatatatggtgtaagctccttcgtctacacttgccccaagccttgcaaagattagttctcttccatgagaaaaccaaggcacagacatgctcaaggccatgtgatcaatcacatcatggcagccagagacagaaggattgtcctgaggcacaagtctccacatggggattttctgtgaaagtgaattttgccgctgtagtgactgcatggtaggtattcacgaggcctggctgtttcgaaagggaaacaaaatcactttggtgatcaagtgcaggctttaaacagtaggtggtaggattttaagctgggcgagtaagtaggtctgtctgtgcaggggtgtgggtcagtcgttcttaagctgctttctgtttgtgccaggcttgagcacagggacaaacacatcagagctcatgggagccagttccccactgccagcagggagttacagagatggaagaggaggtgaggatgtgctcagggtgttgggttggcattggaggcgtcagtatgaaccgatggctttcaatagagggatgtgtggatggagagatagacatagcagtgtgtgcgtgtgcatccacatttcccagctctgtccaccagggtggggctggaggcagggaaaccccagtagcagtgagcacctgcatgtccagattttggtgtctatacctcttttctgtagagggtgtcaggctctgtggagcaaagactaattcctgggctggagtgggaaaaacacaggatgaagctggagcttcgcttttattttttttcacaccagaaaataaggcagtgcttaaggcatgatgaggacacatgagcaggatacaggtgccagcctgaaggagggactgagcttccaaaaaagaaaggtgttcatggggtatgagccatggactaaaataaaaacccagcaagtccacactaacacagataaatggctttgtagtaacaggaggggggctcttagagcagaatacagctgaacagtgcgtcaggaaatcatcagagggtgctaaagttgtggactcaggcttgatgcgaagcaagacacttacagagcctcggggtagttctgcacaaagcttattatcaccagggaaccctagaaacgacagcggacaaatctggtgccccagccacatgatgagagccagcgtcacccaccctgcagtaaactgacaccacgtgcctcctcagaggaggtcccagagggacaccgcatggcttccagggcattccagccagtcacaaagaaacatcagccaagcccaaactgaggggcagtcttaaaaataaccagcctctgtcagggttggaaccacagagaggctggggaacattccagatggaaggagactgcagacacacagcagcagccaccctgagttccaccctgctctggggaaaagagctggaaaggacaggattgacgaagctggaagatggcttgttaaatttcctgattttgatgtcggtacttggttatgagagaatgtccaccttcttaggaaatctacactgacgtgtttaggggcaaagaggcatgctgtctccaacttaatctcagatagtctggaaaaaggttgcgtgtgtgcaggtgtgaacgtgtttagaggaagggagaatgggcggaagggagagggacgggatgatacagcaagcaggaagaatgcggacatttggtgaatctgggcaaacggatatgggagtcccttttattattcttataatttttctgcaagtttgaaattatttcaaaagaaaaagttgcccccccaaaaaggatggcacacattgtctaggagagggctggtttgggtgtgaacaaaggtttcctgtggcatctcggtgctcgtatgtcccggctcccccataagcacatttagctgcactgatagtgcctacatctgggcttcggccacttgcccatcttcattctcctggccctcacaacagccctgcaagcccctgccagccgcagatggacacggggactgaggcccacgggactgtggggccccgccgaggtgaccggccagaaaggagtgcagaactccggccagggcgggctcagagcctgcacccacgcctcctgcctgggccgccctgtgaatgggggagaagggcttcctgtgcctcagaaactggaggccaagaagcacatgatggacgggtgggccgaatgaggccaagctctgccttctacagcctttccaggacttttttcttggaaaatgtggagcttgattggatgcctttgtagtggagcttccatcaagttagagctgcttgtgtggcagtgtccatccgggagtcagtagatggggtcaacaaacagcgccttcagccaaaccctgccaccaaccagctttgtgtaatgaagtgtcagtgggatggccatgcccattcctgcagttgctgtcgggggccgcttctgtcctaactgcagagagtgcagtgtcctagaaaaatggagactgtgtgtcacccgccctctccagggaactttgctgggcctcacctgtggtgttagcggatgtttcctaacccttgaaccaagacccaggagatcctctcagagatgaggccctgctcggcctgggggcaggagcaacagaggtgggtgtggcaccccacctcggaaagggaccaccccatgtggtgggcaggccgcctccaggatgcccacaggttgttcagaaatgtctgtgagttggcatattttgcttggttgtaaaaatgttccttatggttcacaggtggtccagtttggtatagttgcttatttcctaactaaatacatattcctgataacacgctgtttgagtgatcacctgcttataaaaagataggttttatatttatgggactaaaaattttttaatttaagttacatgtggaaagaagagttaaaaactatacaaaaagcctacaagtacttttttttcctttgccactgcttgtttaataaagcacaaattgctgaagtggagtagcgtgttgggaggccggggttccatctgcagtgtttatgccacgtgcagtcacctagctgtgctcggcccgccttcaataattcaggctccgtggcggcagcagctgaggggctgctgtgaattatgcatgcgtcttcggcaaggcttcgtgcgacgtctcctgttggcttcccatccgtgagcctgcgtgcaggcagggcagagccgtctttgtcagccgtgtgctgggatcgcgggagaaactgcaataattggcctcctgggagtgtgagctcaggagcaatgtccctgtgtgggacgcaggcctttgctcggggccgcccgggctctgccggctgaccctggtatggactcagaggggtggtttgcagtgcatggttggaagtatttggttaagtggcatcacagtggctcttatcagctctacccaggtaaagtcccttgtccccatctgcgtaccttgtcgcgttgtcaggggcacactgacttgtgtggtcttcaggtatgtttgccgcagcgggattgtgtcggggatgaggggcccataggggtgcctgtgcagtgacgtgtttcgtgatctgacttggagttatgacttaaagagtcagagtgtttgaggttacggtttggatgagataacaacgggcccgggccgtgtgttacagaactaactgcaaacttttcatcttacggtattaacatttgtaacgtaacctacatgtttgacccaccaatatatacatggcggcttttccaattagcagcaaatctaaacagactttaaactctttttcaccaggaaagcatttctttgactcagatgggtcagttgaaagaaaaaatcccacaacaataccgtaaactggaccgtgttctctaaggtggtgttgggatgtgggctgtgttttgtggatctcttttcttctttggcttagatcacaagtgtgggtttgactcacgtgttcagcaccagagaatcaggcaagccactgcaagcaggccagtgagttacagacgtggtggcatccctcccgcgttctggccttggagctggggtcggaatggtggcttgtgcaaggaattttattttaggtgagtgctgctcagggttcaaggtcaggccttctgtgactgtgcactattttccacgtgacgagaacaactccagagcacatgaaagtgctgtgaattgtgaaatccataattgaaagtgagtgttagagaggagacgactttccgtgtgtgttgagccacgtagcaaagaaaaatggtgctcagggggctctgcctcgcacctggctctgctgtgttcctctgcaagtcacctgcatgaattttgtccagatggaatcgtaaaaattcaccaggagagcttatgattgcaagaattccgggtggacgttttccggtagccagtttttgaaaaacgtgtgtgttgctggagattccactgtcctttgcgaatcgctggactcagtgcctggactcaggagggtccacgtgcccagcaggtcccgtctgtgccctcgggaagctgaggagctgggtcatgagttttctgtcctgatccttaggcaggggtggcatgggcagccggggctgtggcccagaggcttctctttccggctcctccaggtaatgtgtctgcttcctctactctccaggctcctgtgcttgagttgaggcccccgcttgctgtggcctcacactgggaggaattactggagcacaattcctatgtcagcagaaagctacaaaatgagattgtgtgaagggggcgtggctctcacccccagcagtgctgggagcaattggcaaggtgacgcctcctgtctttgcaataccagagaagagcatggactgcaacctctttcccttccttggaaatggtttatttgcagctaaagcaactctcacttgagtgggtcctggagcctgggcaggcccaggagagggtctggcacccacaccgcccccaagccatgcctgcatctgctctctgccgtgctcctctgtacccgaggctgtgctctctcaggagggtctgccatgtggtttcctgtacacagcatctgcctctgcaggaccccaagggcaggagcaggagcacactggggagggaatgcagattccctgggcgggcacaccaggcacaggggagccgagcacaccagacaggtcatcatttactgtttaaaatacaatcatgtttctttcttgattagacttttaaagggtcagttattgatttgtgagtcttagaaaataattagtatctgccaaaacttttgaacatgatgttagtcaatacaccagtcatctttcactcagaatttatatcagtcaccattcattcattccacaaatacaccagtgtgggaatggggagagcagccctgtgggtagctggtcccattgctgagggaggcggcaaggcctagggagtggccagggaacaggggaggtgggcccgggggctggtgtgggacttccacatggtaccagggagaggcccatctcccctccaccggcagcaagggaggcagacggttcacgtcaccgtgcttgtgtgttggaattgaaacaccttttgtttgaggagcaaaagcgtcagcaaccgtggggggttgagctgtgccagccacagcgtgcagtggggcagcctcctttctgcctcccctgtcttcccgtcctggttcttcccagggcccctcagctgggcctcgcctaggcagcctccaggccaccctccaggcagccagagggaccctgcagtctcttgctcatcactgtcccccagggtgaacttcgtgctgctccgtgctggctccctgctctgcccagctcagcgtggcttgtcctgtcatggaagttctcccttgctccctggaggccagttaacgtctatttctccctcagttctcagctagcctttattgtctcaggaaaaaaagctggaggaaaaatgtcatggtgctcataatgcagaaacttcattcatgaggattgcctcatttgtcagcataaaatatagcaaggttagcaacactgctgcctcgaattctgggctcaagccatcctctggaatagctgggaccacaggtgcctgctaccctgcccagctaattttttaatttattttcattttctgtagagatagggtctcactgtgttgcccaggctggtcttaaactcttggcctcaagtgatcatccagcctgcatgatcttattttttaaataggtagtatgtgcccatgcactggaatgtacacagaacaggatcggcccccgaggctgtttctggtgcagggcgtgccattgtgtattctgtgcctttgggggggctgtccagccagctctggtcttccgtctcccagcactgggcgggaggtcctacagcttcaccgtggctgatgaacgaagtgcaccccggcagcagtagccggctctgggcatttatacttcatgtttgatcaatataatcagaggggttgatctgcgtttgctcctcccagcagtgcagaaggtgcctcttggctcagacttcactgccatcgtgatcttggccaggaggatggctacaaacagcctgaggcttaggctcatggctggcgttctgtgatgaggccagtgaacctacgagtgtccgggggcctcctcctacctggtggctgcctgtacccttctgttttccttttggcttgttgatggttttcttcttggcgtttaggtgctctgatgtagaaaagggagccagcccgccacctgtgtgatgtgtggccggtgccccacagtttcctgtccagggacttggctgatggtgcttttccctactgagatttgcgcctctgtgccgtgcactgtatcagtgttgccttcgtggctctgggcttcgtgtcttccttccggaggctttcctcactccaatgttttaaaagatcatcccacattttcttctggtatttctctaatttacacttaaatctttgattcattgggatttgtttcagtgtgtgctggaaggaagagatccgactagatagtttttcagaggtcatcttccccgtgcaccccactcactaccctgaccgtgacttagacactcagggtttgtttctgtactctgttgtgtcctgcaggtgacaccgatgctgtcccctgcgtgttcgggattgtggtctgtgtgtgttctcgtgttaggcctgtctggctctgcgtgttcgggattgtggtctgtgtgtgttctcgtgttaggcctgtctggctctgcgtgttcgggattgtggtctgtgtgtgttctcgtgttaggcctgtctggctctgcgtgttcgggattgtggtctgtgtgtgttctcgtgttaggctggcctgctctggcgtcttgctcatcttgtttgttcccctcatttctgcttagctttccacgggagctttcacgctccacttgtgtggttctaacaagacacccataggcaagtatcggcgtgatatgtccatttagggagaattcctgtctgtgatgttttgctcctcacttccctggtgacaggatattaggcaagcacaaagagtcagcccactccaaggacccctgccccagagagagtgagtgtgcaagttgagtgtgtgtgagagtttcacacctggcttacatgcagaacggggcacttgccacatgggggggagtcttggatgttgggattctttgagggagcctcacatggcccctgtccttctgtccttggccccagccctcctggcttggccgccctgtcctgcgtgtgagcgctggtgcacgtcttcttgcagtgcgtgccgccccttccaccgcagctcggagtcagggcttccgtgtgagccccagccgcaggcctctgaaacttcagtgcgtgctggcggccaccgcggtcacacatttgatctataacagatcaacagcatggtggattcaaggaaacattaccaccgtgtttctgatcctatcccagaacttcctttcggtcttcttttaatttttttctatagcagtttacattatttgattattctttaacattttcttttttaatctaaatgctcttcgcactttgaatgactcctgccgagcgtagcctctggctgccatgctgaccatgagggacactgttggatcaaagccctggtttggtctcctgggctctagggctccacttttctctggattagcggggcccacgctgtggcctccttggaagcctcctgccaggcctctgcctgtcgcctacagcacgtctgcagactgggctgaatccataaggtttagtgtcgcttctgcccctgagaggagttgatgctgcctcactgaccccctcctggtctctttctacccctggccccttgctgataataagatgtgttctatttgctggcctggagctggagcccatcagctcgtccgctgggatcagtcctgtggccttgactttacagcagtgccagcctgggcggcttatcctgcgcaccgtgccacaggaggctggtgaaggggcaggaggggaacatagcgtattttattatgctgctgagaacattctgtgaggctgctctgtcagtcagctgcattccataaagctgcagcagaaaaccaagcccaaagcccagggcttcttaacaacacaggtttagtggccaccttgtcacacgtcatctgtggtcagcagggcatggctcagctgcaggctaaggacagcccgtgtgggacaccctatgctcacagaggagacatacgtgctctggcacggtgggcagcggtccctgaagctgggctcacactggcccacatcccttcttgggctcaggccaggccggccactctgggacaggggcgcccccacactgctcacgtcaggagggacggggcgcccccacactgctcgcgtcaggagggacgggggcgcccccacactgctcgcgtcaggagggacgggggcgcccccacactgctcacgtcaggagggacgggggcgcccccccacactgctcgcgtcaggagggacgggggcgaccccacactgctcgcgtcaggagggacgggggcgcccccccacactgctcgcgtcaggagggacgggggcgcccccacactgctcgcatccagtggacaagggtgatgaacggggatttcctggggacctcccttctctttattcgagagctcaggagatactgggaaccaaaggctactgagggccgttttgcagacacgtcaggcaggatccggtgtcctgggagcgcgctgtgccatatcccacatcgggtctcctgtaaatgagccgccgagccgacatgcgtggctgagggcttagctctggacactgtgcctgagagtttcgtgttgagaaggagcccacatgcagagcagtgtgcagtcacgggtgtgtgggcttcgcatccggaaggtgagcctcgtgcccccttcgactgagcacgctcccgagggcaccgtgggtcaggacgtaactcacgtggcatacgcggcgccccgcgcccagctgctttcgctctagcaagcctgtttgggaaacatcttgttgccatgatggtcttagtgctctgtgtgcacatgctcctgtgtaaggttagttgcttttcctgttcaaccctgtggctgtagtttgttgttgcttgggcgagtgtgcacgtgtgagcatatgagtgtgcgtgcaagggtgctgtgtgggcctgcacatgtgaacatgtgtgtgtgctcgtgcacacacatgtgcagccgctcaaggttggggtctgtgttttgttccctgctccatccctgtgtgtagaatgcactggcaggtggtaggtgtgctgtgcatagttgttgactgaatgggtgttggaggggacagagcttgctgcgtgtcccagggtctcctgtgggcgggcagagcagtcactgggccggggcggagggcaggggtgcaggtgctgtctgtgctggtcccgcagagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgtgagtagggaagggcccaggagcagcggagcggtctgtgctctgcagagactaccgagcaggatctgtgggccgccctagagacagcggcaccctgcgggccctgagcagccccgtggcaggggtctcccctccctggaccgccaccctctcaagagctcagaggagggtgggttgaatcctgcccctggttctgcccccagggagcgtccctggccctcccgctctctactggggtctctctgcagcccgcagcactggagcttcctatctgtgttaagaagccaggtgcctgttgccagctcttcaaagagatgttttgcttttggggaaacagctggaagcagcagtgcggttccctaaagtgctgggcagcgatgaggtttctctctccaggccctcgggcagctcactgagcagccagtgaccccgtggtttctgtagaaggggaagtaggaaaaaggaggaccctgtgtcagtgttaataaatggtgtctttgtctttcttaggattttctaaggaaagaattcagtgaagaaaacattttattctggcaggcctgtgaatattttaatcatgttcctgcacatgacaaaaaggaggtaagtccacgcttgggaagtgggggctgtgtgagagtggcgtgtgagagagacgcatgtgaggggtgtgtgagagggccacgtgtgtgaggggcatgtgaggggtgtgtgtgaggggcgtgagaggggcgtgtgagaggttgcgtgtgaggggcgtgtgaggggcgtgtgtgagaggggcgtgtgagagggacgtgtgagagggccacctgtgtgtgaggggcgtgtgaggtcgcgtgtgtgaggggcgtgtgagaggtcgcgtgtgagagggccgcgtgtgtgtgaggggcgtgtgtgagagggccgcgtgtgtgtgaggggcgtgtgtgatagggccgcgtgtgagagggccgcgtgtgtgtgagagggccgcgtggcctcattggaggctggctcggtgcagggagcatctagagcagttggaaagtggatgataaaatattttcacatggcttgaaaaaaatcatttctttttcagaataaatttttaaatatacatgatatttaattttgcctaaacctggtttgtataacgccctcagccacagctttcacagcagatggggtgtctttcagtgtgctggaattctgaggaaggaacgtgtatttaggggaatttgaaagcaaattggaggcaggagggcatcccgggccgtgctttcgcagctcctcctgcgcctcgtgggaggtgcaggagaagcctgggagagacgccttggcctggcccggcctggctgctgtttcctcagttggcctgtggcctggcttccaggcttcggggctgctttcgtctgctcgcaatgctcagagggcgctgctctcctgcactcccaccttgccaagaccaggtgtgtggcgacacacggcagtattgcccctgcgcagctgctgctgggctagcatcgcccgggtctttgggacactttaagtatccgtttaaacaatcgtagaggagcccgcgcagtgctgctgcattctggccacacttttatttatttattcaagcaagaggtatttactggggcccgtgagaacacatctgtagagcccgggggtgtcgggccttggcaggcagcaggagtgcggggagaggaagccttgccgggctgctcaggtgcctttcctgtcagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcaggtaaccgcaggctgtgggagcttgtggggagtccaggctagggctcggggtatagggtccaccttcaaagaacacgtgctatcaggcaggccagtggatcgagagcatcacagacgcaggtagagaaacgcagacagaaagtggggctttcagtagggtagagaaacgcagacagaaagtggggctttcagtagggccatgaaataagtcccgaaccactgcgtgtctgtctgcaatgagccggctgttcacgctggctcatgtttcgatcctgtgcgtgtgtggaatcacacctgcctgggggatggcgcatctgcgtttgaagttttgcatcgtaggacattgctgtggtcatgggcattaggccccaggctattcgagacgtgcctgtgcatgtcgctgcggcacgtgggtcacgttcacagaagcatagggtggcattttcaaagcagtctactgtaagatttctagtcgcttttggttttaatcttatttaacaaaataaaagttctctggggtctgctcgtgttgatggcttctgtaagttgtcaggattcacttaattttaagagtgataaaggctggttcgttatgagaaagaagactcagatatagaggcacactggaaataactcttaagtaccctcagggctggcgggggaaaatggactgaaacgatgtcctttcaggacagggccagtggttgcctacaggtcgccaagcagcctcgcgcctgaggctgcatgtctgggtccctcctgtgactgtcccaccttacatcttctccccagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaaggtgacctccccgaggctggcctcacgcccctgtgggttgtgtgtcatcagctgagagctgttctgtggggagtgaaaagaggccctgtcggcgtcttcaccagtggtgggtgacgctccatgctggaaagttccagctgctgtctggagtcctgtcagggccacaccatgacctgtagaagtgataccatcccatagagtgcttgtgtttacagctcagtattgcctcctttgcacttaacgtaatagtaaaataacttcacattgttttaaccaaggtttccatttgatgacagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacggtttgtggggtggctcctgggctgtggtgtccaggccaggcagccgcgtccccgtcctggcgtcgctctggtggttggcggtgaccttgggccatgtgtgcagtgagaggccctgttggcgggtcgaggaagcttctctgaatgaataaggaatgccgctgtgtctggggacacgacctgtcagccagccagagggcagcagggctgctccagaatcttccagagaaaagggctcaatacatttcagcccatgcctacctcaggcctaccccacacagtggcggctgaacatctgtgtcctctcctgcttttcactatccaagtaataggtgtttttggtagaaaatttggaaaatacaatcaagtaaaaataggaacacacaaatgtgctattgggtgtctcccccagtggcagcttggttctctgccagggctttttcctaggtagatgtcagggtccatgtgccttttacatgtgtgtggttttttaaaatgtagtagcatagttggagtagtgagcatttttcaagttaagattggtatttgatattgggggctgcccattctggatgctctgtcccttttttcttcgcacatctgagacttcctgtaacaaaagttaggcagagagacggctcccagggcgccagggggtggggctgcagggcccttggcggctcctggccgagctccagacaccagccgggtggttttggcgggtggcagggcagagggcatggagatgcccatgctgaacgctggcgaagatgaggctgttctgtaccaggtgctgaaaagcacataggggagaactgggaagattttcttctctagagatttttgggaaagggattagttttcaggaatgagtgtcctgcctgaaggcaggggactggcacttagcctgtggtctccaagtttaaatcaggcagtgaggtgattgcgatagcaccagctggcatggccctggtggaggcaggtgagcagggtgctctgcgctccgtggctgcggctcctgtgtgtgccctgcagtgccaagcatttgtgcgtggctgctccccgcctgcagggggaagcgttgttcccggggcgctgaaggacgcgctggtgagggcttgacgtgggcagccctgagcttctggccatgctgtgaggtgctcttctccgagcaaaggcagctgagagttgcagagttcacctttgtcggaggccacctgggagatggacactatgttattaggtggggccaggcctcccgagtacctgggagatgggagtgttcgcttcagacagtccatccactcgtgcccatccccatacctggcagatctgcaaagggctttgaaaaccttgatagagccaggcgtgggagctcacgcctgtaatcccagcactttgggaggccgaggcaggcggattgcctgagctcaggagttggtgaccagcctgggcaacatggtaaggctctactaaaaatacaaaaaaaaaaaaaaaaaaaaaaattaggggccaggcacggtggctcatgcctgtaatcccatcactttgggaggctgaggtgggcagatcaactgaggtcagaagttcgagaccagcctggccaacatgatgaaaccccgtctctactaaaaatacaaaaattagccagatgtgatggcacatgcctgtaatcccagctactcaggaggctgagacaggagaattagttgaacccgggaggtggaggttgcagtgagctgagattgtgccattgaactccagcctgggcaacagagcgagactccgtctcaaaaaaaaaaaaaaaattagctgggtgtgatggtgggtactttcagtcccagttacttgggaggctgaggcatgagaatcgcttgaacccgggaggcagaggttgcagtgagtggagaactacactccagtttgtgtgacagaacaagactgtctcaaaataaataaataaataaataaataaatgaaagcaaaccttgatagcagtggcgcctggtggctcatgcctttaaatcccagcgctttggcggtggggcgaggtgtgaggatcgtttgagtctaggagttcaataccagcctgggcaacacagcaagacactcatctctacaaaaaaaaattaaaaattagccaagtgtggtggcgcacctgttgccctagctactggggaggctgaggtgggaagaaaattgcttgggtcctggagttggaggctgcagtgagctatgattgtgccactgtactccagcctgggggacacagcgacgctctgtctctaaaaaacacaaagccaaccaaaaaataaaacccagactgcaggcacccccagaagtaacacattctgatcttggcccaggatgtggcctgggcatctgttcctgtggaaggtggctgcagtctgcaggccagtaggtctgggagctgccttcccctctctcctcaggccccagagcccatgtgcagcggtgtggtttgggagcaggtgctgtttgaaaagtcctgtgtccgaattttcatgatttgtaggttagcctaagaatatagttagttgaggttggtgaaaattgacacttcattacggttcatgtcaggacgtcagaggaaaaggacgtggaccgagtgggtctggaggccgcatccggctgagagcgctggctgttgccacagttgggggtttccagttaggcccagaaactacatttggggatgaaagctccagatggaatggaggaaaggcccttaccgggacatgcacctgggtctgtgctgtgtaactgcacgtactgatgtgatttgttgggcacctgccatgagccaagcatgttttggagccaggatgtggcagtagacagggcagagagtagcatctctgctgcatggtgggtagagccttgttggtccctgactggcttccagggttaggaagacacatgtgactcgtctccaccagagacggcaaagtgatgcctggtgggggatgggtggggggggcttcctggcgtctgtctgctcagcctaaagggggcagagggttgggagatgtgaccgaataaacagggttctgattgacgtgagtcactgtgtttcccctgtcaagacgccctgcatgccaatggaggcctgtgtcgccgagagtcgcagggctctgtgtcctctgcggggagcctggacctggtgagtcactgtctcccctcgtcccacaggcctcaggggtgtccccaccagctgactgatgacacctctctcccatggaaacctgtgtttacaaaactcagcgttcactttgtaaagctgggggacaaggctcgggtgccggcccaggcacagtggcaaagtgcagggtggcccagtgccccatcaggccccggcctcatggtcccccagcctagggctcctgagagggcacgaaaaactattagttatacgagggagggaactcaaagtatctttggatttatttcttaagtctttttgttgtaatttagtttttgtgaactcccactaagaatcaacagaaggtgtcgaaatcaggcgctccctgtctcagcgcgtgagcatcccacccactcccacactgcaggatttacccctctgcctgcgggccgcctgtctcacccacaccctctcacacctgctcactgcttggctggtgctcgtcctggccccagtttccagcagatgagggagatgagcaggcgcaggcaggactcgtgagcttgttagatgttgtttgataggaattttggaaaacctcactggttgccagcatcctggtcatttgaaattttcaggcaggaatgaatgtagaatataatttcttcttcagttgttccaaataacattgaaagctgtaaggatttaccaggtatcagttagctcttgttgcctaatacctccgcacccccaaactcagaggctggaaacaattactgttgtgctgggtgtctgggtcgcctgggtggttctgcccattctggccggccttgccgtgtgtttctggttacctggcacgtgagccagctggctggtcccagaggccctcagttgcatggctggcccttggctggggaaggagcactgacaggacccttcgttcgcctcactcagcggaggccagttcaccccgtcccacagccggctcagggaccctgacagtgagcagagtaaggacggcctctggaggcccaggcttggagccgctccttctgcccacccaggtctgggctggggctgactccacctcttcatgggaggagccacagagccgcattatgaggggcacagatacagggaaggggatggttgggaaccacttgtgcagccagcctaccactgtacaaactagtttcctgaaataatgctcagggaaaagagacctcagactaccggaaggcagtgccgacgaagtcacagtccaggcgacgtttccattggaacgatgtgcatggggagctgtgtatagagaggacagggtgctggaacccagagccctgggagggagtggtcctcacagggcagcttcagtgggccccgcaggacagccctgcttctgggtggagaagcccagatgtgccttctgagcacgatggcccttgaggcccagagctgagagaatgatgaccgctctctcgtgttaattcacaaaacccagcacctcaggcagtgtggactgagcctgagatgtgtgcacctggggagctgcaggtgggaccgtggcagggcgccagcctccccagcacgtgcggcctgggccagctgggctgctctgggaggtgccccgcacccctgtgacgctggttccctcacggctgcttgtctcgctgctccccagtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaaggtactgggcccgcctgaccctcgtgctgccctcaggccatgacctccccgctccctggcccccagctttgtcagagtcctcaggctgccccctcctgcgctcctcatttcaacagcgcctggggcggaggccggattatctgaactgagctatctgctgggagcactttgcacgtgggtgctgggttggtgtggaaagggtgatcgctttctttggatggctgtttttgaagctgctcttctgctctgcacagctgtgtgcctggggcacgtgggtctgcgtttggggggctgcctgctgtgcccacgttgattctggtctctctgttcctcagcctctggtgctgcaccaagacagtagcatcttggagtcaagggacctgcgcctagaaaagcgcaccttgtttcggtaagaggaagatcgctgtcattcacctgaggctcccagagccaaccccgtgtgcccaccacctgctggtctctgcgcttagcgggcggcctgtggatgctccatgctgggctacgatggggtgtcggggcggggggagggtggaggcccacacgaggcagcccccctacaagcccgggggtgagaggcgccctctcctccctgtcccgtgaacagggactgccctggcctggtgagcccagccccctaagatgccgagagggaggggcaggagtgctctctgtagggtggatgccccacaggtagccaggctgctgtgcaggacactgctatccctggaggaggagaccatagcccttgcttggcctgacttttcccacgtggaggaaggcacgttctgatcagctggggctgaactggggggcacaccgaggccttgagggcggcctggggctgtgctgtagttctgctcgtgagactgatctcctaatgagggctgacatgagttggtagtgaattttttcatcccccaccaggctggatcttgttccgattaaccggtcagtgggactcaaggccaagcccaccaagcccgtcacggaggtgctgcggcccgtggtggccagatacggcctggacctcagtggcctgctggtgaggctggtgagtgttgcacggggcccgggcgtcgtcaccgcaggcactgtctgttccctttggcagcctctgtgttgttcactgaagagggcacaccaagaagcggtgtcttcccctgatctggttgtcccccttggaggagaggagacagcctctgccatccccagttctcgttctgtgcagtgggagccatcatggtttatttgtaccttggtcattccaaaaagaattgatatttgagaggtggttttgctccagggaggccaaaatgagaaacaaagcaaccaaccctggactatcctccgctgttggccaatgtgatcagataagagagtgcggatggccctgcccccactgcacctgctgggcccgggcattgtgctcatgcccccagtgcacggtcacatggagatgtcctgattctcacctgcactttgtagatggaagaactcagctggcatttccaggctgcgccattatgatgtgaatggggttaagaaagaaaacaccgcgtggggtggtgaccgcaggtgctgggcaggccacgcgagatggcgagagctgggccccgctgagggtgctctggagcgtgggggttccgggcacagtgtctgcctagtcttctttccttgaaaactttattggagcaatgatttcaagtattttcaggattttagttttccctgaaactacactcaaaattattcaagagctttgaagtgaacaagaagaacctattaaattatttacagacaccacctccgagggtaacctgaagcctcttccccgcgctgcaggctccatcctggagtccagaaatctgcaggtgggagacagacctggcctggctcccaggtgtgcccctctggccgactctggggagacgctgcgcaattgtttagcccctgtgtgtcacagtttccctgactgtaaaatggggttggtcgtggcagcgtgctcgtggcatggttggggggcaccagggtggaagggctggctgcggtcaggctcgttccctgtgagctgcggccctcggctgccgaggctgtgggggctatggaggattcgtgtggaatgggttgtttgggatgtggcttttccttggacgctgtctcctgacctctccagtgaattctgtggccccctgtgtccacgaatgtggtggagaaggcgggacctggggcagttcctctgcttcccccgcagggcccaccacgcctgcccagcggaccagccccttcaggagcttagagcctctcccgcctggcattggacagctgtcattcccctgactgacagatcgtgaatgccaaacatgttcagatgtcttttcttaacagtgactatggcaggtgaagagtcagattctctgccagaggagagctctgatgcagagacaagaactccagcccggtggctagtggcgcttcatttcagcctcaaacctggtcctaaagttgtctgtctttgcttccttgtttacaaaggggaacatctgctctcagtattcccctcatagcagtttcgagggtcagtatttccctcatagcagcgtccgagggtcagtgttccccttgtagcagcgaccaagggttgccacctcctgcgtgattccatcgagcttaggatggtcgtgtagtcgggacccatgtcaggagcatggctcagccccagcttgtgtgcctcagtcaggcaggcctcacctcggggccatctcctgcgtgactccatcaagcctaggacagtcatgcagtcgggtgggatcacacacatctgttccctgaagttccagtctgggtaaattattcagtgctgatctctgccctagagtggagagaaggagcccctggaccttggcgcccctatatcgagtctggacggacagcgggttgtcttggaggagaaggatccttccagaggaaagggtgagtagggctggtgcagcggatggggagagggtgagtgggtccagtgcaggggagggggctatggagccggtgcaggggagggggtgagtggggccagtgcaggggaggggcaggtggggcttgcgcaggagagggggtgggcggggcctgcacagagtagagggtaagtggggccagcgcaggggagggggctgtggcgttggcataggggagagggtgagcggggccagtgcaggggagggggctgtggcgttggcataggggagagggcgagcggggccagtgcaggggagggggctgtggcgttggcataggggagagggtgagcggggccagtgcaggggaggggggtgtggagttggcacaggggagagggcgagtggggccagcgcaggggagggggctgtggggcctgcacagggtagggggcaggggttggcataggggagagggtgagtggggccagtgcaggggagggggctgtggggttggcataggggagagggcgagtggggccagtgcaggggagggggctgtggggttggcataggggagggggcgagtggggccagtgcaggggagggggctgtggggttggcataggggagagggcgagcggggccagtgcaggggagggggtgagtggggcttgtgcaggagagagggcaggcggggctggcccaggggagggggaggctttggagttagtacacaaaagagaattggtctgggccccctggtccctccttggtgccctgatctggcgcccttccctccaggcacaaaacaggaagccagggcagtaggcgcctgtgctctgcccggcaaaatggaggctgcaggctcggtcatttgggctggttctgcagttccttgcgtgcagggaatcgggcggtcgacagagctctttccaacgtgttgccttggtcatgacagtcctgccctggggaagctgggtccggccagcagccttcggagatgggctcgtcgcccggcccccacctcatcctgacgcgcaggagccggccctccttagagcccttgttgagaaccgtgcgtgaggaaggttactcagacccaggagggtgggtcctgtttgtagctgtccccagggacaggcagaggcgtggccttggggcctgcaggtgcaggtgccgtagggaggtgtgtcttggaaagagctttctggaaacccacctgcagatgttctaggtagagagctcactttgtgaggagccacttcaggtgacattgggctgcccctctgcctttcaggttgttggccctgatgatgtcacgcagggagcacgtggctcacttgtccccacccagggagacctgggccatgggtcccagtcagaagcaagcgctgaggccattagtcctggagctccaactcttgctcccctccccaactcctcacagagcagagacccttccccgagcccaccctttgctctagggaaagccttacgctgggccctgacacccacccaggcaggtggggcaggcacagcatgtgtaacccagcagggcggccagcagctttgccccggctgaccctctgtgcccagggcctgctgggcctcggggcttgtttgtgtacaggcaagtcctgtggtggagcttggcgctcagcgtttttgtagggctgtatgtggggcaggagcgcgactcctccagtcacatttgggccacagaaatgggcttgaggccgttagtgccagcagaggccagcctgtggccctggcatggggcaaaggctgtatttgaaaatatgtcatggactggcacagtggctcatgcctgtaatcccagcacttttggaggccaaggtgggtggatcacctgaggtcaggagttcgaaaccagcctggccagcatggtgaaacctcgtttctactaaaaatacaaaaattagctgggtgtggtggcacatgcctgtaatcccagctacatgggaggctgaggcaggagaattgcttgaacccaggatgcgggggttgcagtgagccgagatcgtgccactgcactccagcctgggagacagagtgagactctgtctcaaaaaaagaaaaaaaagaaagaaaagagaaagaaaatatgtcataaatgtaagactctgactttctagagaatatttatgccaaatagtatatgaaatgagcttttcaatttcaacatcactcctccagcaagtccctagttagatgtacggagcccggctgtgtgcgtggaggacgggccctctctcctgtcccatggggactcccctcagggctgtgcgtggtgaataagggcagcagatgccttgtggcttctctacagctttgctctcagagacagtaggagcaggttgtctatgaaacattcagatggatttgcgagtccctgaagtcataaagctttcttatgtttagcatccgcagataaacagaaaggtgtgccagtgaaacagaacacagctgtaaattccagctccagaaaccactcggctacggtaattccccaccctggcccaccctgtgccctgctcctctcgctgtggcccccgcctgccctgcgcagtgccctggtgcttccttaccgcctgcttatcactgtgtgtctcccccacgctccttggcggggtctctctcgtccctgccgatgcccagctccctcttacctgtgaaggactggctttcttttcttctgaggtgggagtggttgtgccttaaatgctattcttgtttgtaatccttatcattgcaatggtttttctgcaatgcatgtaaattctgtatcaatgcaatctatttcatagagccttctactctctaactaatgaatgatgtattgtcgtgtattgaaatgaaagtagaactttgactttccttctaatgcagggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagagggtatgtgaactttttaaaacttccacgtttttagtaaatgcacagttagtttccagtatagtcagtagatctgctttgagctgtcagcatctgggtgactgcggtccgtccctgtggcctggaagacatgtttctcccgggggcagtctgtgggctgttgggatcactccaccgaaaccccagttttgagactgagtgccaggcctcctagggcatcaggggcagccgatgtgagcagcactgtctgccctgagatgccagaggcccccgcaggctctgcctccctctcaccccagctcctccctatggccccaccactggcttgtgccagggtccccagcgtgactggaggcacagttagcattagagagtccaccctaggcagagctgggcacccaggtgaggggaggtggagcacactggcctggaaggaccgtgggcttgctgagctctcttggctgcgggggtcagtgaggaaggtcagcctgcacacccctggcctccaggagagacaacaggcacactggaagactgagatggagagatgagtcctttcttgaagctcctttttctccagaagtttataacaaggagaagcattgaaaacagagtcaaaaccagcagctgtcaccgtgacctgaattttcatccagggcgtacttgccagtccacctggcgtgtcacggctttgtcacagctggctgtggagtctgacctcacggtaaaactaaaacacacctccagcctttgttggccaccgagcacaagtaaatcacacgccctctttgaagcttgtatgtttctgagaaccagtgaagtcagagatttgaggttccttgtagttgttaaaaactccgagtataattccaatgctagagaaagcccagtttagacgccatctacctcgaatggtggccttggggcctgctacactagaaaacccagcccaggtaagaaaaggagagttctggaggagccagccaagaagctggaggcacctgcaggcccccacagtggctgggcagtgggaggcccaggggcacccgtcctggcccctcggggctgtggagcttcagtgcggagagggagagcacgtgttgcccccctctgccctaggcctgggaggaccaccctctgcccagaggcagtgaccccgagaggcaggcgtggatttgagggtgccccttcccagaccacccgtctcagggccttcctctaccacccctcctcgggttcattctgctcccgactttgaggactgcagctgcagctgggacccgggcgggtgcttcagatgctgaccaaccggaggagggggccagtcctcagagggccccaagtgttaaattgaaagcccaggccagagagtcccacagtttcctactcagacggcatcagcgcgtaaccgtgttgagtcaagcgtctcgtttgttcaagtctggacctcacacagcgtggtttttagggagtacacagctttttcagactcctgaagacagagtatgctagaagccccagggctgtcccttccgctgtctgtgggaagatagtgtggacggaaaagggctcttgttgacccacagctgatagggtgttaggacagcccaggatgagagctttctagaatgttctgcggtgacagtcattaatgtgaaactctctaaaacacggtcactctgggttttcttccaatagagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatcactggactggcttacaacttttctttctcatttgaaactttgtttccactttagaaaataataaaagtattttaatctaggggaaatatcacacatttttaggagattaagtggatttaccgtaatctactggcttttaaaaatataccatccactgaacaaaactcttgagcacctggtgtgctcccagcagcacagctgtgcggcgggacagcagaagagctggtggcccggtggcgggtgctgagatgagctggcctgctggccttcgggctgcagtcccgcacccacaccccggccctgcagccctggggctgtggctggctctgcgcacaggtgtggcgtgtgtcaggctgcctgggagggccagacagacccacgtggggggtcagttctcctgcctgccaagggccattagcacagaggtggtttacagctcaggcccagctgagcgccccggctgacatccctgacttgtttgtggcaggagggtgggtggtaccggccttgggaggagcaggtccccctgcgctctggtggctgccccgactgccactggccagaactggttccccgccccgctggctcctcagcccctgggcaggtgggtaccctggatccttggctcttgggctgtctcctaggaggagacccagtgagtgggagaaggaggtgggagtggctttggccataggtcgtaggtgtgtgtcctccacgtgcctgtccgtggcgacacaggacaactgctgaggacctgcccagtcttcctgtgatgttggctcaagcctgctggggggcgttgggacagaaactgctctgtgcagcttgcttctggaacccccactctaatgggattctctgtattggagagttcacctgcccatggcggcaaaggaaacaggctgtgaatgccgtggtggcctgatggaacctctttcacatctgtgggccggggcgagcctggactgagtgctgacctgtccgttttcagggtttaggagcttgggggtcatcccgggtcacgctctccgacgttgacagttgctgtgggatgcttcctcacaatgtggcagccgccctggacccagcgtccggggtgagaaacacaacaggaggtgtagccaagcccacgggctcccgccctccccattgccatggtgggcagcatgccggctacgcgtgggggctgccagcaacagccttgaggtagggggagtctccacagagctgtgccacaccactttgcccttccagcctcagtgccatgcactgtgccaccctgtcctagccccagtgccacatgccacaccaccccatcctagccccagcaccacgtgccatgccaccctgtcctagccccaatgccacatgccacaccaccccatcctagccccagcaccacgtgccatgccaccctgtcctagccccagtgccacatgccacaccaccccatcctagccccagcaccacgtgccatgccaccctg

SEQ ID NO: 12161 - DNA, 9728 bp, Human
tcgaactcctgacctcaggtgatctgcccgcctcagcctcccaaagttctgggattacaggcgtgagccactgctcctggcaccgtttattttgctttctttatcagagcaggagaaagtactagctcaggaattgggagataggatccaatttccagctatttcctgttccagtacacttaactaagagtgcctcaggtgtacttaactaagagtgcctcagtatacactgcctatactgtattccaagaggcacaaaagactcactaattttccttattgctagcaatcccagtatccctattaagtaaaactgaaagctattataacatttattgactgctgactacatgttgagcactgtcatataagcaccttatatgttgtcacggatgctgtgcggtgccacccagatcccgtcttggggactgtgatcatcatttcccagggtgttagtctctctccaggaattgctcttgacaaagggcactgccttaagattaggctgtcttcttgggcagctgtatgcaatgaatggtctttatggggttaccagggccttgtcctcttgcttcagtggacagttccaaagggccagctgagcttccgggcattccttggaaccagctggggtctctgttgaaatggcatggccttcaactcctccctctgcccagacctgctttctttactccctcttaattctgataactctccccagtaaacctcctgcatgcaagtgtctacccgagtctagttcctaggaactcaaactaagaattaatttatttagttctcacaaccaccttatgaaataagttgttctcttcgtagagacaaggaaatggaggcatagaaaggttaagcagtttgcctcgtctcccatcagtagccagttaacagtgaacgtggccttcctgcagctgggtcttcagcaggtcacctggcagagccatgacttgaaacctgaaaatctaactctagaccctgtacttttaacctcacatacagcctcttaatagcaatcccaatgcctttatgggaagatgaggtgagaggaagggcatttattacctttatgtcagagatggagacaataaggtattaactgcttaaacccaggatcgtccacaggtatagccgtgaccgggtactaacctttgtgtgtgtgtgtggtgtgtgtgtgtgtgtgtgtgtgtgtgtgtgcaatggaaaaagaatggcaaattcacatttgaattttggagccaacacttactagctgcacatctttgagcaagttatttaataactaagactttgagcaagtcttacttatgtgcctagcacatagtaggtgttcaataaactactcatccctattccacttttctgtcatctccaactgtgatcttggacaagtttatttagctttctgattctcgatttcttcatctataaaatggagatgatgatgaagagcttacttagccccgtgtccatcatggtaagagcctcgtaaagggtacttatcagtataatcagatgctgttttgcccaggtttgcaccctgtgcgcctgtcctcaggacccagcaggctcagacttgcctgcgatcaaagaaagccctgtgtgcctcccagacccaccacccccgtgcaaactctctcaacacgacaccgctgcgtgactttcctgctgttactagaggtcggcaggtacttttccctaggaaactgggtgtgcacgtctcatccccgtgccaattctcttgccgcttttccttccacacgcggcgtcctctgggcggagggtgcagctccgcgtgctccagctgccgcgaaagttgcacccggcccagtctggctgcgggccccgcctccgccttctcagcgcccagccccaccctccgattggtcagcagtgcccagccccgccccgctcctccgaggggatttaaagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagaggtaaggggaggttgtccaactgcttgggggaagtcccaccaactcttagggagtggagcggcaggcctggggacctgggtgggcgcggggatggggcgctagaggcttgagtagagaggtagaggcgcacttgatgccacgtgctcagattccaggagcagggagaaagcaaggggaagggaagcaagggcccgcggcttgctgccatccccatcctctgacaaactgcagtcgtgctcaggtgacctgctgaagacccggctgcgggaaggccacgttgacatttccaggcagcactgagcctgcccatttcttaagcatttgtttttcattcctcagaccagagctaggggcattgcctcctctgcccctggaagacagggagatttttttttttttggtggggtgtgtgggggtgggggctcccactgttgagggtgtgtccatattccagagagctactcaacagcttccaatccttactggctgggaaggaaaaagtaaagatgaaggcaggaatcagtttcccacacagttcagaaatacttctgaaaagaatgctgagttcttttctgaatcaacaggcacgaagagagatcagtgtgactttagggaaaagcccatatatgcagcgtgtgtattacccagaaagtgtaagacctaccacagcatagctcaaacattgcttttgttgctttggggttgatgatgctgataagagaagcactcttggcctggggacagccaagagtttccaggaactcttgaggctaaagtttgggtggcaccacccagagctcttctgggacccataaacctctccacactggctgagcaaatgagagaatgctttcatgttcctgatttgtttttcagagccaaagagttcaagacacgtctggggatctttcttcacaaatcagagctgggctgcgatactgggagtactggcaagttcgagtggggcagtaaacacagcaaagagaagtaagtgttgctgaccagctcagggctccgagagggaagggagtgggaagggagtcatgaggagggaaatacagggagaagccaggacacgctaagtggaccttggcaacacctccctagagattttagtgggacttgttgctggtctgttatgactacttggctcatgggtgagtgggtaggtggctccagggctccaagtccatccacggatgagggcacacagggcatgaatgcctagttcccagactctcccacctcgggattcattgcacgtgcatccagggctaggacagaatccaagaccacttgaagttttctagtatgcaccttgcctagaaactctttcatattggctatcaactgtaccaaactctggagttatgtgtagatgtaatctctatttatgaggaccttatttccttgggaaggtgtacaaaacaaatctttgagagtcaggggaattgaaataatttttggacagagacgagacaggcttagagatattgactgaggactaaagagtccctggctttgatttctggttgctgaattgtgctctagaaagcactactgcttaccctaagtccaactaagagtttgaggtgtcagcttcagcaatcaccaagcaagcctttctgtgaattttatgcagttttccatcagagttctggctagaatttgtactatgctttggtttgttgattttttttcttactctttttttttctttttgtcttttagtagaaacttctcagaagatgtgctggggtggagagagtcgttcgacctgctgctgagcagtaaaagtgagtaggagccttttgtgtctgtctctgggtggcacatgtgtactcatgtgctttggagccagccccaggactgctgagagcctgggcagaataatagtagtagtaataataataataatgatcccctagtgtgccagcctctattcaacatataaaggcaggtcattgttcaagaaaattatgttctaaaaatagagccattaattgcaattgctttcctttcttcttgtattccctgctgtccctccagctgacctatttcctcttctttcccgcaaccccagatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggttagagcccccatatgcccagtgaatcctcacgaccctgcctgctccttcccctctgagaatcagggctagaggggaggaagggctaggtgtagaggtagaagggccttacttggcacaggggtgactgggcttctgtgaccagagactaggaaagccaggcccagtgccactcctgggtgcttaaccctaagactcatgatggggcaggatgtgttggcaggtttttcggcttctgtccatacccacctttataaacccatccgtttttagaggctcaaaacacttagcaactggggagacaaggtcagcacagggaccttatgtaacctggctcagtccccaggctgacctgcctgaggcctgctggtctgtggtctgtgatttttttgtctaccttctctcctggccgctaaacgcatggcagctgcatttgctaaagaacacagcgccacctggtggaaagataagagtaatgccttacttttgtaccttatttttgttttctgaccgctgattgattccacataattctgtaaaggtgtattgagccccaattatattcaagacactgttacagtcactgtgtatgtcacagtgagccacacaaagtcccttacctaatgaaacttataatttgaatgggggaagatgccaataaccaactagacaaatatatgccaggtgatgagctatgcactcataaaaatacagcaggaaatgagagacagggagtaccagaggtagggcctgggaagacgtaaggttttccattctgtaaagggaagtgaggacatatgaacagagataagaaagaattcagggagggaagaacattccaacacaggaagcagcaaatgcaatggccagagcctgcctgtcacagtcacggatgagcaaatggacctgtgtagagcagggcaagagcaggagatgaggtcaggcatgaggaggatggccaggtgtgggcttggggagcctcgtgggcccagcaagccctttggctcttcttctgaaagacatgaggagacaacagaggagctaccaaactgagttgggtttttaaaggctcactgtagcgactgggtagagaacaaaccacaggggtggggggtaaggtagcagagagaccaggtaggaggccttggtgcaaatcccaggagagctgatagtgacttgaagcagggttgctgtagaagaaagggtgaaaggggattgcgtttgtatacattcttgatagatcctcatgttaattctgagagattggaggacagacactggatcagatgtgggtacaagcccagagctgaaaagctagtgatcaactcaggagcccccacttcctgatgcagcatccgatgctctttccaatgcccagcctgccgttggccctccctcagccatgcccaccctcttccccaactcaccctgtgtgtgtcctccttcccgcaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatgacatcctgtcttcaagtgctgtgtgggtcaggggaaaaggggaagtgttgtggagagctctggggaggagctggcttttgggaattccacaggacaggcgagtaagcttccatggcacaggcagaagtacagggagagcttgatattcacctggtacctgccagagtcaagagaagggataggttctaacgaggctgctatgatcagtgactttttaagctcgtgacagccccacttgtgttgggctgttgtgtggattggactgggctcagcccactgtcatttcagagcccgtatcttttgcccacctggctgggactcggcatgagccatttccaattctgcctgtaacagtgcaggggtcagtaccccttggtcaagtagcaagacatcatcagttaggtggtgacttttgtaggatttttacttttaaaagtaatttgtaattaaattcaattacaaatcttttgtaatttatattcaagaaattattattctttttataatttcatagaagtatctgagatgaggtatatgaagccactctgtacatgaggctgctccattccatgggccaagggaataagggttgaactgtgcttgaaagaatttgggggtacggagacaggcgcggtggctcatgcctgtgagcactgagggagggaggctgaggagggtggatcacttaagcccaggagctcaagaccaggctgggcaacatggcaaaacccagtttctacaaaaagtcaaacattagcagagtgtggtggcacatgcctgtagtcccagctacttgggagactgaggtgggaggatggcttatgctggggaggtcaaggctgccatgagctgagatcactctaccgcactccagcctgggggacacagtgagaccctgggggtaggtttgcaaggatcaaaatctgttcttcctctgctaattgcctgcttgttctcctttttcatcctactgaatccctctcatttttttctgattacgactacttaaaaaaatgttttcttctctgttgaatgatctgtttatacacagatctggaccttaaatgaacctttatttcttccctattgatagtctgagtaaagtgatcagacttcaggaacatggggtagaaatccccatagaatcacatcttaagcacagatctaaggagggattctgtgggtgacaccagggaggatcctgaaattaagggcctgggaaggaagacagggaccaacactgtggcaggccctgagctctgttagtccttacaacagctctgtggagtgggtctgaacactttatcatccagagaaggaaacaagctctgagagggagggacatgcttggggcagccagccagtgagtggcagaatggggatctgaactcagttatgccatggggagtccagtctgtgaaagatgggtggaggaatgtgactgataagggaaggaagagcggaggacccagaaagacagggaggtactaacactcgccctttcctactgctctccttccatctttatgcctttaacatgcatgtattgagtgcatcgaaatccctcagacccaaatgcgttgggtccagcttctgcacaggctcaccaaggcttccttagaggactctctcatcctctccaatcagataccacaatttcccggcgggtctccctaccccagcctctccctgtgctggttcattttccacactgtgccagtcttcagctctaaagcacagatctgagcactttgtggctacgttagaacccctcagcggttcacttttgactctaaaataaagtccagctttaatcctgacacacaagggggtctctgacctgacccaagtccctctccagacgtatctcctgcctggacagccttcattctcagacttttcccttctctctctctctctttttttttttttgtggctacacatgctgttctctctgcctagaacacctctttctcctcttttttagaaaaaattggggg

SEQ ID NO: 12162 - DNA, 4987 bp, Human
tatgcattgttcttggggcaaaaaggaaatcaaacatctgcccttcctcccacaacctctttacttccctctcttcctaacactgtatctcacatctacagctgcaggcacacagatatgacatacagcttgatatctttatgtgcaaaggcaaaagatggctatggatataggaggtggcatttaaaagaacaatatccatgtttgatactgctttcattatcaataatgaaaaggtagcctttcagcagaacaaagtaaggtacaggtcgtttggaagccatttcagtcattcacacagtgtgatccaccattacgaagcagaatttgaaatcaaaagacaatagtacccatatacatcaaactaggagttcaactggggtcagtccttggactgcacatacagagttgggctgcctgactctcaaaacattgcccttgctaatttgcgttgctcacttcctattgaatcagggatgatttttctttgctgtagtgaatcagccctgctacactgcaagaatcaagccgattcacaattcacatcaattccaggagtgacggccagatggcagcatctggctagtcagttggtgagtgagtccacctccaatcttgattaaactctgctgctgggaagtagcaattctgagcataaatgtctttgatatcctgaatattttgggtgtgggatgagagaggcagtagatagtggaaagagcacagggtgtagactaagataggcctggattcctttctttaatctgtcaatgaaagcaatgaatgttctgaaactacatggcaatgctttttttgttgccactctggcttttttttttaatgctataaaatatatgcctatttttcactgccaagaggtgacaacacaatgatgctgcaaccagagaagacagacagctaccaacaactattgacaagacagaaggaacatcaagaatagatgcaagacaaagcaatgtatctccatggcctagattttttaggttatgcatagaaacagcaaggagaagaagacacaatccaagttttcttttgagaatattgtgctgtttaaatttattttttaaacatttcttagcttttcttattagtcaatttcataagcctgggaaacatctttactctatccatttaattgcatttgttcattagcttactcatttcacttattagttcattcaaacagtagctattatcaactgtcttctaagaactgtatctgggtattctggttttgcttttttttaaaaaatagaattaaaaggatttccaaaaggacctgattttacattagaattagaataatacattttaaattaatgtataacatatattattctagaattagaatagattttaaatcacattagaataatagccacatgacaaaaaagaaaagaaaaataataaaattaatgacaaagaaaaacaatagtcatgtgagaggaaaggcaaagcctaaatattcctctgtcctcttcctccacctagattcccagatgtaaggtattaaaagtagtttgtaaactttctgtgacgtatgctgagtctatccaaactgtcgggaattggagcctcccgggaaccaaacactccccaaagatcatacacctacggagttcccccaagagacacacaactgcagtttcatgtaggttcaccttttctctctttttatactctgtccacacaaacctggcagccacgcagtcagtccctgccctgtgtcattgtactggccacagcaacttctctctgtaaatgagaaaggtcttgctttcagaaaagatcatgtttgcaaactactcactcttgaggaagaagggtgggaaaagtagcagagatgagtggggagatggtgcatataagaaggaggaaagaggagactatggagtcaggatgccggcttgctattctcaacacctttttccagtgcccagttcttaccttatttctcctgccccttgctttcttttctaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctgagaagactgtgctatggtattattttttttctctgacttttaaattcttgtttagtttataaacatgcatgcaccttaataacctcataaactctggtcaaagactaatgcctatcagatccatgaccacaacacagaagatttgtctcatttactccagagagaatgattcctctcaaagacaattctcacagctcttccttctcccttagaatatttagaagcaaattagggagctgtcaggtctctgagcccaagcctgcacgtatacatccagatggcctgaagcaactgaagaaccacaaaagaagtgaaaataaccaattcctgccttaactgatgacattccaccactgtgatttgttcctgccccaccttaactgatcaattagccttgtgacattccttctcctggacaattagactcaggagctccccaccagagcaccttgtgacccccgcccctgcccgctagagaataacccactttgaccgtaatttcccactaccaacccaaatcctataaaactgccccaccccatctccctttgctgactccttttttggactcagtctgcctgcacccaggtgattaaaaagctttattgctcacacaaagcctgtttggtggtctcttcacatggacgcgtgtgacatttagtgccgaagacccagaacagggggactccttcaggagactggtcccctgtcctcgccttcactccatgaggaggtccacctatgacctcaggtcctcagaccaaccagcccaaggaacatctcacccatttcaaattgggtaagcggtcttttcactgtcttctccagcctctcttgctacccttcaatctccctgtccttccaattccagttctctttcctctctagtagagacaaaggagacgcattttatccatggacccaaaactcagacaccagtcacggactcgggaagatagtcttcccttggcgtctgatcattgtggggatgcctgccctgatcattcacccacattccattggtgtctgatcactgtggggacacctgccatggtcattcacccacattcccttgatggcaagtcaatcgcgggatgcctgctttggctgatcgtccacgttatagcccagggctgctcaccaccccctttgctgtgtctctacctttctctttaaacttacttcttcactgtgggcaaccttccaccctgcattcccccttcttctcccttagcctgtgttctcaagaacttaaaacctcttcaactcacacctgacctaaaacctaaatgccttattttcttctgcaataccgtttggccctaatacaaacccaacaatggttccaaatggccagaaaacggcacttttgatttctccatcttacaagatctagatgatttttgtcgaaaaatggggaaatagtctgaggtgcctgacatccaggcattcttttacacatcagtccctccctagtctctgctcccaatgtgacttgtcccaaatctttcttctttctctcctgtctgtttcttcagtctccaccccaagctctgagtcctttgaattctccttttctacagacccatctgacctcttccctcctccccaggctgctgctcaccagccaggccaagccaggtcctgattcttcctcaccctctgctcccccaccctataatccttttatcacctcccctcctcacacctggtccagcttacagtttcattccatgactagc

SEQ ID NO: 12163 - DNA, 50530 bp, Human
ccggggcttcaagacaagactgggcaacatggcgaaagccagtgtctacaaaaaaaaaatacaaaaaaattagccaggcatggtggcacacacctgtggtcccagctactcaggaggccaaggtgggttgatcatctaaacctggggaggtcgaggctgcagtgagtgagtcatgattgtgccactgcactccagcctggctgacagagtgacacctcgtctcaaaaaaaaaaaaaaaaaaaaagactgggtgcggtggcccacgcctgtaatcccagcactttgggaggccgaggcgggtggatcacgaggtcaggagatcgagaccatcctggctaacacggtgaaaccccgtctctactaaaaaatacaaaaaaaaaaaattagccaggcgtggtggcgggcgcctgtagtcccagctacttgggaggctgaggcaggagaatggcgtgaacccgggatgcggagcttgcagtgagccgagatcgcgccactgcactccagcctgggagacagagcgagactccgtctcaaaacaaacaaacaaacaaacaaaaaacacaaatacttagatattttacatgagaattacatttatctatcagatactctaccatgccagatttccttacaattacgaaaaatagcaaacacatattgtttgtaaatgcaacacaaaaacgttaatgctctggtttctatctgccttgtcattccgttatttgactccattttcgaggttagaaactcactgtaaggtggccgggcgaggtggctcacaccagtaatcccagcacttttggaggccaaggagggtggatcacctgaggtcaggagctcgagaccagcctggccaacatgatggaactccatctctactaaaaatacaaagaaaattagccgggcgtggtggcaggcgcctgtaatcccagctattcgggaggctgaggcaggagaatcacgtgaacccaggaggttagagcttgcagtgagccgagatcgcgccactaaaacaaacaaactcactgtaaggaaacaatgtaacccaaggcatttggggtgaccttcacgttgcctgagggtgccgagggaccagagatgctggccatggactaaggtctgggtattctcaggcagcagggacaaggtgggcttttttcctggttgctaaacccacgtcaaagtcgagctcagggactggagctcaagaaacccaccgcccattctccagtccgaccggggacctgcatgcacctctgccgtgctgccctgagtcctccaatcctccacactcttcctctgttatgtacacgtctccacccaggcctgcaaaagtcccagcttcctcgcaggggcagggacccgcacgccggcccagggcttggcacgcggggatgctgaaacagggccaggcctggtttccagccgatcgtcagagtcccaaggcccagcaaccttcctcacaaaggcctcgttaagaggcgaggaaacaagagccgggagaggggcgcggaacggcgggcgggacgaacgaccagctccgcgcctccggccagctgcgtcgagccaggggcaccgcggctgttgtgcggctggaaatctaggaatgggaaggttcggggcctgctcggctccggaggcagctggcgggtcgtccctggcggcgttggagcggtcagtggcagccgggcacgggcgaccgggtcgcccgggtcgccctcagaccgtgactcccgaaaagccttgcgggcggggcgcgcccgcgccgtctcttgccggaaggtgcgagttagtgcgctcgattgtgggcgggggcggaaagaggcgcgttttaaagtggtaacagatggttttcttatccaataggattaaaaaatttgtccttacccggccgaccgcggaagtagagtaggcgggcggccaatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggtaagtcagggccttgcagatgcgaggtttaggcagcttcgcggcctacagaggcctcggcccgcgcctcttgggggagccgcgctgcgcggcttgacccagccgaggctttgcagcccgggacctcgagccagctctggtcgctcgcactaccgtccgcgcgggcgcaccgagcccggcttggcgcgggcaacagaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcggttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttcttgaattactacctttgtaaggaccttttgtaaacattgtttttctaatcttcatgaaatcttaatgccatacgtaaactatttctttttatataatgtatgcacatctgtgctttgtacataaaatgagtaagatttttcactctcctcaagatcaaagtagcgtatttttgaggtctcctgtatgccaacctttctgcttggaatacagcagtaaacagtcgtggtcctcctgtagctgggtgaggatggagggaataagagataactcattttattgtgttttgcaaatactgccttttttttttgcaaggtgaaggtttatagcaaggattcatcgagcaagtctgtaaatgccagccatttttccaacagcatgtgctcactttgtgtctcttgtgtcacgtttgggtaattcacaatatttcacacttttttttttttttttttttgaggtggaatctcactctgtcacccaggatgcagtgcactggcgtgttctcggtctcactgtaacctctgccatctgggctcaagtgattctcctgcctcagcctccggagtagctgggattacaggcatgtactaccacacccagttaatttttgtatttttagtggagacggggtttcaccatattggccaggctggtctcgaacgcctgacctcaagtgatccgcctgcctcggcctcccaaagtgctgggattacaggcatgagccaccatgcccagccccaaaccttttcattgttacatctgttatagtgacctgtgatcaatgttttgggttaccatgaatagcactcatataagacagtgaacttaattggtaaaagttgggtgtgtactaacagctccactgactggcagttcccagtctctctcctcaggcctctcaattccttgagacacaatattgaaattaggccagtcagtgaccctacagtgtccaggcaaaaggagcagtcagttgaatctctcttactttaagtcaagttaagaaatgtttatccttagtgagaaaggcgtatcaaaagttgagataggccaaaagctaggcctcttgtgctgaatgacagttagccaagttgtgaatgcagaggaagagttcttgaaattaaaatgctactccaatgaatacatgaatgataagccaaacagccttattgctgatagggagaaagttttagtggtctggatagaagatcaaaccatccatgacattcccttaagcgaaagcctaatccggagcaaggtactaactctcttcaattctgtgaagagtgaggaagctgcagaagaaaagtttgaaactggcagaggttagttcatgaggtttaagggaagaagccacctctgtaatgtaaaagtgtaaggtgaggcagtaagtgttgatgaagaagctgcagcaagttatgcagaacatatagctaaaataattgatgaaggtggccacactaaacaacagactttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacggtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaacttagccggtcttggcagcgggcacctgtagtcccagctactcgggaggctgaggcaggagaatggtgtgaacccgggaagaggagcttgcagtgagccgagatagcaccactgcactccagcctgggcaacagagcgagactccatctcaaaaaagaaaaaaaaaaagaatatttgtgattcatgggaggaggtcaaaatatcaacatcagcagttcacggtggctcacgcctgtaatcccagcactttgggaggctggggcaggcagatcacctgaggtcaggagttcgagaccagcctgcccaacatggtgaaaccccgtctctaccaacaaaatacaaaaattagccaggcatggtggcacgctcctgtagtcccagctacttgaggggctgaggtaggttaatcgcttgggcccaggaggtggaggctgcagtgagccgagattgtgcctctgcactacagcctgggcaacagtgagattccgtcttaaaaaaaaaaatcaattaacacaacaagaacttggaaaaagttgattctgaccctcatgggtgactttgaggggttctagacttcaatggaaaaagtaactgtagatgtggtggaaatagcaagagaactagaattagaagtagagcctggccgggcctggtggctcacgcctgtaatctcagcactttgggaggcctaggcgggtggattacgaggtcaggagttcacaaccagcctggccagatggtgaaaccccgtctctactaaaaatacaaaaaattagcagggcgtggtggcgcacgcctgtaatcctagctactctggaagctgaggcagagaattgcttaaacctggaggggcagaggttgtggtgagccgagatcacactactgcactccagcctgggcgacagagcgagactctgtctagaaaaaaaaaagtagagcctgaaggctgggcctgatggatcacctgaggtcaggagttggagaccagcctggccaacatgataaaaccttgtctctactaaaaatacaaaaattagctgggcgtggtagtgggattgttactgcatagtaatcccggccactccagaggctgaggcaggagaattgcttgaacccaggaagcagaggttgcagtgagccaagatcgggccactgcactcaagcgtggacaatagagtgagactttgtctcaaaaaaataaaagggccaggcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcaggatttgaaaggattgactccaattttgaaagaagttccactgtgggtaaaatgctgtcacacagcattgcacgctacagagaaatctttcatgaaaggaagagacaactgatgcagcaaacttcattttaagaaattgtcacagttggcccagtgcggtggctcacgcctgtaatcccagcactttaggaggccgaggcaggcggatcacctcaggttgggacttccagaccagcctggccaacatggagaaaccccgtctcgactaaaaatacaaaaaaattagctgggcgtggtggggcatgcctgtaatcccagctactcgggaagctgagacaggagaattgcttgaaccagggaggcagaggttgcggtgagccaagattgcgccgttgtactccagcctgggcaacaagagtgaaactccatctcaaaaaaagaaaaagaaaaactgtcacagctgccccaaccttcattagccactgccctgatccatgagcagccatcatcagggcaagacccttcaccagcaaaaatattacaactttgtgaagactcaaatgatcgttagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcacacaattagtaagcagagctcgaaacttcaccccacccctgactcctacctttgttccttttgttaggctttgttatgtcatctgctttttttgtgtggtgggaaagcacatggccaatgtttctagaaacttcaaatagtaaaaacaaaatagtatctttatttttgctttcaccgcagaggagtctgataattatcctcaagaaaatttattgattctcagtgactgtattgtattcctcaaagttatttttcctaagttttctcctctcaccagctaagggaagttgtcctagggcctaggcatttccctgtctgccacacctcacctcttactttagccaaactactgctaaattctgctcctaaatatggcagcattctgtgttacctgcactaaaatttgcttcccttgtaagtaccttcttgatgtcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtgatctgcccgcctcagcctcccaaagtgctgggattataagcatgagccaccatgccctgcctacagcctcaaactttaagctaaattaatcctcttgcctcagtgtcccaagtaaatgggaatacaggtgctgatatggtttggctgtgtccccacccaaatctcacattgaattcctacatgttgtgggagggacccagtgggaggcaattgaatcttgggggcaggtctttcccatgctgttctcatgatggtgaataagtctcaagagatctgatgctttaggtcgggggcggtggctgatgcctgtaatcccagcactttgggaggccaaggcgggcggatcacgaggttaggagttcaagatgagtgtggccaacatagtgaaaccctgtctctactaaaaatacaaaaattagctggacatggtggtacatgcctgtagttccagctacttgggaggctgaggcaggagaattgcttgaacccaggaggtggagattacagtgagccgagatcatgccactgcactccagcttggacaacagagtagacttaatctaaaaaaacaaaagagatctgatgcttttataagggggagtttccctacacaagctctctttgcctgctgccatctatgtaaggcatgacttacttgcttctccttgccttccgccatgattgtgaagcctccccggccatttggaactggcttttgtaaacttcttgcttttgtaaattgcccagtctcaggtatgtctttattagcatcgtgaaaacatactggtacagtaagttggtaccagtagagtgcgatgctgctgaaaagatacctgaaaatttggaaacagctttgcaactgggtagcaggcagggattggaacagtttggagggctcagaagaagacaggaaaatgtgggaaagtttggaactcgctagagacttgttgaatggctttgaccaaaatgttgataaggatatggacaatgaaatccaggctgagatggtctcagatggagatgaggaacttgttgggaactggagcaagggtcactcctgttatgtttcagcaaagagactagccgcattttgcccctgccctagagatttgtggaactttgaacttgagaaagatgatttagggtatctggcagaataaatttctaagcagcaaagcattcaagagatgacttgggtacagttaaaggcattcagttttataagggaagcagagcataaaagtttggaaaatttgcagcctcctgtcaatgtgctagaaaataaaattccattttctgaggggaaattaaagccagctgcagagatttgcataagtaacagggagccaaacgttaatccccaagacagtggggggaaatgtctccagggcatgtcacaggccttcatggcagcccctcccatcataggcccagatgcccaggaggaaaatatggtttcctgggctgggcccagggttcccctgctgtgtgcagcctaggggcctggtgccctgcgttccagccgtctcagctgtggccaaaaggggccaacatagagtagaactcaggccgtggtttcagaaggtgcaggccccaaaccttggcagcttccacatggtgttgagcctgcgagtgcgcagaagtcaacaatgagggtttgggaacctccactagatttcagaggatgcatggaaacacctggatgcccaggcagaagtttgctgcaggggcgggacactcatggagaacctccgctagggcagtgtggaagggaaatgtggggttggagcccccaagcagagtccctactggagcaccacctggtagagctgtgggaagagggccactgtcctccacaccccagaatgatagatccactgacagcttgccctgtacacctggaaaagctgcagacactcaacaccacccagtgaaaacagccgggagggaggctgtactctgcaaagccacaggggtggagctgcctaaggccatgggaactcacctcttggatcagcgtgacctggatgtgagacatggagtcaaaggagatcattttggagctttgagatttggactgctctgctggatttcggacttgcatggggcctgtagcccctttgttttggccaatttctcccatttggaatggctgtatttacccaatgcctgcacccccgttgtatctaagaagtaactaaattgcttttgatttacaggctcataggtggaagggacttgccttgtctcggatgagactttggacttttgagttaatgctgaaatgagttaagactttgggactgtgggaaggcatgatttattttaaaatgtgaggacataagatttgggaggggccaggggtggaatgatatggtttggctgtgtcccccacccagatctcatcttgaatttccacatgtgggagggacccggtgggaggtaattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtcctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccacctcggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagactttgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggctcactgcagcttcaacctcccagtctcaagcgagcctcccacctcagcctcccaagtagctgggactacagtcgtacaccactatgcccggctaagtttttgtatttttttgtagagacaggatttccccatgttgcccaggctgggacactgatttgttagtctactttctaggtaaagtgttgaaggagagttgaagagggcctagattagggcttctgggtgctggatttctccaccaagatgcaagcccctagagagttgagtttggctagccctttggtgacagcttgtattgtcccttagcccacagatgcatctgactaagagtagaagaacatgtctctctttaggagcccggagccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctctagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagccaaggtgggcagatcacttgaggtcaggagttggagaccagcctggccaacatggcaaagccccatctctactaaaaatacaaaaattagctgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggctcacctccacctcttgggttcgagcgattctcctgcctcaggttcccgagtagctgggattacaggcgcccaccaccacacccagctaattgttgtatttttagtagggggtgggtttcaccatattgttcaggctggtctcgaactcctggcctcaggtgatcccccccgccccgcctcggcctcccaaagtgctgggattacaggtgtgagccaccatgcctgacccaggtctcttattttcagtgggtaattgtatcagactctgcctcccaggtggggtttgagggttctgtgtacctggtgtaggcctgggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatcctgtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccacccacatacattgtttcttaattaactcctcctgtcacttgaggccccattcagcactgcttcctctagacagcccggcttgatcctcagcgcgtttgggctgggactgcgactcctttgctgctgcttccacttgcttaggtcaccagcgtcccacttccgtgtttgagctcactggccgcctttcagttccccagcctgtgcattgcagctgttcactgcttcctcctccttgaagaaggaggttttgtctgagtgacggctccaggttctcctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatccggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaatttgagaaatctgaaaaatcaccgtcagtgttcccgctagtttctggaattgatgtatttgattctggcactaacatacctatttgagggtgtgggtcttggtatcagactgccctggtttaagtctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcttgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcatgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccatgttggccaagctggtcttgaactcctgatctcaagtgatctgcctgcctcagcctcccagagtgctgggattacaggcatgagccactgcccagcctcattattttaatttttttatagagacaggatctcaccatgttaaccaagctagtttccaattcctgggctcaagagatcctccctcttcaacttcccaaagtgctggggttatagggcatgagccactgtgcctgccccatttgtgcattctgttgagagcacccgtagtcccatagtatgggccagcctaaggagatgcaagtcaccctttattagagtgaaacagtgaaggggatttcccctctaaaccattgaggtcaagctagagaatgaggcgctcagggagtgagatacagtatgccattttctcagaaccagacgaccaagtgctgaagaaaatgctcagctcagctgggacggcggtccctttgggcatctcctgaaaaacctactctggcctccctttctcctcctgtacttcttgcacacttagttcctaacttcgttatagctgcctgccagcaccctcctcacccttctccccgccctagattctgcacagaggctgtgtttgctcattgctgtattcccagggcaggggctgtactgtgaatgaggcggggaggtatgcatcctttcttaaagctgggtgggaggacagacgtggtggctcatgcctgtaatcccagcactttgggaagccgaggcaagtggatcacctgaggtcagaagttcgagaccagcctggccaacctggtggaaaccccatctctactaaaagtagaaaaattagcctggtgtggtggcacatgcctgtagtcccagctactgggaggctgaggcaggagaatcacttgaacctgggaggtggaggttgcagtgagcccactgcactccagtctgggcaacagagtgagactccgtctcaaaaacaacaacaacaacaacaaaaaaaaactgagtgggatgtgatatcacacagcattttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttttttatttttttgagatggagttttgctctcgttgtccagggtggagtgtaatggcatgatctcggctcctctgcctcccaggttcaagagattctcctgcctcagcctcccaagtagctggaattacaggcatccaccaccactcccggctaattttttgtattttctagtagagacggggtttcaccatattggccaggctagtctcaaactcctgacctcaggtgatccacccgccttggcctcccagagtgctgggattacaggtgtgagctactacacccggccgatgcctggatttcaatctcagttgcctggctcaagagatgtgccctaattgcagtgccagcctggctccacacaccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcgcctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggtgatttctctgcctttcctcaaagcttctgcttggctgcctagtccacagcctcccgattcaccattcacctggtcccagcaacagaagtctcagctggacacacaacatgctttagagtgagtggctcttgtcttctcaactccggacggcgacagtgaaattgtgggaagaacctgaggctctgagctgtggcctcagaagctctgtcccttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcatggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttggccaggctggtctcaaactcctgacctcaagtgatcttggcctcccaaagtgctaggatgacaggcatgagccaccgcacccagccgtttttatttgtttttaagagacagggtctcactcagtctcccagtctggagtgcagtggtgtgatcatagctcactgcagtctccaactcctggagtcaagcaatcctttcacctcagcatcctgagtagttgggatcataggcatgcaccaccgcacctggccaatttttaagaaaaaattggccaggtgcggtggcttatgcctgtaatcccagcactttgggaggccgaggtgggcggatcacgaggtcaggagatcaagaccatcctggctaacacggtgaaaccccgtctctactaaaaatacaaaaaattagccaggcatagttggcgggcgcctgtagtcccagctactcaggaggctgaggcaggagaatggcatgaacctgggaggcggagcttgcagtgagctgagatcgtgccactgcagtccagcctgggggcagagcaagactccatctcaaaaaaaaaaaaaagaaaaatcatttttgtaggcatggagtcttactttattacccaggctgatcttgaactcctggcttcaagcagtcctcccacctaggctcccagagtgagcgacaatacccagactgtttagagcttttatcacatctgtgagacagctctggtttggtgtaattcaggtgtctcctggaaccccttgagctctcgaggagattacctgaaggtccccctgtcccagtttattctctactgacagagttctcactgcaagtttgttcaaatgatctaaactcaaaacatctgttgtctgagatcctgaattccttgtcagacagaccagatgtgaaatagcctgctgatttcttccagtgctccagaagtactgtgaatggtatgggaagatggatggtggggacaggtgagactgaacaaacagctgtcagagggaacagtgatggaaatgctggtcacaccctctgagccttttgggtcctcaccctcttctgttacttcctggccgccattgtgctccagggcccacttttgatggtgatacacaaaaaagcccacttctttgacctcccaccttggtgcttcacctgcaggttaccatgtagctcacctatggggaaataggtgctttaagccttaacccatctctgcttaggccagatcagaacaggcaaaacaatgtagccttttgtgcatgtgtgtgaagaaattggttaaaattcctgaaagttacggtgtggttatagcttatgtggttgtgattggatggtcagttttcaccaaaagctatggacctctgagggccctgctagtgaaaaggaagagaattatgaccagaattatgggagggccagagtggggagctctgcagatattcctggattgattgagcctgtcttgagtggtgcagggaagctacttgggaggaggaggctcagagacagcagagtgggagggtaaaggatgtcctcaggaaggaggtgacatttgagtgggttctggaaagctgtgcaagaattggccaagtaaagaaagggagggacaggcactccaggcagggaagaagctctggttaaaggcatggaggggtcgatagagcaggcagaaaagaggattcctgaggttagggaggggtggggacattcctgtaattatccgtgaggggagattttgggtccaggacccatggctgctttcttggctccctcagtggggcccagaaaccacacaggtagctgtgggacatggaggtctgcttagcagtgcctagtaagaaagacttggtctgctacaggctgggcatggtggatcacaaggtcaggagttcgagaccagcctggccaacatggtgaaaccccgtttccactaaaaatacaaaaaaattagctaagcacagtgcgggtgcctgtaatcccagctactcgggaggctgaggcaggagaatcgcttgaacctgggaggcagaagttgtggtgagccgagatcattccactgcactcctgcctgagcaacagagtgagactccgtcttaaaaaaaaaaaaaaaaaaaaaaaagacttggctacaagggaaggagcctatacgaggacaaaggacattgtcaaagagaatggggtaaatattttcatttatttattattattattttgagacagagtcttgctctgtcgcccaggctggagtgcagtggatgcaatattggctcactgcaacctctgctgcccgggttcaagcgattctcctgcctcagcctcccgagtagctgggactacaggtgcatgccaccgcgcccagctactttttgtgttattagtagagacggggtttcagcatcttggccaggctggtcttgaactcctgacctcgtgatccacgagaatggggtaaatattaaagagtcctaagtgtttgaaatgcttgttttctggtgctgtaaagaaatagcatttgaacgtaaatttaattttttttagcaaggccatatttatactttctgcagaaagggtacactcaccagttgttttgccatgagaatacattgaataaaggagacagggttatttataacttgatgtgtttactctgctgctgtgtccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaaggtaaaaataacctttaaataaggaagaggaacaggctatgatctaatgcttgcttggactaatataagcatgccaaggtaaatatttaggctaaattgtgggagctaagaatataaagtacattgatttctttattatggctagcagatatttaagaatgttagtacaggtctttgaataaattttgcttttaagagaagttactatttatttctaattagatggggaggaaagtctttgaagaggaacctctactttactttttacataagcaacctggtggctgctggggaaacccttaaaacactgggcagtagaactccactgaggttagtgtcagctcccttgaggccaagagcagctgctcacttgggagttttggctgctgtcgcttggcctctgggccctcctggggctggttctgtgctccttagtccgtgggaagttactagacccagcttcatttccaaaacatctcaagctgccatttgataagagtagcattggaacacagaatcaggcttatccctgttgcctagcgagggcttggctggatggtgggtgttcctggatcttgtatgaatctctcctgcaatatctggtcctttcagagtttcctgggacagattgaccctagtaaggctaaggaattgggatagtagtagcatcttccgtctctgcgcagtactttacatacatgatctcatttagaccttataacagctctgcaaggctggtactggtgaggaacttgagacttagtagtgcagtacttgtcccaggttgtccagtgcaaaggatagcaggacagggcacagggagaagagcacggaaacaccagtgggaatacaaggtgacaggctctgttgggaagctcttttttttttggggggggggtgagatggagatttactcttgttgcccaggctggagtgcaatggcacaatctcggctcaccgcatcctccacctcccaggttcaagtgattctcctgcctcagcctcccgagtagctgggattacaggcatgtgccaccacgcccagctaattttgtatttttagtagagacgggtttcaccgtgttgcccaggctgatcttgaactcctgacctctggtgatccgcctgcctctgcctcccaaagtgctgggattacaggcctgagccactgcgcctggccagctctgtctcttgattaaggtggaggatattctcagcttgtcttttgggaccaggcagaccagaaatgctggagcatattggcaaaccagcagcctaaggatttggaagaaaggctggtcagagtgtcagttgcttatcaaccagctgagagcctgaactttccggaagacatggctcttgggtagccactgggaacaggcttaaaacagctttggttctttgagttctttgtggggagtgattgtctggtgtgaatcacagttgatagtgccctgaaaggttcaaggccacatttcccaggggaagataagctttccacaatgtatagaaactcagaaaactccaagttctttatgctaagaaacaaaaagggctcagaaaggctgaacacaaagtcaaggaagagaaattgataacttttggttaaagggaagagtttccagccttttggccagggcatccactaccaagtccaaatcctgacttggcctcaagcttttgtaaagggatgcatcgtgtcccttttgacctgctgatagtttttttgagatggagtctcacactgtcacccgggctagagtacagtgacgcgatctcgcctcactgcaacctctgcctcccaggttcaagtgattctcctgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttatttttacttatttatttttgagatagagtcttgctctgtcgcccaagctagagtgtagtggtgcagtctcggctcactgcaagctccacatcctgggttcacgccattctcctgcctcagcctcccaagtagctgggactataggcacccgccaccacacccggctaattttttgtatttttaatagagacagggtttcaccatgttagccaggatggtctcgatctcctgaccttgtgatccacccgtctcggcctcccaaagtgctggtattacaggcgtgagccactgcacccggccatgcaaactcgcgttttaaacagaagaaacttagtgcaagataaatttcatgggccccccaggagaaatgaagttctctatatggtctctgagtttcacttctacaaatgagttcttgaaagccttgacttgaggctaggatcctggctctagaccaaaaaggaacgaactgctttccgtcatggcacttgtcatcctctaggcagtcttacccctgtgtgtacttagggctgcccattagagcactgttttgtttttgtttctgtttgagacagagtttcgttctgtcagccaggttggagtgcaatcgcgtgatctcggctcactgcaacctctgcctcccaggtttaagcaagtctcctgcctcagcttcccaagtagctgggatcataggcgcccaccaccacacccggctaaattttttttgtatttttagtagagacggggtttcaccatgtcagtcaggctgatctcgaactcctgacctcagattatccacctgccttggcctcccaaagtgctgggattacaggcctgagccacccgcctggcctagagcactgtttttgtaagagcccagaattgtgttcaccagaaagagaatggttcaataaattgttgtatatcagtatatggactgttggacagcccttctttttaataaagaatgcaataattttatataaattatattgtatatgtaagattatcacggtttttattcttgtgaaactttatgatacaagaaaataaaacaggccagccagattgcttgagcccaggagtaccagaccagcctggacaacatagtgagaccctgtctctataaataaaaaaattagccaagtgtgggaggctgaggtaggaggatcacttgagcctggaacattgaggctgcagtgagccgtgatcgtgccactgcactctagcctgggcaacagcaagaccccacctaaaaaataaataaaagaagttacgttgggttgggcgccatggctggctcctataatcccagcactttgggaggccgaggcgtgcagatcacctgaggtcaggagttcaagaccagcctggccaacatggcgaaaccccatctctactaaaaatgcaaaaattagacgggcgtggtggcgggcgcctgtaatcccagctacttgggaggttgatgcaggagaatcacttgcacctgggaggcagaggttgcagtgagccgagatcgtgccactgcactcctgcctggacgacagagcgagactctgtctcaaaaaaaaaaagttaaatgcattacaagacactttccccaaatattagaccaatactgtttcttaaaaaacttcatttagtgttttgttgttgttgttgtttgtttgtttttgagatggagttttgctcttgttgcccaggctggggtgcagtggcgtgatctttgcatcccggggttcaagcaattctcctgcctcagcctcccgagtagctgggattacaggcatgtgccaccacacctcgctaattttgtatttttagtagaaacggagtttctccatgttggtcaggctggtctcgaactctcaacctcaggtgatccgcccacctcagcctcccaaagtgctgggattacaggtgtgaaccactgtgcctggcccattccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccttggccgggcacggtggctcacgcctgtaatcccaacactttggaagactgaagtgggtggatcacaaggtcaggagttcaagaccagcctggccaagatggtgaaaccccatctctactaaaaatacaaacaaaattagccaggcatgctgccaggcgcctgtaatcccaactactcgggaggctgagacagagaattgcttgaacccaggaggcggaggttgcagtgagccaagatcgcaccactgcactccagccttggcgacagagcgagactctgtctcaaaaaaaaaaaaaaaaaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctatattacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttgagtgcctgacacctagaatggtgcccagtcactgtgagtgtatgccctcccaactgaaaggaaagggaacgttggctcagcactgcccatgggaaatctctcaagttccaaaagtgcctgctacttagcatggcctcaggggatgcaggctccctgcattgccacctgatgcctgctgcgtcctgatgccagggaggctggagcccaggaggctgcctgtgtccctgtctcatggcaccggttacagactgcaggggacgtgtgtatacgtgtcctgcctgccaggagggaggccttgtctggtcagaggacacacggagaagctatttctgatagacctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagttgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcaccagttgctcattaaagctggaaagtggtgtctgcagaagtttttttgttttttgttttttgtttttcttgaatactcagtgttcaccacagtcttcttggccttctctctgccagaccctgaggagagagctaggattttgactgcaggaagacaatgattgattggcttttgttggctgacaaaccaacatcatttcccctttcacacttgtgttttcttttgctttagaaacagggtctcaggctgggcgcggtggctcacgcctgtaatctcagcactttgggaggccgaggtgggcggaccacgaggtcaggagtttgacatcagcctggccaacatggtgaaaccctgtctctactaaaaatacaaaaattatgcggacgcctgtagtcccagctattcaggaggctaaggcaggagaatcgcttgaacccaggaatcagaggttgcagtgagccgagatcacgccactgcactccagcccgggcaacagagtgagactccatctcaaaaaaaaaaaaaaatacaaaaattagccaggtgtgatgatgcatacctgtaatcccagctactcgggaggctaaggcaggagaattacttgaacccaggaggcggaggttgcagtgagccaagatcgcgccactgcactcaagcctgggcgacagagcaagactctgtctcaaaaaaaaaaaaaagaaaagaaaagaaacagggtctcactctgttgcccaggctagagagcagtggcatgatcacaccttactgcagcctccaacccctgagcttaagtgattctcccacattatcctcctgagtagctgagactacaggtgcatgccaccatacactactaaatttgggtcgggtggtggtggtgattttttaatatttttgtagagacagggtctcactgtgatgcccaggctggtcttgaactcctgggctcaagcagtcacccacctcagcctcccaaagcactaggattacaggtgtgagccaccacactggccagctttgttttgttttgatgactaagctgctcttgctaaaagggcttcctctctgaacttccctacctttcttctgtttccctgggctagggctccatgttggcagtcctactcccaattaacctggggctgtctggttaacctttataagatctgcagtcattgggagacccggggaccaggaatattgttgttgagggagctaccctggaaagtggatgggtggccagagggagagctgataggtaaaagggagacgctcctggcttgggaagcaggagtcctaggttctggtctctcagatctactggtcagtttgatcagtggatttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtatctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactttgttcatctcatttgattagtttccctcaaaatgaactttcatttttggcattgcatagcctagaaaaggcatcactgctgtgtcccgaggtgtgagtgtctttgatttttactggataaatgccagacttttctaaagagggagcagttcacattcatgccagtgtttgaggttctccacatcctcatggccacttttaattttagccattctgatgcttgtccagtggtgtctcattgtggttttaatttgtgcttttttattacaaatgggatcaaacaccttttcatgtttatttttctcttttgtgaagtgcctgtttaaaacttctttgttttatagcttttatttatttatttatttatttatttatttatttatttattttgagacagagtcttgcactgttacccaggctggagtgcagtggcgtgatcttggctcactgtaagctctgcctcctgggttcacgccattctcctgcctcagcctccagagtagctgggactacaggcagccgccaccatgcccggctcattttttgtatttttttttttttttttttttgagacagagtctcactctgtcacccaggctggagtgcagtggcacgatctcagttcactcagttcacctccgcctcccgggttcaagcaattctcctgcctcagcctattgagtagctgggactacaggcacgcaccaccatgccaggctaattttttatatttttagtagagatggggtttcaccatgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctcgatctcctgaccttgtgatccgcccaccttggcctcctaaagtgctgggattataggtgtgagccaccgcgcccggccttgggtcatgatttccatcatcttagacctgttggtgctgaggttttctttaaccattggtagtctagacatcaacatgagcttcaatcatggtctgcctttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcgctctgtcgcccacgctggagtgcagtggcacagtcttggctcactgcaacctccatctccagggtgccagcgattcccatgtctcagcctcctgagtagctgggattacaggtacacaccaccacggccagctaatttttgtatttttaggagagacggttttgccatgttgaccaggctggtcttgaactcctggcctcaagtgatatacctgactcagcctcccaaagtgctaggattacagacgtgagccaccatgtccggcctccttggttgctttttaacagcaaataatcttttttttttttccaagttgtgtgctttctccaaatttgttttttttcttcttcttcttctttttttttcccttgaaacagggtctcactttgttacccaggctggagtgcagtggtgccatcacggctcactgcagcctgtaccttctgggctcaattgagcttcctgcctcagcctcctaagtagctgggactataggggtatgtcaccatccctggctgattttttatatttttttggagagacaaggtcttaccgtattgcccagggtggtctcaaactcctgggctcaagtgatcctcccaccttggtttcccaaagtgctgggattgtagttgtgagccactgagcctgaccttgggtcacttttcatgagcattttcagtatgccagtctctgctctggctagaagcaatgcagtggtagaaaagagactggcaactctctttaaggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggttttccatttatgagactctgtagaaaggatgcttgataaaggcttttctggaaggaaggaaggaagagggagggagggagggaaggagggagggacagaaccctgtagatctctgggtgtaaaggacacaggaggcacactgttggaataagtgagccagcccaattccatagaaagaaagaagagctcagaaaagcccaaacatcatatccaggaattagccaagatgggttggctactcaactacaatgtgattgtccgcaccagtcttcccgactttcctgccagtgccgcaagtaacaggcatcagtaactgcatgatgtgtgtagctgttggacattgagtagccttttgtgtgcacagtgcttggagatggctgtttttccagtggagcaatgtgcagtgctgtgagctgtaaagttgtctaaagcaagtgtgtcttggtgcccttggctgggtgaacattcctagaaatgccaggggccagcctgagtgcacgggacccagtgattcctatacttgcttctttcatgcagaggtgttctgaggctcacctgtgcttttagaagcacaaaggggcttcgagtgaccaatcagatgtgcctgctgcaggtccactcgtctctaaatgctctgacctatggactgttgtccatagttgagaagaagctagagtaaaataaaatgtatgagtgagtgaatctttttctttttttttttcttttctctttttgagacagggtgttgctctgttgcccaggctggaaggcaggggcccgagctcagctcactgtagcctcaacctcccaggttgaagagatcctcctgcctcagccccaggagtactgggactacaggtacacactgccatgcccagcttattctttgtattgacgggatctcgccgtgttgcccaggatggtctcgacctcctgagctcaagtgattcatcccgccttggcctcccagggtgctgggattgcagatatgggacaccatgcccagccgaggaagtgtgaatttctgatcttgggctagcttaccacagtactaattaaactattcagttcaggggattagttaattgttgttatttcagttttggtttttcacttatcttaaaagcctctcaaatagattagaggccccagagcttgtgttacacctctatccatctctcaactcatctggtaggcatttatgaagcgctggtactcttccctctgcacctatcttctgtgctgggcaagtactgtgccacctgcagggccatagctgtgatttaggttcattacagagttcttgagatgtctgcagggattctggaatttgatgtgactcggccactgggtggagggaacaccagtaatcaatactgtattgtccaccagctgagaggccaggctgtggtcgttggttttgtttttttgtttgtttggtttttgttttgttttgttttgttttttgtttttgttttgttttgtttttgagacggaatttcactcttgttgcccaggctggagtgcagtggtgcaatctcggctcaccacaacctccacctcccaggttcaagtgagtctcctgcctcagcctcctgagtagctgggattacaggcatgagccaccacatgcccggctaattttgtgtttttagtagaggcggggtttctccatgttggtcaggctggtctcaaactcccgacctcgggtgatctgcccgcctctgcctcccagagtgctgggattacaggcatgatccactgccccaggccttttttttttttttttttttttttttaattaaagacagtttcactattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatttcatgcggacagtacattgtgccggccctggtaagtttggtcctgatggtgaggttgactgattgtccccagatttcccttttcaccgtctgcagtctcctctaagaggaaaggggagcacgtttcagtggctccacgtatgtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtctctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatgccttcatttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccgcacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgacgcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaatatcttttacacattcatttgctctttggaatcaatttcccccctttttgccaaggtgcggggttcttatctgcctcacgttgagtgtattttgcattggtgtgtgttcaggaagtttccatgtcctaaatccagcaagcatgtgagaggctgttcttggagcacagccacaagcccaagccctggagtccctaagagagcagagtctactctgagaggcaaggttgaccaaggagctgtctgctcagctcggccagtctctcagaggtgctgggggtgctgctctgagtgggatggactgagattgccctggaaaccttgcactgcagcacccccctttgcccctgaccacctagatacaaaatttgccctctgagtgggagtcagcactgggagtgcatggatatgccagccactgccacaggcgagcagtgccagcaaagccacaaggagggaatgggcttggcagtgtggccaagctctccctttgcctctgccctctgtacctatccagctgtccccagggactagaaaggctaacatgctggctgcctgggtcccaaaggcctaccatccagtgcagtttgcttaccatgctcctggcactgcacttttggctctgtgggcagtgagacagacatcatggaacatgtttacagaggagacagtcccccaggccactggaaaattgaaactgatgagggtggggtacgggaaaccaggagatccagcaggaagaagttgaagctgtccagaaagctctctctgaataagggctgctaagttgccatcttcaaggtccagaaagctctctagggaaagaggaaagaattccagagaccccaggccaggcctgtgaaagttatgagaaagagcttcttgctggcatacagtagggtctgcaggctccccgatacctaaaggcattggaccagacacttctggtggctacccagggcctggcagttctttaccccaggagcaagcctaggggaggcagggagcagtgtatccctaagactggtactgctggagtgggtctggtcctggaaaggagggagcccccaaggctggctatagaaactcaaaagatgtctgtattaactttttcggtgggggggtggttttgttttgttttggcagcatagaaacaattgattctctatattgtgtatccagaatccttgctatttttttttttttcctaagacggagtctggctctgtcgcccaggctggagtgcagtggctcgatctcagctcactgcaacctccgcctcccaggttcaagcgattctcctgcctcagccacccaaccagctgggattacagggacgtgccaccatgtccagctaatttttgtagttttcgtagatacgggctttcaccatgttggccaggctggtctcaaactcctgatctcaagtgatccgcccgcctcggcctcccaaagtgttgggattacaggcgtgagtcaccactcccagccccaactctattttttttttcttttttctttttttctatttttgtagagacgggggtctcatcacgttgcccatcctggtctttaactcctcgcctcaggcgatactcctacctcagcctcccaaaggtgctggaattaaaagtgtgcgccaccgcgcccagcctagcccagtacattattattacacacaaatggtgtttgtgttttagtgtttcatcaagaaagatgtttgctgtaggttctagttagataactgtcagatgagggaggttcattttcctaccatgagataagcatttatctttttttttttttttttgagacggagtttcactcatcgcccaggctggagtgcagtggtgcaatctctgctcactgcagtctccgcctcctgggttcaagcaattctccagcctcagcctcccgagtagctgggattacaggcatgcaccaccatgcccggctaatttttgtatttttagtagaaacgggattttaccatgttggcc

SEQ ID NO: 12164 - DNA, 20644 bp, Human
cattcccatttgaccgctggccctcttaggacctgactgtcctaagtgccaggaacagcagcatgtcccacttggtgttcctttgagggctgggctgtaggagcagcttaagagggacccctagtgactgcatggagcggtgtcgcctccgcaccctaggccaggctggctctagcatctgcctgtcctggcaaaggaaggtccttggggcttgggcccacaggacttgccagcagtgtcacccttgcctccgggacaacggcttcacgtggtctcctcttcctaacggggctccctttcccaggtaagctttctccaacagcctcagcttcctacacccctaaactccccttcctcacacttagcttttcctcagggggcccgactttcccctctgcaacttctccacagtgggaggagcctccatgcaggttctggccccagcctcccttctattgaggtccatctttttccttcacaggccccatctctctccttggggaccgtggggcacaggacagtggaggcctgatccctattgcatgtggtgaatcttaactcaagccttcaacatcctccttgaaagagggggatatcaagagaatgaaaacatgggccacacaatgaggggaaatatttgcaaaagacatagtcgataaagaactattatccaaaatataccaagaatgcttaagacaaccataagaaaacaggtaggtgctctagctcacacctataatcccagcactttgggaggccgaggtgggaggattgcttgagccatgagctcaagaccagcctgggcaacatggcgagaccttgtctcttcaaaaaatacaaaaattaattggcatggtagtgcacacctgtagttccagctactcaggaggctgaggtgagaggattgcttgagcctgagatattgaggctgcagtgagccataagtgtaccactgcactctagcctgggtgacagagtgagacactgtctcaaaagaaaaaaaaaagaaaccaaataaccaaatttaaaaatgggcgaaagatctgaacagacacatcaacaaagaagatacacagatgatggcaaagtgcataggaaaatatgttcaacatcatatgccatcagggaaatgcaaattaagacaacaatgagatactaccacacacctataagaatggcccaaatccagaacattgacaacaccaaatgctggcaaggatgtggagcaacaggaactctcattcattgctgtgggaatgcaaaatggcacagctacttcagaagacggtttggcagtttcttacaaaactaaaacatacccttaccatacaatccggcaatcacactctttggtatttacccaaatgaattgaaaatttatgttcacacaaaaacctgcatgcaaatgtttagagcagttttattcataatgccaaaacttgaaagcaactaagatgtccttcagtaggtgaatggataaactggaatgcatccagacaatgaaatatcattcagtgctaaaaagaaatgagctatctcaaccatgaaaagtcatggaggaagaatgcctgttactaagtgaatctgaaaaggttacatgctagatgattccaattctatgacattctggaaaaggcaaaactatggagacagcaaaaggattagtggttgccaggggctggaaggggatggtggggataatggatgaatagacagaatatgggggagtttttagggcagtgataacattctatgtgattctacaatggtgattatgtgccattatacatttgcccaagcccatagaatgcacaataccaagagtgagccctcatgggagtgagggacactgggtggtgatgatgggtccaggcaggttcattgattgtgctaaatgcaccactctggtggggatggtgatagtgtgtatgtggggggactgggcatgtgtgggggcagggggcacatgggaactctgtactttctgctcaattttactatgaaactcaaactgctctaaaaaataaagtttattttaaaaactgaaaatgaaaatgaaacaaaagaatttgaacatacaatcaaagagattcgctaacagagctgaaagaagggcatttctcattcagcgtaaattcatgcttcactactgttctcactccttatagtgactccagattaatatatacacatgtttatagatcttctaatgatctgggtgagtataattacattgcaatattttttttttcctcataacagctttaaggtgttaaacagaaacacttaaaacatcctgtaatttgggatttagaaatttttaaatattctgctgggcatggtggtggctcatgcctgtaatcccagtactttgggaggccaaggcgggcagatcacctgatgttaggagttcgagaccagcctggccaacctggtgaaaccccatctctactaaaaatacaaaaattaaccagatgcagtggcaggcacctgtagtcccagctacttgggaggctgaggcaggagaatcacttgaacccaggaggtggaggttgcagtgagctgagatcgcgccactgcactccagcctgggcaacgagagcaaaactttgtctcaaaaaaaatttttttttttttaatattctggtgggccccacaaatggaagtagttatggcccctctccagtgtgaagggccccaccctcagtccctttcacaggccagagatgtctcacccctcaggcccttcttcactcctcacgtggtctcctactcaatcccgaggtgggactccctcctgtcattccccatggtgacacttcacgttgcttcacctcaactcagctggctctgttggccctgaggccccctgcagagccccagccggtgtgcagggcttcctcctcaggcactccaggaagccctggagtttctttcgtgcagcttctctgtcaccccctacgacagctcacaggtctgagctcgccaagccgggggaggcaaatgagcagatctgggctattccaactcgagcactcctgatgtcactgtgaacctaggtttgtggcatgagagaaagcagatacaccacgtgagatgcaaaaggttaaattaaaaatcccagggtagtgaatgtgattgtcttgtttttttttttttgagacggagtcttgctctgtcacccaggctggagtgcagtggcacaatctcggctcactgaggcctccgcctcttggggtcaagcaattctcctgtctcagcctcccgagtagctgggactacaggcgttgccatcacacctagctaatttttgtatttttagtagagacggggtttcgctacgttggccaggctggtctcgaactcctgacctcaggtgatccacatgcctcggcctcccaaagtgctgggattacaggcgtgagccactgtgcctggctgaacttgtgtattttgtgctaagatgttacgtgtattttttcctggctgttcaatgagaggcctgaaaacaaggccaaaggtaagcacccttatgttctaattgtgttctctaaacaccattccccactgaaagaaaccaggggttggcagacaaatggctgattccaggtctggggcagaagaggagcaagatgaggacatctagtagcactagaaagcaaggatagtatgcaggtcatataggttagatgtctatccctgcccaaatctcacgttgcaatgtaattcccaatgttggaggtggagcctggagggaggtgtctgaatcatgaagctggatccctcatgaatggcttgggccatccccttcataacaagtgagctcttgccctgagtttttgcgtgatctggttgtttaacagtgtgtagcacctcctccgccattctctctctttctctatctctctctctctcttgctctcgctctctctcttgctgtgtgacacgcctgcttcccttctccttccactatgactagaaggatcctgaggtctccccagaagccaagcagatgttggcaccatgcttcttgtacagaattgtgagccagtttaaaacccttttcttttctttctttccttcctttcctttcctttcctttcctttcctttcctttcctttcctttcctttcctttcctttcctttcctttcctttcctttctcctttcctttcctttcccttcctttcctttcccttccttttttttttagacagagtttcactctgtcgcccaggctggagtgcagtggtgtggtcttgactcacgcaacctccacccgccaggttcaagtgattctcctgcctcagcctcccgagtagctgggatataggcactcgccaccacgcccagctgatttttgtatttttagtagagacaaggtttcaccacgttggccaggctggtcttgaactcctgacttcaggtgaccacccggctcagcctcccaaagtgctgggattacaggtgtgggattacatgcccggcaaaatccttttcttaataaatcacccagtctcaggtaattcttttttttttttcttttttttgagatggagtctcgctctgttgcccaggctggagtacagtggcgcaatctcggctcactgcaacctctgcctcccagattcaagtgattctcactgcctcggcctcctgagtagctgagattacaggcatgcacaaccatacccggctaattgtttgaatttttagtagacctggggtttcgccatgctggccaggctgctcttgaactcctgacctcaggtgatcccctgcctcggcctcccaaagtgctgggattgtaggcgtgagccatggtgcccagccgattgctgctaatattataaaagaggcacaggcagccatgatatgcctcctgatgaaagaatgattgccacctagacaggatcttgccaaaaaaaaatcagatctgaatccaatcaagcatctatagatccaactaccgattcaggaaatgcaaaggagaaagaatgtgcggcccggtgactctcaggcttccgagtgttcatgagtccctggcgggcttgccgggtgaaaagtctggtacagcaggtctgggtggggcttgagacattctgcattgctagcacgctccccggggaggccgtgctgctggcccacagactactcaccctgagtcgtgaggtgttagatgatgccatcatggtgcaaacggcaaaagcacatcaggataaactctaggggatgaacaacatggttttcttcaacaaatacattgaaagaaaggaaggagactgggcacagtggctcatgcctgtaatcccatcacttgtgaggccgagacaggcctgggcaacatggcaaaactgtgcctgttatctcagctactggggaggctgaggcatgagaatcacttgaacctgggaggtggaggttgcagtgagccgagatcacatcattgcactccagcctgggtgacagagtgagactttgtctcaaaaaaaaaaaaaaaaaaaagaatgaaagaaaggaaggaaggagattaaaacagtcttaagacacatcaaccagttgcagcaggggtccttcattgaatcatgattccaaaaaaagtgacacttgtgagataattggaaatttgaatactgaccaggttagttagctagggcaaagtaccataaactgagtggtttcttagaataacaaaaacttattttctccccattctggggctagaagttagatatcagctgttggcagggccacgcttcctggaaaggcgcttgggaaggtccctccttgcctcccccagcttctggtggccacagactttccctagcgtgtggcagcatcgtttctcatgtggcgttctccctgtgtcactttgctagtcttccctctgtgcgtgtctgtttctgtctaaatttccctttttgataaggacactaatcatgttgcatcagggcccaccctaatgacctcatttaagcttggttacctctgtatggaccctttctccaaataaggtcacattctgaggtccggggagtgggactgcagcatagctttctgttggggggtggggacacaacttaacccattacactagatttctgagactgtcaaggagatggcactaattttctaaggtgtcataatggtattatggttatgtttaaaaagtttctgttttcttttagataaacatccaaaagacttacaaatgaaatgttatgatatatacagtttgctgtagaatgatacgggggcggcaaatgtgcagcagtaatagacgaagtgaccctggctcatgtccataattgttgaacccaggggtatatggggtcagtatattattctgtttactttcataaaagtttgatgttttttataataaaggtaaaacaaaaagagaaaaacgaatagcaagcaacaaaaacaagaaactttccacagagctgactcggcccctcccttgaccctccttgtactcctggagagggtccccacgggcctcccccttgcacagcagcctggctggggcttccctcctaagtcccccatccccaggcttccttgtgcccagaaacttcccctgagccccgttgccaccagggctgcctccacgtggtgtccctgctcccagcccgctctcgcctgcacaggaagagccagtgcagtctttgccctcatgggggcagccaccactcagggaagagatgcccggccctggcacagctgcaggctggagctccgccccagtgggtactgctgtgagccagtctgctacatcctcgtcttcggccggcctgatggcctttgaaaggacagtggctgggatgtgcttctcttgagaaggaaaattcagcctgactccacttgggtcagctctcctcgcctggctctttgaggggctctgggccaggcctcaaaggcacggcattaaggcccaaagatcccctgggaggaaggccccatcagcagagggaaggaggctactagcgagtgccccctaagaactcctgtgatctctgtcccagggcccttcccctccagggggagagagccttctagaaccataaacaatgactacaagacaaacagccttgtgaccaatgatgggagcttgcaagtgtttacactgcgtagatcaacacctttaagaaaaaaacttaacaatgaagcaagtcttaggtaaaatgtcccctgacctctttcgggtcacacacggcatctcccaggcctttctccaagggcatcttccgaggctgaccccttccccaccatgatcccacagggctggaagggtggaagggaggaagtgcagggaaaaaggatgtagcaaggggtctcatgcactctatccatccatgtgaatatccctgtcctctataaataggaaaccatccaggcagatgttttttttctgcaagtgtagactgcgaactgcatgctgcggcctgaagaatcccaccagctagtgacgccccaagcacaccctgttctcccaccaggggtttccaccctgtctccaccctggaatctcagagagtttccaaatgcccctccccagatggaggagatcagaaccactttctagtttccccaagtgatggcaaggtgcagctagggtaggtgatcaggaaggtctctgtccagcatgagatgaggtgcccgaaggcgatggaaggcaggtgccaaggcacatttctggtggatggagactagtaataaaatgacagggacaacgttggggtaaagggtctcggattgggggaggatgaaaccagggtggagaacttgaataacggatgacattcaaaaagcacccactctgcaggggcctctttcaggctgctcttttttggcgtgactttggctccacaatggcccaggcggaagagccacagggatgctgaggccactgcaaccttcaaggtgggcgtttccaggcagaggaggcaagaacagttggtgggtgggccaagaaggaccttgcatcctgtctcagcgtctgtggactttgccttatttgtgaattttaagcagcatcagatttgtgctttagaaaaattgctgccatctgaagcggggatgggttggggagagactggagtcaggaaaaccaagtgaggaggctgttgccttgttgggaaataacaccaccatgcactgcagctggggctggaggtttggcggggagtggctaaggtggggagtgtgggtgggatgcagagatggggagatctccctttcccggaaggcatctggatgttcccagagttccccacagctctacaactcgggcaaagaaggtcagcccctttttctaagacggtcctcactcccagcctctttcttcaaggctcggtgcctccatgctccttgccaccattcatgctggtggaggaggctgcttgtgggttgctgtgaatatctcaactcttcctaggggaggtgagaagcctcctgcacacaggctatgttgccgccactctgtgtcaccagaaaccacatcagaaatttcccaagatttgatcaacatcaaattgatgacactttgacctgcaatctgccttggtatgtaaatatagctgttctttcagattagacgtcgacaggcttctatttctcctgcacaatcaaattggtttgatttgctgtttcagaaaccatgttctttacacttgatccccacacatctagtaatccctgtgcttaagagagaatgcaagagtccggagacacgagtaaagcccaaatggccagagccaggattcctcttagggagggaacccccattactcaacaaaacaccttcttgaagtatgctggaaggggatgagttgtggtttggaaggagacgggaaaacagagctaactgtcatatgaagaaataagctatgatttgatggccgggcccggtggctcacgcctgtaatcccagctgcttgggaggctgaagcaggcggatcgcttgagcccaggagttcgagaccagcctgggcaacagggcaaaaccccatctctactaaaaaatacaaaaattagccaggcgtggtggtgcgtgcctgtaatcccaactgctcaggacgctgaggcaggagtattgcttgagcccgggaggcggaggttgcagtaagctgagattgcgccactgaactccagcctgggcaacagagtaagactctgtcttaaaaaaaaaaaaagtaagaaagaaaaaagaaagaagctgtgatttgggagggcagagagctgaagagagggggaggggtgggaggaagggggcgccaggccacggaaaagggagccacaaacgaatcttggtgatggggttattgctgggctcctaattgcttttgtgaagggataataaaaacttagaacaccaattcactctgccaaaagaaaaaaaattaagctgaaagctgagttatgcaagaagctgcctttccttttgttcctaagcagatagtgacagataaaaagttaaagatctccacaggtagctcctctccattcaccttatcttatagtgagcaccaggccagttcattagtgactatgtgcccctacctgcttcttttctcttgcaacatttggattcagtaatgagaccacaccttccctctgtcccctccagctggcttttcctttttaaatattggagtgctcagaatcatctttggaaaaaggcatagacttgtctcttaggcacacatccttaaccctggcaaaataaacttctaaattgattgaggcctaccccagatactctctggtttacacttctataaatctctgtgagttagggtgttcctacttgatgaaggtttacactgctatcattaaagtgccccaaatcatcagtaaaatccactcaggtgtcttaggtgagccatcttgggagcacagggtggattaaggagaagcagtgcagttctaccttcaggctggtgcagagatgaaggacgtggcagatgagtgagaacgtgggtccacacggagtcacaggtgatcaggagaagagcagccaccagggcaccaggagaaatcttggagagagccctggacaggccacaggatgaaggctcggtggcatggccccacattgagcttccaaagtcagggcgaccccgaggaacacctgggttttatatagatatatacagaagccaccacatacacctgcccaccaggataaaactaccctgtttcaaggtacatattaaataaactcagctcaaagataatttctacagtaggactcaggattttttttttttttttggttttaagagactgactcaacccaaactgacataaagagggaaaaataatttattggttctttcatttagaaagtcaggggtagttggctgggcgcggtggctaatgtctgtaatcccagcactttgggaggccaaggtgggcggatcacgaggtcaggagatcgagaccatcctggctaacatgaagaaaccccgtctctaataaaataaaaaaattaaccaggcgtggtggcgggcacttgtagtcccagctacttgggaggctgaggcaggagaatggcatgaacccgggaggcagagcttgcagtgagcagagatcgcgtcactgcactccagcttgggcgacagagcgagactctgtctcaaaaaaaaaaaaaaaaaaagaaaatcaggggtagttgcaggcatggcggacttaggggctcattgggtcagcaggactccatgtttctcagatctgggcttccttctgaattctttcctgttggctccattctcaggcagcctgtcccctcctggtggcaggtggtgataatgaaatgcagagaattttgatgtgtccagaggaaattaaaccacacacacacacacacacacacacacacacacacacacacacacacacacacacagagaaatattcctgaataatgccaacagaaactcgttcccagggtgtagctggagagagtttccatgaacagaaacggggtttgcctttggagagagttctcttgtttcaagagaagagaaaaactggcagtagacccaaagcaagaggaaatttaagcaggtgggaggtcctttgggtcagagtcagcctggtctaagcctggcaggacaacctgcttgcttcccagcctcccttgcagctaggttggtcatgtgaccctgttctggccaatgaggcacaagcagaagccagcttggaggaatccaggcagaacttttgctgtccttggaaagcaggatggtagctgaggcctgggccaagccttcccctcttgtccttgagcacttgagttgggttcaccaatgctgcttctttcctcctggaccaaagccatgcctcggagtcccagcttaggaaaaggtttagttcttgctaaaccacacctatctatctatctatctatctatctatctatctatctatctacctatctatagagagagatagagatgtagatatataatagatatacacaacatatacatatatacacacatctatgtatgtattcttaattcttaattggtgtggtttagcaagaactaaacctatatatgcaactctctctctcatatatatatacatatatgcaacacacacacacatatatatatgcagagagagaaagacttgctctgtagctcaggctggagggcagtggtgctatcatagctcactgcagccttgaactcctgggcttaagcaatcctcttttttttgagatggagtttcgctcttgttgcccaggctggagtccaatggcatgatctcggctcactgcaacttccgcctccagggttgagtcttgcctcagactctcgagtagctgggattacaggcgactgccaccatgcccagctatttttgtatttttagtagagacaggattttaccatgttggccaggctggtctcgaactcctgacctcaggtgattcacctgcctcggcctcccaaagtgttgggattacaggcatgagccaccgcacccggcctcaagcaatcctcttgctcagcctcccaaagcactgagattacaggtgtgatccaccacagccagccaagaatatatatatatatatatattcttcaattacaaaagcaatacgtactcaatgtaaaaagttaaaataataccgaagtatgtataataagtgcagttccctcacctccccttgtctcactaaatcctgacactgcagaggtagccacggttcatggttttgggggaatcctccagacctttttctgtgctatatatatatatatatccatgtttgtgtatatgcgtatatatgtgccatcctgcagctgtccccactgaagtccgtgatgtccacacacatgaacatatctagatcagcctcattcttttgtgtggctccagatggccccatgctgggttcagtcttaacttatttaggtattcctctgtgagtggacactgagggcatcatttttttccatgagaatactagtatttgtagcttcattgtcttattttcccaagaaaaaagaagccactgtgattgttctcatcaatgacatgtagtgcgtggccgctgtgtacaggacagtgtgctctactgaggggtgtgggacagaacgggatgggattgcccgctcctgagggcttggctgagtggtggggagaagtatgtcaaaaggtgaggtcaccgcctgaggactgagtgaggtcgcctgggaggaggggcatgaacccaggtgtttgctggggtgggcctcatggcaggagaggccttcggtgctggctctggaaccctggggaggagtctgtggagggaggggtggtggggtggaggtgccctgggtcagggaacagggtggccagagatgccgagacaggaagaatgagcagacctggttcttcaggtgtgcccaggaagcaccgttctttctgacaaaagtgaaattaaggtgccagaactcattatctggcctttctccgcgttgcgaggcccatccttgcttctgtggtgttattttccctctctctctctctttttttaaaataaaaataactatgaagggttcaaggcgcctttctttcacaacatctcagctcttaggtcccagcggtgcatcggtggcaaagaatgtcccctgtcaccacggctgcttgcctttatttgaagtgtctggctgagctatctccctgtgacatgcttctttcagagcgaattattcatccccccacagcccccacctctcccggccctgggctctgttcatccccgcaggtgtgaagacaggcccggcctttgtgtgtgaggagcctgccccctccttggctcccctcttggatcccctccaggcctgtcaaggctttcctcgctccaggcccttgcggtgtgcggggctgatgtctcctgtcatccagggagggctgcgcagcctccagcccgcctctaatctccccctccacaaagggcagccctgtcactcagggaggcagtgggggaacctggatccggggccacacaatgaaccatccaccctgcctgagtaggaggaagcagcctagcagaggtggctgttggggcagagggcaggtgggcaggggcctgggcagagagagtgagagctcagccatcttaagccaccgaagtcagggaatcaagcttattttggtggagtacacaagtggcataggccaggtgcagtggctcacatctgtaatcccagcactttggggggctgaggcaggaggatggcttgaggccagaagttcaagactagcctgggcaacatggcgagaccctgtctctgcaaaaaataaaaaaaaaaagctggatgtggtggcgcccacctatagtcccagctactcaggaggctgaggtgggagggtcacttgagcccgggaggtggaagctgcagtgagctatgattgcacctctgcactccagcctgggtgacagagcgagaccctgtctccagcaaacaaataaataaaacaagtggcacagagcaagctggccaatcctggtagtgctggctaatggttagtgcagagggggcagtctcggtggctgacttggagccatcctacaaaaatgagggaggtacctatagaaatagggtcagcttccccatcctccaccagactccagaattcttcctcagcctcctgcattagtggtgatgaaaaaccgatgcagggatgcaggggtggagtgagcaagccgagaccagcctggtgcccagggtcaggagcctgctcttttgagcctcagtcccctgtgtgtccacaggaagcacagtgcctgctgcctgggggggcctgaagacacaggatgggtccccgtggtggaggtgcccgggcagcacctgcatatagcaggtgctcactgttggtgttggcatggtggcacagagcagaggtggaaagcaatgtgccgcctgcagacaggcttttgtgacctaccccgtgtctagaaatgtatcttctgagttactaacaaggaaaaatgtggccacacaaggtccaccttacttcaaggcatggcaggctgggtagagcagtgctgcccttggagatggcacagggtcccccctgcctgcacccctgggttctcctccacctcctgccactccccctttgtacaccagctggtgacactcagtcacaagctttcgttggctcctgagacatttgaggttgagagctctgggacctggagcagactcgggtttgcatcccaccacttcattcgcgacctgtgtagtcaaccttgctgagcctcagcgtccttatctgtaaaatgggactcacgatcttcaccaaatgaaaacaagcatacatcacctgcccctgaacctggaagagagagcggattcccaaccaaagagaagacacattgctgaggctgcctcaccatggctcactgctgacagcatggtgtgcactccacagggctcagctttccccgtgggtgggcagcgtgacccgggcaagcaggcagggctgccagggccttggcctcggcccagcacggagcgggcaggggctgtggccaagggtctctggaggaggccacgtctctgcagaggagacccctcctgaaacaccctccaagctggaagctggcccctcagaggggaaaacaggtgccgtgggcgactctgagctccccactgtaaattaatccacccgagcaattgggaacagaaagtgcttcctgtcccggcctgagacaatggacaataaacccagcctgctgggccccggcccctgaccccaaggcttcaggaagaggctcccacacgcacacacctgcggtgtgcgaagctcgcattgttctgggctcatggccgagtagggccccttgctctcaggagcctccagctctttctggacctgagccctgggagccttcactctgcccagatgtgcttcctgtggaaggagacccccagatgacacaggtgagcaagcgtccttgggttcgggttcatttgatgcgtattcttgaagcccctaccacgcacggggtctgcacaccagcagcacagtacaaagcctttccagaaaggctgtggtctcacacctagcaccagacagcacacgggcctgcccttctcctcctagcacacagacagggccatatacatcctgctggggaaggcccggtggaggcggctccttggagtgaaaggccctgaaatgccagaggctcctgggatgtgaggttccttctggatttctgaggctgataactgaatactcttgactcgaatagatgatgagcttgtggaacatcgtgtgcatgtgcacgccaccacgaagttagtaatcaatcttgcttgctggggccatgtgtgtgtccacattttgtcttttaattttttttgagatggagtcttgctctgtcacccaggctggaatgcagtggcatgatcttggctcactgaaacctctgcctcccggttcaagcaattctcctgcctcagcctcctgagtagctgggattacaggtatgcgcctccatgcccagctaatttttgtatttttagtagagatggggtttcaccatgttggccaggcgggtcttgaactactgacctcacgatctgctcacctcagtctcctaaagtgctgggattacaggcatgagccactgcgcctggcctcttgtcttttaattttattttgagttggggtctcactctgccactccgattggagtgcagtggtgctatcatagctcactgcagcctcaacctcctgggctaaagcaatcctcccacctcagcctcctgagtagctgggactacaggcatgcactgccattcctggttaggttttaaacatttttgtagagatggggtcttgctacgttgcctgggctggtctgaaactcctgggctcaagtgatcctcccacctcggcgtcccaaattgctgggattacaggcatgagccccacacccacctcaatgtcttttaaagtcattaaaagacaattattttgtctttttttttttgagacagagtctctctctgtcgcccaggctggagtgcagtggcacgatctcggctcactgcaagctccacctcccgggttcacgccattctcctgcctcagcctcctgagtagctgggactacaggcacccgccaccacagccggctaattttgtttttgtatttttagtagagatggggtttcaccgtgttagccaggatggtcttgatctcctgacctcatgatccgcccgccttggcctcccaaagtgctgggattacaggcgtgatccactgcacccggcctcattttgtcttttaatgaataatggactagcacagccttagagaaggaaagagcagaggttctatgtccagtcagtggggaactgggagattcattccgaaaggctttgaggaggaaccgggcccgggtcactctttgaaagggtggctctcccatttttcctgcagaaaatctgagcagtgggtgaggccgagggactgcccagagccccagagcacggcagtgggcaagcagtcgtccctgtcctgggcatccctgtggccatggagctcctgggtgagcagctgctctgagacaagtctggtgaagaatacagcaggactcctgaacattcttccttaaatgcttatctgtggaaaccagaactgcccttggcgcgtggctcgtggacgtgctgggtggctgggtggggcgggtgcacgggtggagcctcagctctgtttctttctctgggtagtgtccccactgccgggcttctcccgctctcagctctctggggaggtcccctgtgaagggcctgtctttcctgtcccctccctcggatcattaatgaaccactctctctctctttttccttttcagtgattgggctgtcggaatcaaagaggccctccggtgactcaggcgtttcccattgccctattctagcatcctctactcttagcactgagagtttttcacgtcctatttggaactgataggaaaccctttcattgtttcgctacatggatattagcactgatgaaggaagcgctccatcagatagtggtccgctgcagtgagctggtttccagcacgagcctgcctagactcagcgtctcccgcctccagggacccccagactctcagcccctaggcaccctgggccagggtggttggaagcttctaggcattgtggggtctctggcaccagagacactcgggggtctggggaccgagtttgggccctgtacccacccactaccatttgacatggtgagagagagagagagagatgacgagctcaggcagggatggcttctccagtgcccacaatgtgccaggactctgctgtgccactgtgggcctttcctcacccctccctcccagacatcaagctccggtttccagctgtgttccttgaagccgtcgggctctctggtgacagccacagagcctctgagcaactttgctttcagctattttccatgacccagtcctgggtaaggcttcatttgaatgaagggttctgctgctaaaaaaaaaaaaaaagtcggaaaaaccacctgatcacaactttctaaggcagctattttgttttgcaatgagatatttgcagtggtttcactaaagcctgatcttcccactggactgtcggcctgtgaggatgaggacgtgtctatcacagtcagtatgccctgaatgaatgggtgtcaccctcctccccctagtgagagataaggacctcaggctcagagaggttatgtggttttctcaaagccacacagcaagatttggcaggtgagccttacttctcttcctgggctagcctgcggtcaggggcaaggcttttggatgataagagtgaggtgcagtcagctctagattgggggtggcagagggaaaaggagggggggttcccaaagcaccattctgctttctgtgagaagggatttcccctcaacaacttctgtcccatttttcagagctaaagtgacaagccacatccacgtccctggttaaaggtgctccccctgcaggaaacacatgtgcacttgggatggagccctctgtgcgggagcggcttgctcacctctcagccagtgccagctgggtgggtctctcccagctctcgaatcctaactgcagccaccatttattcagcacctgttatgcaccaggcactttatgtatcttattgctaaccctcaaaacaagcccttcccaacataagcgcttttgtgccaaacccataggtctgaaactgagacccagagaggctgaatgacatgctcacagtcacacagcaggcagtggcaggcagtagtgaagtcggctctatggattgtatacctgggctcctccaggcctctgcgctgcccggcctgataccctagcaggttgggtattcagaggtgcctggggagcttgttaaaagtgtagattccaggcctccttacccttagagactgtgactcagtatccggggcagggcccaggcatcttcattttgacaggccgtcccggtggctgccatgcgcaggcaggttttaggaacatcatgggtggatgattcctggtctccccagccctcttgacctggccacagagagctgcctttccagcgaggtcagccgagatgacgctgccgggagagcagtcttctctgtagtccccggaggggactcctcggaggaaggatgagtctgagggttccggttgtcttggcctgagaccacccaaggtcttttaacagaaaaaaactttacccattcccagtgttgatttcatacctttattttatatatctatttttattgtggtgaaatacatataacaataaaattgctgggcgtggtggctcacgcctgtaatcccagcactttgggaggccgaggcgggcggatcacgaggtcaggagatccagacaatcctggccaacatggtgaaaccctgtctctactaaaaatacaaaaaaatagccgggtgtggctgcacacacctgtagtcccagctactcaggaggctgaggcaggagaatcggttgaacctgggaggtggaggcagcagtgagccgagatcgcaccactgcattcgagcctgggcgaaaaagtgagactccatctcaaacacaaacaaaacaaaacaaaacaaaacaaaacaataaaatttaccaccataaccattttaaagtatagagttcattggcatgagatacaatcatattgctgtgcaacactcaccactgttcatctccagaatgtttttcattgtcccaaactgaaattctgcacccattaaacactaactccccattctccctcctccagcccccggcaaccaccttctacttctctgtgtctgtgaatgtgactgctggggatcttatatgaatagaatcatgcagaacttgactttgtgtgcctggcttatttcactcagcatcatgtcctccaggttcaccgatgtggcagcagagctcagaacctccttcctttttaaggctgtgtaatagtccattgtgggacaggctgcattcatttatccattcatctgtagatggacacttgagtttctcccaccttttggctattgtgactttggcttattttaacattatataaaatgaggccaggcatggtagctcctacctgtaatcccagcactttgggaggctgaggtgggaggattgcttgagcctaggaggttgaggctgcagtaagctgagaccaagccattgcactccagcctgggccacagagcaagactctgtctctaaaaagtcagccaaccaatcaatcaatcgttcaatcaatctgtgctcacctaaagctaaacattggtactgtctactcctacaacaagatgaaaatgaaagataagttaaatccaaccaaaattacaagatgaataaaattcaagtgaatggtattagtctatgccaatgaataatgctgtcttgcttgaaacaggaatgtggtgctgatgggctcagtgcagcttccgtggaatctggcacattctgtaaccactgtgacaactcccttttcctcctccttttctctgtttgaactcctgcaaagcctcagtgtcttaaaacacatccaagtgccattgcccttctcttgtcatgaatgcgtcct

SEQ ID NO: 12165 - DNA, 6382 bp, Human
ccccacatacgcattatttcttgaggtctgtagctcctggtgaggggccccaggttcccgatgggcacctgagaggcccaggctctgaggcagggagcagtctgcccaaggtcacagtgccctcgatgtaccaggatttcttggaaaacggaaggctggaggcactgatttccaaggcccctcctggggctcccggcagccgagggcagatgccctgctcttggagccagaaaccttggctagctgccgccacactggtgacctccagcaggctatgctgtttcagagcctcggtctcctcctttgaagagcaggcccagtgatccttggctggtgtgccccatgcttgttggcaccaccagccaggcctgggcgggaaaagccctgcatgactcatgggcctgacatagaggggcatggcatggcattgttcttccttgcctccaagcctctctcccactgccctcaccacctctacctaccctgccaccaccaccctgggaacttgggtgccagcaaaccaaagaggtgaagcttccaggcctttgaccccaccaggaacggctaccctctcgcccactcaacaggttgattgaacacctactatgtgctaggtaggccttgtgctaggagatgcatcagtgcataaaaatccctgctttcattggcagggaacagacataaacaaacaagatcatgccagtcttgattataccaaaaagatgaaatggggcattttaataaagtaacttgcggaatagataaggtggttggggaagacctcctggagctgagacctcgatgatgagaaggagctggggaaagaggcttctagaaggaggaaagggctagtgcaaatgctctgaggttgtaatcagcttagtatttggggatgagccaagaggccagggaaggtggaggctgggggtgggtgaagggagtgggggtgatgaggctgcagaggtgcaaagggttcttccttcccagcccccagcatggtaggctgcgctgaggactgaggcccgggcttggcttccctcctgcttatgatgggaaggtgggggagcaggggagtggggagtgatgtgatctgatttatggtttggaaggattgctttggctgcggcaagcagccgggattggaggggctcaggaggaaggagggggagggcgagactgcagtggtccaggctgaaatgaggtggcttgctgaatgctcagagctccttgagcacacaacctagcgtctgtcgatttcacctcctggagaaaccttccctgactgctccgccagactcctcaccctctcccatctccagccccctcatccccggagctatctggctgctggtctgcaagcagctggagtccccagcatcacccagcccacagcctggcctgcaggaggcttctagtaaagtggccaattaatccccgagccccgtcttccagggtcatgcacacagtcacacgcgtgctcttcacatgtgtcaccctgcccccacacacactcacttggatctccagacaagggcttggagggtaggatgggcaatctagggggcaggaggggccctggagtctcctccattgagtgtgcaggcgatggtggccacagggtaataacaacctcagcgagatcctgaggtctgcccctccttaggaatggccaggcagggaagaagggagcagtgctcggtcccagcatcccaccactgccgagatggttctgagcgggttcctgggctgaggccggggcctgtgttttccaagattccttggagagccagctccatcctcttcctgattatctgatctttgggctacagcagaaggaaagagcagggcggaagcgagctctggaaagtggaaagaggagggtgtgcgaggagacccaaggcgggatctaggctttggaacgttggaggtttccggccacagaggcagggcctccggggagccaagaggggcggggagagacacacagagagaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaaggtgagctctggagtgtcagggagctatgggtggtgaactgtgggtctgggagggggtattgcaaggttagggaaatggacaatgaggagcgattgggatagtctcagaggagtgggagggtgatgggctcagagacaggactcaggcagcagagaatgagttatgagttggaaaggggtgaatggggcatcttggtggcaggctggggctcaccacccctcccctgccccagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatccgtgagtaaccagaagccctcacccccaaactcctaggccgccgcggtcactttcgcaaaaatgaagggtcggttcactgccaagtggcctttcagttgtccattgcccagcccagagcccccacacccctaggagccccaggtccacggccatgcctcctaaaggcctgggccactcgaccctaccttccaggagtccggggtgccccccccaccgccaccccgccctcaggagccctagatcccagttctccaggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcccggccgcttggcagggtgcagtccgcggcgcgcggggtggcacaccccctgcagcactcatctgggcccagccatgggcactggttgcaccaggtgcaccctaggtgtccggggcgggcagcagttcgggcagcagctgctgtgtgctcacggcacggggttcgcgcagctgggcggctgcacatgccgggcgcgggtgggcactccagacccgcgcggcacccgcactggggccgcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgaaaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcagtgaaggcagtcttggactttatctcctgcaggggaagccgggaagggccagaccctggtctttgggcgcgtgtcctggcctttggatgcctgttctgctttttacagatgtcatttgagccccagatggagtgatggagaaacacaggtgcatatgtacacacggtcatctgttctgtgcacagatggccggagtacacgcgtacaaacgctgtagacaccttcacctccatcgtgccctctctctcggcctttgggacccagggcctgccagttgtcccaggccttggtcttggtcctggtcaaagagatttgggaaacgtgaaggggctaaaggctctgacaagtccggcaggaaagagcccgtttaatttgtttaagtggcgtgtccaatttgtttccccagatgatatggtttcatggacttgttgggatgatatattgagacatggacttaaggactcacccaaccctgaagcttagacttcctcccaattttccctcctctgcttcctgccaatgaggccaggagccagtcccttcccctctgtgagcctcgggtttttcatctgaacgtgggcacaatccctcctactttgtgcggctcttgggatgttcaggtgagaccaggacagtgtgcatttggtggtggctgaacttgagccacacactaccttccgtcctcacctttttttttccttttttgagacacggtcttgctctttcgcccaggctggagtgcagtggtacaatcatggcttactgcagcctcaatcttctgggttcaagcagtcctcccaccttagccccccaagtagctgggactacaggcacgccccaccacacctggctaatttttgtatttttttatagaggttggttttcgccacgttgctcaggctggtcttgaactcctgagctcaagcaatctgccctcctgggcctcccaaagggctgggaatacaggcatgagccacagtgcctggctctccctcaccatttttcatacctttactccctgggggcagtgaagacacccaggagtccgccagccggggcctcagcatagtggccagctctgtctagaggagaggctctttggaaatcaccctagtacctcccccaaggttggcatcatgggcgtgaccctgacatcagggagcctaggaatggggatgtgaccctgtctgtccttaccactctgccccttcccttccttcagccattgcaccactgcctaaagggtcaccattggatccacacatgggaggagcaagccatcactgtcagcttggatagaggggagatcacccacccttctcccttcaggagacatttctcagccccacatccccagaggaatacagaataggagagtgggggtgtggcctggagtcagccttccatcagaaattcttctcatgctgagcttcagtttccccggggagggataggcagccctagatcttatagccaaccagaggtcagattaggcagacaatgatgagtatctattatttcccagaggggtctctgccctggcagagcttccattctggaaagtatttgggcatggtacaccatggctacccgcccagattctagagccagatggcccaggttccaatcctacctcagccacttatcttctgggagaacctgagtgagacataaccttgctacttctcagtgtctccatctgtactgtggggataataacagtattgatctagaatagtaccagacacagaggggtctttgcagttcccagatctgagcttcaccagggcaattcaacctcaccttcatctctctgtactctctcctgacactgtgcttttgtatatgcaaagatctccatcctccctcctctctagggtaaacacccacttccaagaattggataacacatcaccccaacaaccagcccttcccccagccccttgcggggttagggatcccctttggtatccacaaaccccttgttc

SEQ ID NO: 12166 - DNA, 92276 bp, Human
  misc_feature (1)...(92276): n = A,T,C or G
tgacccaccatgcctggctactatgtatatgtgtgtgtgtgtgtgtgtgtgtgtgtgtgtgtgtgtgtatatgtgtgtatatatatgtatgtatatacatgtgtatatatgtatgtatatatatgtatatatgtatgtatatgtatatatgtatgtatatatgtatatatgtatgtatatatgtgtatatatgtatgtatatatgtgtatatatatgtatgtgtatatatatgtatatatgtgtgttgtgtgtatatattatgtgcgtgtgtgtgtgtgtgtgtgtgtgtgtatatttatttatttattcattcccaagacagagtctcactctgtcgcccaggctggagtgcagtagtggtgtgatctcggctcactgcaatcttcacctcctgggttcaagcagttctcccacctcagcctcccgaatagctgggactgtaggtgcataccaccacacctggctaatttatgtatttttagtagagatagggttcaccatgttggccaggctggtcttgaactcctgagctcaagtgatccacccgtctcagcctcccaaagtgctgggattacaggtgtgagccaccacgcccagcctatttcctttggttctttttttttttttttttttttttaattatactttaagttctagggtacatgtgcacaacgtgcaggtttgttacatacgtatgcatgtgccatgttggtgtgctgcatccattaacttgtcatttacattaggtatatctcctaatgctatccctccccccaacccccaccccacaacaggatggaatagttactggcacatactggatgcccaataaatatttcttgaaagagttaatacctctttggtcacttgattattttttcttcttcccatgtttccctgtggagcatgtcttaactgatttgattcacattgacaatttctggtgtactatgtgcttagaataaataaatatcttaatagcactgtagtagttttgaaagagacacttatcatgtcagctgcttatgaaattttgttcccccctcttagttttcagatagaaccattcccactgataagcatgttgacctcctgatcaataagtatggattgtctgctcacccagttgctcctcagatgtttgggtatgctggaaaagaacatatggaaaaatatggtatgttacagttaaaaaactttgaggcttcttactagttatatacatgagatgagaaatgacagttatttattaaggaactgtggaggatgccaggatatataagatgtaaaatgttttttgaattaaatcgaagtaatagttcttgtagaacttagtcatagagaaagtatttatatatagactatggtatgggaagtacctagagtactctatagcaggaagttgaaataggaaaaataacacaaatcttgtctcctttaatcatggactataaattatttttttccaagctgagggtttcactctgttatgcaggttgggtgcagtggtgcgatctcggctcactgcaacttccatctcccaggctcaagcgatccttccaccccagcctctcgaatagctgggactacagatgtgcaccaccatgttcggctaattttttgtatttttggtagaggtggctttttgccatgttgcccaggctggtctcaaactctgagctcaagtgatccacctgtctcagcctcccaaagtgttgggattacaggcgtgagccaccatgactggccatggactataaattgaggatcttaaaatgtcaaccaagaagaggtgaaagatcaagctattcatactctacattcaatatatcagcaagccttttctctatattctcagtctatccatttctcaccatttctgctacttttgctgtagtggcataatttcgcacctgaaatttaggagtgttctaactggtttctctacttctgcttgtgcacctccagagtcaattctctactttatagccagagccatgcttttaaaatatatcagatcatttcactcctgtgcttaaaattctccattgtttctcatgacattcagattgaaacccaaatgtcttcttatggcctatgagcttctacatgatcattcccttcaccctcattagctctctgactgtatctccgaccattttttctttcactagtctgctccaaccacactatcctttctttctgttcctcaaacacaccaagcttttcttcaggtagggccttagcttctaccctaagattgtcagagccagctcccttgcttccatcaggtctttgcttaaaagccaccttctgctttctttcatcactctccttcccagaacttcctattcactatctcctgctttatcattttatatggcacctataataatctgacatatatctgacacatacatatatgtcagattattacaggtgccatataacatgatatatatatatatattcttgtttattgactcttccaaccagaatataagttcaacaaaagcatggatttttatttgtcttatttcctgcacattgattgttaacctagaatagtacctggctaaaccaaggataaaagaaaaaaaaaaaaaagaatagtgcctggcacaaatcagtgttgtgtaattaattcatctttaaaatttagaaagaccctccatgactattcaaatcaaagtagtcccctcctgttatcctctttcttagatagcttcatattgcttccttcatagcacttagcactatttatgttcatatatttatcatatgtgattttacttgtttaattttcatcttccttattagtctataaactccacgaaagcaggtccatgtctgctttgtttaccttgatatacacagccaagcacagagcttggcatgttatttaaccagaaagaagttttttttttttctttctcttctatagtctgcagcatatttaaatactcaagaaacatttattgaatgaaggagtgaatttccatatgtatgttatcttattcagctatcacaagaatccattatcggaggtgttattatctcattttataccagaagaatctgatattcagacaagtttttgaccaggatgatagggtcaataagtagcagagcctatgttccattctatttctgtctcactcaaaagcccttgcgcagccctttctcccagtaatagtagctgctctttgttgcgtgcctcacacatcttagatattttacacaccaaatataacaactattttaagaggtaagtgtatgcctatttttcatatgaggaacctgaagcttggagaatttgagtaacttcttctaataggtgataggagagggtttcacacccaaatctgccatactataaaacctccattcttttcattgtttctcatatagctatatttaattttaaataataaaaagcttttactgtatattaacttttagttttcttgtcattcctgtacatagttgagggacattaagtactttttgttagcatttattataggtacagaaacatgttttgcttgaaattttcatttgtgcttggctttccttttttcttttttgacctattttgtgaaggggaaggaaaactgaatattgtaatagcatttttgtttaaaaatcataaatattttaaattacttaattagataatgaatgtggccagattataatttgaaattaaatttgtttatggttgtcatttgaaaggtttgtcaaatttttttcttttctctctttttttttttttttttgagacagagtctcgctctggagtgcagtggcatgatcttggctcactgcaagctccgcctcctgggttcacgccattcttctgcctcagcctcccgagtagctgggactataggcacccgaccaccacacatggcattttttgtatttttagtagagacggggtttcaccatgttagccgggatggtctcaatctcctgacctcgtgatccgcccaactcagcctcccaaagtgctgggattacaggtgtgagccaccgtgcctggcccaggtttgtcgattttaaaagatgatatgcttcatttttagaggtatattgtaatatactttaaaaatattttgtttagaagtaatttcagactgaacaagaatgttgccaaaatagtacaagaattcctaatacttttcctctagattttctaaaaattaacattttgccatgcttgttgttttaatgaattctttttacctatattgctatgtaatttttaaaaaatgtaaggctgggtgctgtggctcacgcctgtaatcccagcactttgggaggccaaggcggacggatcctgaggtcaggagttcaagaccagcctggccaacatggtgaaaccccgtctctactaaaaatacaaaaaattagccgagcctggtagtgcacacctgtagtcccagctactcgggaggctgaggcaggagaattgcttgaacccgagaggtagaggttgtgagccgagatcgcgccactgcactctagcctgggcaacagagcgagactccatctcaaaaacaaacaaacaaacaaacaaacaacaacaacaaaattaatttaaaaaagtttgagagtaagttgcagttctttcatagtcactacagtgataaaaattgggaagttaatattgatatgatgctattatataatctacagacctcattctaaatttcaccagttatctcactaacatctttttctggcccaagagccctcatagtttttctttttcagtgttttcttgcctccatttatgcataggttatgtgcatgggttttttttgttttctccatttgaactttactctcaatttgttgagctccataaaaaatcttattggtatttttactaggattgtattaatcttgttaatttagggaaaactgatgtatttatgaggctgagttgtcctgtcaaagaacagggattatctttttatttattcagttctgtctttgtgtctttcaggagtgttttaaagttttcttcatatctaagtgttttatttcttgttaaacttattcctaaataccttctttaattcctttaatcatccttgctgctgctattgcacatggacttttcactggtgttatatcctccaaggtggtcgttgcttgtgtatacaaaggctactgatttttttttccccccaacatggagtcttgctccgttgcccaggctggagtgcaatggcatgatcttggcttactgcaatctccatctcctggattcaagcgattctcctgcctcagcctcccaagtagctgggattacaggtgcgcatcaccaagcttggctaatttttgtagtttttttttttttttattagagacctgattttaccatgttggccaggctggtcttgaactcctgacttcaagtgatccacctgcctcagcatcccgaagtgctgggattacaggtgtgagccacatacctggccagctattgagttttatatattaatcttatgacttgctatctcactgaagtttttaatttttgagttagttttattattgattttacttataggggtttccacatatgcagctatattatatcatctacaaaaagagatggttttactacttcttttctcattgtaatatttgaactgacttatctaattgtatttgcaaataccatcagtacaatgttaagtagcagtggaagacagtaagcatccttgtcctgttcctgatcttggtgttttaagtaaggtactgagttaagcacatagatatatctattatatgttgaaaaagtatccgtcagtgtctattttcttgagtttttttttttccaggaatgggtattgaattttgtagcttttccagtatctatggagataattgcattatgttccccacttagatctatggctggactattttagtaatggattcctaacagtaaaccaagtttgcatatctggaataaatgccggttgatcatggtgtattgctgtttttaacatggaattaggttctgttgctattattttatttagtaatttcaaatcattatttgtaagtgatatatatatatatattttattgttatcaagtttgggtgttaattttatactaaagaaataggggccagttgtggtggcttacgcctgtaatcccagcactttgggaggcagaggcaggcagatcacgaggtcaggagtttgagaccagcctggccaacatggcgaaaccccatttctactaaagatacaaaaaaaaaaaaaaattagccggcatggtggcatgcacctgtaatcccagctatttgggaggctaaggcaggagaatcacttcaacccgggaggtggaggttgcagtgagccgagatcatgccattgtactccagcctgggtgacaggacaagactccgtcttaaaaagaaataggagccacgcacgatggctcatgcctgtaatcccagcactttgggaggctaaggtggacggattacctgaggtcaggagttcgagatcagcctggtcagcatggtgaaaccctgtctctactaagaatacaaaaaaattagtcaggcatggtggcaggcgcctgtaatcccagctactcaggaggctgaggcaggaaaatcggttgaacctgggaggtggaggttgcagtgagccgagattgtgccactgcactccaccctgggcaacagactgggactcctcaattaaaaaaaaagaaataggaagctattttaatgctctgaaacaatttatggaactttgaaaccaactgctttgtaggtttggtagaattccttgtgagataatctgggcctggttctttctttttggcttggtaatctattttttttttttaatgtttaaacattctatatccaatggggccaattttggtagtctgtagttctccaggaaattatccacgtcatttagattttcaaatcaatttgtatagaagtctgaaaagtagtattttaacaatgtaaatttttatttctatttcaatgatattctcctcttgtcatttgtttattttgagatggagtcttgctctgttgcccaggctggagtgcagtggcactatcttggctcactgcaacctccactgttgctgtcaattgctatgggattgaacaaagggggacaaatgcagaaatgaagagaaagacaaaaagatctgttttgaaagaaggggtcagggggctccttgcttctagtgaacaagcaccctgagcttttacagcccttcatatttattaggtagaaagagcagggaggcagaggtaactgttggtccgctgcttgatttatcacaggtacacacaattgctttctttgtacaacaggtttccgatgttcctatagataatcacaaggaacactgtgcttggggtgtgactgccctcagcaccccttctggcagcagatgcagttgtcagttttccaacatcctgctttcatccagtttcctgtttgctcatatagcctccagtggtatactgagtcagtcacgaccctcactcttttggcctgtaacactctgcctcctgggttcaagcaattctcctgccccagcctcctgagtaactgagactacaggtgcgtgccaccatgcctggctaattttttgtatttttagtagagatggcgtttctccatgttggtcaggctggtctctaactcctgacctcaggtgatcggcccgtcttggcctcccaaagtgccagattacaggtgttagccaccacgccggcctctcttgtcatttattctttgtgtgcatttatggtttctcccttttcccttgatgaaattagctggtagtttgtctcttttgttaaatttttcaaaataacaggattttgattaattatgtctattctttctattctttaccctcattcatttcttcatcttcctggtactttcttttggtttactttattcttatttttagttttttgacttggagaattcaatattttatttcttgttaatataacagctttattgaggtataattcttatatcatataatttactcttttaaagtgtacaattcagtgatttttaatatattcacagagttgcatgaccatcaccatgattaatttcagaacatttcattaaccaaaaatgaaaccctgtacccattagcagtccattacctcctcttctagttcctggcagccactcatctactttgtttttctttggatttgcctattctggacattttatataaatgtacagttggcccttgaacaacagggggtttagtggtactgacctgcacagtcagaaattcatgtataacttttgattccccccgaatttaactaatagcctgctcttgaccagaagccttagtggtaacataaaaaattgatttacacatattttttatgttacatatattatacactatgctcataataaagtaagctagacaaaagaaaatgttattaaaatcataaggaagagaaaatatagttactattcattaagtggaaggtgatcatcttaaagatcttcatccttgttgctcttcttcttcatcattttcttgttgagtaggctgaggaggaaggggaaggttggtcttgctgtcccaggtggcagagacagaagaggtggaagaggaggcagaagaggcaggcatacttgatgtaactgtcattgaaaaaagtccccttatagtggacccatgcagcttaaacctgtgttgttcaagagtcaaatataatcaatatgtggcctttctggatatggtgatacacacctgtaatcccagcactttgggaggctgaggcaggtagatcgcttgagcccaggagttcaagaccagcctgggcaacatgatgaaaccacaaaagttagctggtgtggtggcacatgcctatagtctcagctacttgggaagctgaagtgggaggactgcttgagcctggaaggaggaggctgcagtaagccaaggtcgcacctctgcattccagcctggttgacagagtgtgaccctgtttttgtttgtttgtttgtttgttttttctaaaaaggccaggcacagtgactcacacctgtaatcccagcactttgggaggctgaggttgggggatcccctgaggtctggagttcaagaccagcctggccaacatggtgaaaccccatctctactaaaatacaaaaattagccgggcgtggtcgcgtgtgcctgtaatcccagcaactggggaggctgaggcaggagaactgcttgagcctgggaggtggaggttgcagtgagctgagattgcacctctgcactccagcccgggcggcagagctagactccatctcaaacaaacaaacaaacaaacaaacaaaaaaagtggccttttgtgactggcttctttaagttagtatattttcactgttcattcatgtcatagcatgtattaggacctcattcctttttactgcttaataatattccttatgtcattcatttattcttattaataaatggttagtggtatatattttcctgattactgtgttaaatgtatcacattgattctgatatgtagtattttcattatcattattttctgacaagttctataatttccatttctattttcattttttacccaagaattatttcatggaaatattttttaaatttccaggtggacttttaattttattagtaatttctagttttattgcctggtgatttgagtgtgttgtttgtagactgaggggattcttagttctatggtgccctcttctgtaagtgtagtagaatggggtcttgcaatactacccaggctgactctttttaggtgcaatcatggtgcaccacagccacaaacccctgggctcaggcaatactcctgtctcagcgtcctgagtcgctgggactacaggtgtaccttgtcctcttttgctgcttttctccttcaccgctcaattgcaccatacaaatgtcctcttacatacaaatgtcctcttatgctgcttttctccttcactactcaattgcaccaaaagggaccttgccctttcattttgcttttttttttcctctcagaacttatacctttaagattcccacctcagatctcctgtgtttttcagcccattccatatagtcatggtttgatctataggaatattttcttggtattttcacacttggggaggaggtctttcttttcttggtagtttagagcagttgttggcctgcgattatctcccctcttctctgcacagtttcctcagcctgcccatgtacccttaaaggtttgtgtagaaacgtgagcagttgttggctgggatttggtcttatatattttttcttttctttttcttttttttttaacttatagataatttgaaatttggcattttctattttctagttacgctgagagtatgatttgtgctattttattttttctggttattctgtattggttttagaggctatagagagacacagatttttttttttttttttttttttttgagacagagtctcagtctgttgcccaggctggagtgcagtggcgcaatctcagctcactgcaagctctgcctcccgggttcacgccattctcccgcctcagcctcccgagtagctgggactacagatgcccgccaccacgcctggctaatttttctgtatttttagtagagacggggtttcaccgtgttagccaggatggtctcgatatcccgacctcgtgatccacccgcctcggcctcccaaagtgctgggattacaggcgtgagccaccgctcccggccgagagacacagatttacgtggcctccatttttcctcaattacctggaaatcctgttactgatgtgtttttaagtgtatatattttctcaagttttacattgctcagaataattggacagttttctagtctaaaatttgaaatataaatgtacactattttagtggaaatgtcattgtagggaacaagggccttgaccctctgaaggttcactgaaaatcacttacatgaggcagattaacaggagaaaaggcatacaaatttatttaacgtgtgtacacgggaacattcagaatgaagactcaaaaaaatgggaaattgtccatttttatgcttaggttcaacaaagtatggaacagccctatagaaatatgattggacaaaaagcatatgatctaatgctaatagactgagtggagaaacccagccaggcctgtccatctaggttcttcttggcctctttgagcacacattccttccttctgggcgtggggcaggtccctttctggaatgggggtcttatgacccacagtcaaacaagataggtcagatagtttgtttatgaccagtttttacacagaaaggtggaggaagttaaagtaatatttctaggttttatgactggctttggggaaaaggagttctggtttctatgacctgccttggggaagagggattctagtttctatggttagcctcaggagagaatgggcctgagagacaggagggtaggagaaggtcagtgaaaaacttttgcttctgaggctatcatttgggggtattgtttctttattcttcattcgacagatttctaaatgaattgtagaattttatataatttaaattgttatttaaaattgctgtttgtgagtgttctgaatgtgcactagaaatgaatatgtaagaaagcttatagtagtttaaatcatttgtagaaccagccgagtttgtggtttcataattaaattataggatattaaaatagtttgacataaaggcatagcctttgaatagtcaaaaatcttaattggcaattcagaatcagtagtcaataagcccttcatcagtggccaggcttaataaatatgtaagtgactggcagaatatttttcaaggggatgctgtcttttattgattaatcagatcctatgttacgaaaaaaggaagaaaagatacgaacattattgaacatctcttatgtcagacaccatgccaagtactttactgttttagccacccttcttcctaccaatctatgcatggattgcttgcaaatctaatagagacaataaagcatgtgtacttcctaaaacaaggaatttgtcaccaactgaggccaccaatcccaatttttaggagattccaattgttacaattccctttttcatgttgaacccaaatctctcaccctatggtttgcatccatggtcttgtttttgtcttctgagaatgacagaaaaagcctattttaccttgtagcccttcaaatatctgaagccagcctgaccctatatttaatttcttctcttaactactctcattagacttgtttcataacccataagcagtctaattgctgtactgtgatcccatgtaagctattctgctagtcacatcacactatgaaatctcactgagcttgaggtttctcatagttgttgctcatttttgcaggttgttgtgggagttcaagaatagaactgagtgtttaatttatattctgatccatcctattgatagaccttgttgaaattcaacattatagcagtcccttccagctttaggtttggtgagagagcctctagttttcttactcactttgtaatagaaatattaacaagaccagagctgaggttagaagttagtgctagaaacttttctctaggtcaatgcattaattaatgcctgttgtttcacatgagtgtaatattgggaaatgcttcatactttaatcctcttctagatggtcataatgcacatagtgcaatagtaaaggctccaaatgtcttacagtaaagacgtgtttagctttgtttaaccatagtctaaacttatttgacagaagaaccctctttttttttttttggtaacaccaaaagataaaaatgaaaataaccccccaaaatcccacactacgatatttccttatcttgtccaaaatgttttgagaaatttcgttaattttcttgctgctgtccagatactatgttttctttgatctaacagtcaattcagtcacgaaaagataacacataatttgacttgtcttattcttattgaacccatattggcctcctcctgatcactattctttttttgagatggagtctcacgctgtcacctaggctggagtgcaatggcacaatctcggctcactgcaatctccgtcttccgggttcaagtgattctcctgcctcagcctcccaagtagctgagatgacaggtgtatgccactatacctagctaatttttgtgtttttactacgcctggctaatttttgtagttttactagagacagagtctcaccatgttgactagtctggtcttgaactcctgacctcaaatgatccacccaccttggcttcccaaaatgctggggttacaggcatgagccatcgcgcttggccctgatcactatttttattgttagaagatcacaagtgtggaatttatcttctctttttattagaattgagataagatttgcttaattatatgtatgtcatttttgctctgaagatcatcctccttgatagagaagagagagataaaacagacatggggaactttgtactttactgtgccattaatataacattatcagctctaattggtggctttcttttttctttggcctttacagcaccaaatgagaattcaaagcatattttattcagttttatctttttaaaagtagtaaaaaaaaattttttttgcgtgttttacctcattactgtacttttttttgttttcctgacacgattatttaaattttctgttaaggaatttaaaaggcatacatatttcttatcaggatataactcttctaaaaacttttctgttttatcataaggaaagggaggaagatgaaatatcttatcatgccctggagggtgtgagttgtgtaaaattctctcagtctagcgtactggggtgtttgacagactcctagaggaattgtagtgttctcctgccttaaaaccaccatgtttcttgtttttgaaactgggttctacttattttaattagaatagatcagtttgaactgtttttatcttatgtgcctattagttgattcagttcgttaattaggcccacatttaattataaataaaaattttttgagggaacagtgctgaagtctttaatactgatgatatatatgaaagggaaaatatggagatatttagcagaacactgagtaccattgcaagatttgttaataagcagcggaaaaacattcacccactggtagatgtttgctttctttacaggaacaaaaattgaacactttgcaaaaattggatggaaaaatcataaacattcagttaataacccgtaagtatttcagagacatgaaataatgaaaatctgggttatcctactgtataatatgcaactttatacttgaaaagcaaatgccaagatctcaaatattttaactagaatgttttatttttttcttacaaaaggcttatacgcaagtaaacttttgacaacttttcagttccagtttttggccactttatatttagaatatcatttaggctaatgaccctttttcttttttttgagacagagcctcgctgtgtcatccaggctggagtgcagtggcgtgatctcggctgcctgcaacctctacctccctagtagctgggactacaggagccaccatgcccggctaattattattattattttttttagatggcatctcactctgtcacccaggctggaatgcagtggcatgatctcggctcactgcaacctctgtgccctgggttcaagcgattctcctgcctcagcctcccgagtagctgggattacaggcacctgccacagcacctggctaatttttgtatttttagtagagacagggtttcaccatcttggccaggctggtcttgaactttgacctcgtgatccacctgcctctgcctcccaaagtgctgggattacaggtgtgagccaccgcacccagcctgtatttttagttgagacgagcttttgccatgttggccaggctggtcttgaactcctgacctcaggtgatctgcctgccttggcctcccaaagtgctggggttacaggtgtgagccaccatgcctggctaattgtacatttatttaaaagctccattagccttaattaatgtacttgtataatattatcggctcaaaagttggctgaattgcaggtgatttgattttgcttttaaggaactagtattctttaatttgccaggaaacataaatatggtattctgttttaatccccaactggtctaacaccaactgggtatattgcaactcaattctggcatgaagcgcctaggagttaatgcaaactccatgaattaaggacccagtcctccacaagactgctcatacgtcagacattagctgcaagtgggatgcccatgccacccatattttgaccaactgaccacaaatccaggggctcccatgactccctcagattcaataattcactagaacaacttacagaactcaggaaagtacttaaaattacagttttattataaaggatataaatcagaaacagtcaaatgaagaggcatatagagtgaggtctgggagcatcccaagcaaagctttcttgccttttccctatggagtcagggcatgtcatcctccggatacatcaagacgttcaccaatcaggaagccccgctgaacaccatgtccagattttttactggggcttcattatgtcagcatgctagattaaatcactggccacataactgaactcaatctccagccttcctcttcttctcagaggttgagctggctcaaaagtctcaactctgtagtcacatggttggtcttttggtggtcagtctcccattttcaagataacaaggcccaccataagtgacctcattagcataacaaagacacttctatcattcaggaaattccaagggctttggaagctccaagccaggaacccaggacaaagaccaaattttaaaaaataaaacatactgtattttagagttaggattttttaaaaggtcaattcagatgacatttatggctattcataaaaatctgtcttctggttgtgaaaataatatttacatattattctgtttcttactctgcaacaaaaattacagttgctatctcacattctgtaactaatatttattttgtatttaggtattcccagttccaagatgaatacagtttagatgaagtgatggcatctaaagaagtttttgattttttgactatcttacaatgttggtaagaaaaatatattttaacatttaatgagggaagtaactgctgcccttcctgccacccccctgtggttaaaccttaggctctgcatctgggcggagctttcacagaactcctcccagtgccgtccccactctgggtcacttcactagagtaccctacttcttactcctgcctggagacagactgtctcttctcttggaaaatgatgtgttttacttcttcttgcaggacttctacctactttggtgattgcaattgtatttattcattaaactgtggcttgggggccagtggagcccaaagcattttgttttccctgctatgtacttctactacaggaaattctactctataatagtagctatgagtaaaagtaaaacaaggaaaaattcatagctctaatgatgataacagttgtttcttgcaaagtgcttgacagtatctgtctcctagaaaattgagtgagtactgcttagctcctgcctgtgtcctagttaacacctggctgtgccctgtagatacaggctgggatggaaagaaataagtcgggtcagcttttatttgttgtgatatgagggtctgcccatttagaaagtctaactgaactcccagaagacttcttgtgtttgctaccttccatcacagtttgctgtaagaaaaagatctgtttaagatctcgagagtcttaactaaagcagatggttttgtattcccaagctatcttttcccagtttccaaaaggatttcaggactgagttatttggagatagcaaagttggagctggggcggtctgtagtagaatctttattgtattaggataggaataaccttttggacttactcctcagaagatgccttatgcatctccagaggcaaattggtaattctttgcaataagaactttttggggctgggcgtggtagctcacgcctgtaatcccagcacattggaaggccgaggcgggcggatcacctgaggttgggagttcgagaccaacctgaccaacatggagaaactccgtctctactaaaaatacaaaattagccaggcgtggtagcgcatgcctgtaatctcagctactcaggaggctgaggcagaagaatcacttgaaccggggaggaggaggttgcagttgcaatgagccaagataacaccattatactccagcctaggcaacaagagcgaaactccatctcaaaaaaaaaaaaaagaactttttgggactcttagattccaagtagtgattgacaacatttaagttcttgatagaggttcagtcctcaggtgggaagcatgtgtgatttacaactgtagatatcacaaagaagacaatccactgaccagcaagcatatttggcctttcctttcacatagaagtaactcctagtctgaaatcctccgatcaggtgctactgggtgtggagaattatttttacttcctcttagtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggtatgtctgagattctatttgttatttttatttttaagatggagtctcatgattcttgtgatggagccatgcattattatataataacttttaattaactagacatgctatttgtcattattttaagttgactatgcctagaactccaatcttacagagttaagggaaaaatgattgttttgttttgttgttctttcttttcttttctttctttcaacagggtcttactctgtcactcaggctgcagtgcagtagtgcgatctcagcttactatagcttccacatcccaggctcaatcaatcctcccacttcagcctcccaagtggctgggactacaggcacatgccacgactgccggctaatgtttgtattttttgtagagacacagttttgccatgtttcccaggctggtcttgaattcctggctcaagtgatccacctgcctcagccttccaaaatgctgggattacaggcgtgaatcaccacacactgccacaaagatgattttaatgaactttcttgaccctcagcactttaaaaattctgaataaagattgagtacaaaatggaaaaagtaaaaaagatgaaaattcagacctagagttagttgaatatttgaagacatacacacaatacacaaaattgcatgctaaattatagtttacaaatgattttacaacaacactgtgaactggaaaatgtttttgtaactgcccaagatcacagttaggttgtggcagaggtggaatttatatttaggtttcctggttatagtacatttttcattataccacagttttatttctttttctttttctctttgagacaggatcttgctttgttgcccaggctggagcgtggtggtgcgatcatagctcactgcaacctctgcctcctagtctcaagcaatcctcccacttcagcctctcgagaaagtgggactacaggcatgtgccaccacatctggctaagtttttgtattttttttttttttgtaaagacacgattttgccatgttacccaggctggtcttgaactcctggactcaagcgattcacctgcctcggcctcccaaagtgccaaagtgctgggattacaggcatgagccaccacgcctggcctcaccgttttattccttgaagaaaagttattttattatttgaggagaaaaacatgttaagaacatggactttggaaaaatggtttgaatcctagatgatcttctaaaagaagattgtgtcattttatatagaaattctcccatatttttcagtgtatctgactcataatgatctggtaataaatgtcttcaacttgtttatcacaactatacattgtagtttgacagaagttttgtaacttagcacaagatatgctctgaggaattctaggtcctttttatatattttatttaaaaattctgtcattttttagtacaaaattgaatatgtacatccttctcctagatgttattttatttagactttctgtgtaatatagaatcaattgactgaccctccttccctccctccctcccttccttcctccctttctttccctttccctttcctctctttctttcttttcttcttttcttcttctcttctttttttgtttcttttttgagacaggatcttgctctttcatccaggctggaattcagtggggtgatcctggttccctgcagccttgacctcctgtgctcaaacgatcctcccagctcagcctcccaagtatctgggaccacaggcacatactaccacgccaggctaatttttaaattatttgtagagacaggatcttccattgttgcccaggctggtctcaaactcctgggctcaagcgatcctcctgcctcagcttcccaaagtgcttggattataggcatgagccaatgcacctgggcaaaaatttaatatatgtggtcaattatcagttgttaaggttatgcatctattaatctcttaaaatacttgtttaaaaggcccagttttggtgccctttatttatatatggttttggttttaggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggtaacatctttgaatagggcagattaattcagtaaatttcactgagaaaacttcactttgaccgttagataaaagaattcactattcacttttcccttaacgttggctctgccacactgtgggaaatgaatgtaagctgttttggtagtggacgttttagaacttgtggtattaggcagtaccaacactaagatgatggagtgtccagataatttgtattatgattatattatttgtctggaaggctcttttatctgaccaaaatagctactccatctttcttatgcttattctttgcatgagattttattcatttgctttcaacctatttatgttaatttatttaaagtgtatctcttataggcagcatgtaagcaataatttttttttgttttttcgtttttctgagacggagactctctctgtagcccaggctggagtgcagtggtgcaatctcagctcaatgcaacctccacctcctgggttcaagtgattctcctgcctcagcctcctgtgtagccgggattacaggcacctgccaacacgcccggctaatttttgtatttttagtagagacagggtttcaccatgttggccaggctcatctcaaactcctgacctcaggtgatccacccacctaggcttcctaaagtgctggaattataggcgtgagccactgcgcccagccgtgataatgtattttttaaaatctactttgttgatttctgccttttaactggagtgtcgaaacctgtgctgataatgacagccactagctatactttagtctttgaaatgtagctagtccaaattgacgtgtgctgtaagtgtgaagtacacatggagttttggagacttaatattgaaaaatagaatgtaaagtatttcattaataatttttttttttttttgagacagagtctcgctttgtcacccaggctggagtgcaatggtgtgatctcggctcattgcaacttctgcctcctgggttcaagcagttcttgtgcctcagcctcccgagtattacaggtgtgcatgctaccatgcccagctaatttttgtaattttagtagagacagggtttcaccatgttgcgcgggctgttctcaaactcctggcttcaagtgatccacccgcctcagcctcccaaagtgctggggttgcaagcatgagccacctggctcactgataatttctttatgttgattacatgttgaatgaaaatattttatatatatataaaatgtatatattaaataaaatatatactagaaaatttaaaagtattgtgtgggcattatatttctgttagacaatatttatttagataattaatgtaattattgatacagtaggatttaggttggtcatttaattatctgttttctatttgtcccctgtaatttttgttcctctgtgcccctcctcttgacttcttttgcattatttaaatatttttagtatgccatttcaacttatcgattgtttttttcaccatatctctttgttttttcttctttgtttatcccagtggttgctatagagcatggtttatcaaccttggcactattgacatttgagctctatcattcttgtgatacagcttgtgcatggtaggatattcagcaatatccctgcctcttacctactaaatgccagtagcaccaccccccacagttgtaacaaccataaaatgtcttcaaatattgtcaaatgtcttctggggggtaaaatctctcccagttggcagggcgcggtggctcaggcctataatcccagcactttgggaggccaaggcgggcagataacgaggtcaggagatcgagaccatcctggctaacacggtgaaaccccctctctactaaaaatacaaaaaattagccgggcatggtgttgggcacctgtagtcccaactacttgggaggctgaggcaggagaatggcgtgaacctgggaggcggagcttgcagggagctgatatcataccactgcactccagcctgggtgacagagcgagactccatctcaaaaaaacaaaaaaacaaaaaactcttccagttgagaaccactgcgataagaattatagtatgcctccttaagcgtctcctttgagttaatattgtaccacttcacataaaatgtagaagccttgcaaccatataggtccattcactgactcccctttgccgtacactgtcccttatgttataattgtcatatgtgttatatctatttacattgaaaaccccaatatataatattataagttttgctttcaacagtcatacacttagatgtctgttatatgtcatgggtaaaaatgtcacacataattttaaagatactaagagggaaaaagtattttatacttatccagatatttatcattttttgttgctcttcattcttgaacacccaagtttttctctgtaatcattttctttagcctaaggaactttttgtagcattttttataaagcagatcttttggagatgaattctcttagttttccttcaactgaaaatgtctttgcttaaccttaattcctaaaggaactctgggctgattatagaattctaggttgacaggtcttttagcacttaaaacatgttgtttcagtcttctgaccgccatagtttctaacgaggagtcatggtcattcaaattgttgtttctctgtatgtgatgggccatttttctctagctattctcaagatttttagcagtttgattgtgtaatgtctaggcatggttttcttttaatttattctctgttgtgttttctgagtttcttaagtctgaaaatgcaaaacttttaccaaatttggcaagttttcagccattatttctttaaatgtatgttctgtcccaattttttcctcctcttcttctggacttccaatgatgcatatattagacctttggatattgtcccataggtccctgaaactgttcactttgaatccccttttctctctgttcttcacatttgataatttatgttgatatatctttaaattcactgactcttccttcatgttctttctactcatgaaccattctaatgagttttctatttcaaatattgtattttcagttctaaaatttccatttggttcattttatagtttctatttctctgctgagagcttacatctttttgttcatttctagtgggctttctttaccttgtagttctaacagctgttttaaagtctttaataattccataatctgggctttcttgggttttgcatctgttgattgtcttttaccttgagagtattggttacattttctgattctttgtatagcaaacaattttggattgtatcctggacagggtgaatgtcctattatatagatcctttggagaatgttgatgtttttgttttagcaagcatttaagccagtatgttctgacaataagttctgtcttgccttctgagggtggtggttaaagtctttgctcagctctctaaatgtatgcctacgtcagagtaagcctgagacttgtacaggtctatacacagaattaggggatcctcttctctggctctctccactatagacttcttcccttactctccagcctgcagagatttcttttcctagttcctttggttaggaagatggggtttctgttagagttttagctacctttgctgtttctgctgccatgctgttccagggctgtgctcaaccttggggcaaagctgttgagagagagagagcctaaaaagaaaaaaagacaaccaggacctcacccttatgcagtggcttctccaagttttgacttgctctataatccccctgcttttatttacttttcagagtcctcaggcagttttttttatttttatttttatatccagtgttttcagttgtaatcaatgcaagagataaactgtagtgaacatattctgcctaatatggaacttaatctaaaagttaaatattttatgtagatacagatataaaatgattactttcttttttttttttttctttgagatggagtttctctcttgttgcccaggctggagtgcagtggcgctatctcagctcaccacaacctccgctacctgggttcaagtgattctcctgcctcagcctcccgagtagctgggattgcaggcatgcgccaccatgcccagctaattttgtatttttagtagagacggggtttcaccatgttggccaggctggtctcgaactcctgacctcaggtgatctgcccgccttggcctcccaaagtgctgggattataggtgtgagccaccacacccagcttttcttctttttttttttttccgagacagttttgctcttgctgcccaggctggagtacaatggtgagatctcagctcactgcaacctccccttctcaggttcaggcgattctcctgcctcagcctcccgagtagctgggattacaggggtacaccaccacgcccggctaatttttgcatattttttagtagagacgggatttcaccatgttggtcaggctggtctcgaactcctgacctcaggtgatccacccaccccagcctcccaaagtgctgggattacaggtgtgagccaccaggcctggccaaaatgattactttcaaacttatactccttgcttgaactgcttctccaacctctagactcaagaatccagctgcctactttttaggggtttctttggatgtctcataagcatctcaaacctaagtccaaaattgagctatggatatttttcaaactttctcctccctcagtcttccccatcctcctgttgcttaaactggaaaccatcaggcttgaattcttttctctctctcacaatcatcattaaatctatctctaagtcctgttggctatggactctaccttcaaaataaatccagaatatgaccacatctcaccacttttgtcactgccagcctagtgcagaacagcatcgtttctcatttatattattgttggagtcttatggctggtcccgtgcttctgccttgtctctccagactgaagctagaatgtgcagcaaatcagttcattaattcattcaaaacccagtagtttctcaactcactcagacgaacaagccaaatatgatctgtcctccttactccccactcccatctctgacttcctctgcttttctctgaatcttctactctgctgcagccacattggcttccttcttcaagcactggaagctcgctcctgtttcagggcctttgttccaaacatacatgatttgctctctcactcccttcaggtctttgactaatgtccttctcagtggaagccttctccgatcactttgtttgaaatataaaccactcacctccatcttccttgtctcaatgtgtcctataccctttccctgctttcttttttcccttggcatttatcaccactttacatatttctttacttattttatatattgtctgtcttttcctcacccctctccccacataacttaaactccatgatagtagggattttcgtttggttcactattgtatccataagttcctagtttagtttttggtacagaacaggtataataattgttttccaaaagcgtatgcatttgttttcctatctatgctaggggagagcgttcatttacagtactttaatctctgaatatttttagttgatgagttcaagataacttccctttggaatcttttaatactttacaagattgtatatattataggaaaagtgtagtgaattattcacttttaggggttagcttgtgtttagtttgctattacttgctacagaaacaatatttagcagtttgtaagtagcaatagtagatagatttatctcttatgactagagcctcagagcaatttccaaggtagaaacataccaaaaaataaaagagagaatgccttagccaatggttttatctataacctagatttaaagccaaattagaagtgtcagtcatctaaaatcctgtgattagtgtatttcattttaccaacagaggaacttttgtttttgaaggcaatataatatattagctgagaacacaggctgtggagccaggctccctgagtattaatcctagatctcttgctgttgccttggttgatttcttaatatctctgtctgttttctcatctaggaaatgagaatgatagcacctacttcataggattgaatattaaattttataaatagtcatcactcagtatctgtggggttttttttctaagacctcccacagataccaaaatccatggaagctgcttatataaaatggcataatttttgcatataacctatgcacaccctcctgtatattttaaataatctctagattacgtataataactacatatcacttcattcacatggattcaatgtagtactcagcacatacaaattgaagttttgctttttgtaatttttttcttctgtatatatatatatatatatatttttttttttttttttttgagacagagttttgctcttgtcgcccaggggtgcaccaccatgcctggctaatttttgtatttttagtagagatggggtttcaccatgttggccaggctggtctcgaactcctgacctcaggtgatctacctgcctcggcctcccaaagttctgggattacaggcatcagccatggtgccctgcctcttctgaatatttttgatttgtggatggttgaatccatgatgtggaacccatggatgctgactatatatacagaaaataattagaacaagagctgacccagagtgagtgctcaaagctattagctacctttgacagcattgccaccatcattactatcattatttggagcgtccacatcttattactttatcgtaaatagatgtggaagacaattttatacaatacatccatttttatttacttcttaagcatctggaagaatgaccaaatgaccaggaaattgacaggaacattgaagccaccaagcatgtgaagtaattttttctttaaccttacttttgtggctcaacagtgttttcagacatttctcttcattttatgaaagtgccttttttctcctgtttttccatatttattaaaaatacttatatagtatatagcagtacagatgaaaatagaaaagaacacattttggcaaaattatgcatttttaaagctgacagttattttagttatagcattatatccatttcagttctattctcctagttctctgaatctctaccatatttagagcaattttggaagtcagagagctctaaggaactaataggagcttttgtttcatacaggaaatgttctgaaaatgtaagtatttattacttttaaaagtgcttatgtcaaattattgttagtttgaactgttaagaaatatttgctccaagaaattcttggctatatggaaatcttataaaagcatatcatttgttctattgttactattaatatttgtgaatactattttttcttctataggacaaggtgcaacgctggttgatagaggagataatacatatggaggaaagtgggtcataaatcctagtggtggactgatttcaaagggacacccactaggcgctacaggtaatgctacatacagatttcatacattttaaaatcattttttccttaagtgtgaatgagttagtctttcatttgaatgaaagattatattctctgaacttggtagctggtgctttaaatgattgtttagcttcaatatttttgatgttccattaagtagagcacacttaaataatcttcattaattgatgagaatttgaattaattaaaactaaattcaggatgtttccaaatagagatcttactagacctgctaaataagaatcatttgaaatgagcatgttatttatatgtagttgtatacatggttgacattgcatggaaattattttctcttgagacaactggactagaatttataaagtaagaattttactatggctctgctgttgactggctggccgtgtgaaactatttttatcagtcaatcactttaacttttaattccttaattataaaatgacaaacttgtacaatgtggtttctgtttttttaaataaaaaattaagcccaaacctcaccatgcaattccttttttctttctttcttttctttttttttttttttgagatggagtctcgctctgttgcccaggctggaaagaagtggcacaatttcggctcattgcagcccctgcctcccgggttcaagccattctcctgccttagcctcctgagtagctgggactacaggcttgtgccaccatgcccagctaatttttgtatttttttttttagtagagatggagtttcaccatgttggccaggctggtcttgaactcctgacctcaagtgatccacctgcctcagcctcccagagtgctgggattaccggcatgggccacacacggccacaacatgcatttttaatatatcacagtctaccttcaaatagtgttatgccattttgtatataacgtaagatttttacagctgcctatctatttaccttctcctatcttttgtgttattgtttccatacacttattcctaagtatattataaccctcacaatatactattattattgttgctttaaacaatctaatatctttcaaagaaatctaagaattatggggatgatcagtgatgttatgggaagtggcaaaataacaacatccaaaaatcctgtcctttataaaagttcggagaactctggcaaaaattgtcaagatcaactttttccataactttaaaaattaaccagatttacaacaatctgttgggagtggaggtggggggtgcttaaaacaacaacaaagaacataatctctgtgagagcaacgagctttgtggcattttcacctgccttaacacctccctctttctgcagctccactgtagccttgaaaacctacagcttgcagtcatggtgaaaattagcagcctagctggcactgagcaagtcagaacagagttggagctctttcaaagccccttccttagagaactgtcattatatgacctgtctgacagtgtcctggtaaaccccacttgaaagctttgtctttatttcacctcactgaaaactcacccagtgcaaagagtattttccctagaggcaattgtcgagaaaaatcagccacaactgttcaacaaagtagctacctcaggtgccaattggggtaaacaacaaaataaccaaaaaaaaggaaaagttggggagtaggatgtccatagggggctttgaaaagatctgatatgttcctgagaatctagaagcctaatggcgtatataaggtcagagttgtgtgcatgctcaggaaagacctgagaaggtcctaagctcacctctggctaaacttggggctctgcacaagcaaaaggcaaaggctaaggtagaattgtaaactgcctggctgagtaccacattatgcaggtagaggtccagtaaagaccaggagactttttagttcagtcatttaaggacatctctgtccagtcagtagctgagggaagagaaaattcagtggccatgtgggacaaagattacagactttatagaattagcttggaaaagtcactaaataaacaaccacaacaataaacagcaacaacaacaacaacaaactgggaaagaggaggatttgatttttagagaagctacattatttaaaatgtccagttttcaacaaaaaaaaagaaagacatgcagataaacaataaagggtgacctatgtacctaggaaaaaaagcagtcaatagagactatccctgaggaagccaaaacattggacttactagacaaagactttaactagctattttaaatatattaaaggaaaccatatataaagaactaaaggaaagtatgagaacaatgtttctccaggtagagaatattaataaatagaaattataaaaaagacaaccaggcacggtgggtcaggagatcaagaccatcctggctaacgcagtgaaacaccgtctctactaaaaatacaaaaagttagccaggcgtggtggcgggcgcctgcagtcccagctacttgggaggctgaggcaggagaatggcgtgaacccgggaggcggagcttgcagtgagccgagatcatgccactgcactccagcctggacgacagagtgagactccgtctcaaaaaaaaaaaaaaaaaaaaaaaaaaattaaaggtataggtggagaagaagaaccatttaagaataatgagagggaatgctcagttagccaaggaaggagagtgtttcaaaagtaagagattaggccacaaaagttagatagataaagaatgaaaagtgtccttcagatttggctgttacaaagtcgttggcaatcttggagcaattttgaagaagtgttttgcatggaagcagatgagattcagaaagaattataagtgagaaagtggcaataatagtgcaggtacacttttagaaatagtggctatgaatggaaagtgatatatatgtaagggatgtacctgaattataggtacgtgttctgtatgaatgaagtcttgggtttgaacctagcctcttcactctctttagtatgtagcttagccagttaatcctagtttcttatctataaaatgggaatatagtacctaccttataaggctgttctgtggattaagtgaggaaatatatgtatgtaaagtatatagtagagtcccccaaaaagagtaggaacacaataacttccagaattcccttcccaactacaaaagggagccatgatggatctgcttaactggttcttgtttgtttgtttgccagtaataaacctcttgttttttttttcttttttcttttttttttccttgaaacggagtcttgctttgtcgcccaggctggagcgcagtagcgcgatcttggctcactgcaacctccgcctcccaggttcaagcgattcttctgcctcagcctcccaagtagccgggattatgggcatgtgccaccacgcccagctaatttttgtatttttagtggagacagggtttcaccaggttggtcaggctggtcttgaactcctgaccttgtgatctgcctgcctcggcctcccaaagtgctgggattacaggcatgaaccaccacgcccagcccaaacctcttgtttttatcacagtatgaaaaataatttttaaccatttttggaaaagaatgttctttaatttggtttttttttttgtgataacagatcaattttaattctagtacctgaagctatacaagggtatgctctataaacttcatgggactgttgtacacacttgataaagtgacaactgtgcaataccacttagcatctcaaaatcaggaacatactattgaattgcttaaacacaatccacagaattaaaaacaaaatcagatgccatccacagttatactaattatccattaaaagcttacacttaatacttgaaataacaatcaatatctagcagggaatactgaaagtgatttcagagtctcatcctgttgtactctattgggaaggtttcttgagtagttatgtgactggccaaagatgggtacaaccaagaccagaccagcaagtaaaagttctaccacagtttctgtagtttccacttgtttttctttgtcagttaaaagtgaacagtgagaattaaatacttatctttacatatacacaaggtatgctatgaaagcatatctgcttacaaacatataaaaatacttgttaactagtttgataagaaaataatgtataaaagtatatagcaaaaacattaatcatctctgaccctggaaagatcaattccatattttatattacaaacaaaaacagttttagttttttgaatcccttacccagaaatacttgaaaaggaagacagaagaaattattcctttttacccttagcgtggctgtgaaaaagagttaaattaaaaaaccaagtacactgaaatatctaagtcctaaatgagtccaaatatttgaccacgtagaatattaccatcttcaagagtaggagcagtaacacaggcttttatgagcagtttttaatccataaatacaataggcatttggtattttggccaccagaaaacaaaagttgtagtataagtaaaggtctgagatggttcacttttgtagattcaattcagtgtatttaaggttaacaaaggctgacattgaaatgtttaaagataggcaaaaattcacattaaaaaaaccctatatttctatttagagtaacagtaggcagtgtgattccaaaagttaaaaattatttcacaacctgtagcttcagcttggcaaacagcttagattccaaaactgattcatctctattaaaatgtaagcacttaaaaaaagagcatgtctgtgtatatagacatatattttaaaggaatcagataatctttgaagcagccttagtgtttcctttaagtttgtctggaaatgaccattgtattagcttcacagaaaggactagccagcttcttggtctaaggctaacatggtgatcatttgtctaaggctagaaaggtaccaacaagatgtaaactgaggagaggaagagaagatgagggcttttcctggcagttggtagctaaaactgaagggattctagaaaatgacacaatggcagcctttcttgtctttttctttccgtgttggttctggtgaaggaggacattcctgctcttgaaatttcctgataacccggacaagttcatggaaagcttgatctacattcatcctaatctttgctgatgcctccatgtatgttaccttaagttgccgtgctaactgccgtccttcttcctgtgttacctgtctttgatgatccagatctgctttattaccaattaaaatcattgggaactcatcacgatcctttactctgagaatctgtctttgaaacttatagatttcttcaaaactgcctctatctgtgactgaaaagaccaacaggaagccctcgccagtcctcatatactgttctctcatggctccaagctcttcttgtcctgctgtatccaaaatatctagccgggctgctctgtcatctatcacacactgctttgtgtaagaatcttcattggttggatcataatccgttacaaaataggactcccaacttaggaaacaaaacatttgtaatatgattgaagactcctgcatgcctcctcaataatattcccctctctcctcccccagcaccaagaggtaatcaatatcctgaatttggtatctgtcattctcatgcatttatacaacattagtaatcatatgatagtattcctaagctatgttttggagaggacaccactgcaaatcttcagccctatactagcttttatcggtagccatcaattgcagttttaatagaaatacaaatacatcaagtgtctgttctttaatttgtaaagaaaatttgttttctagcgtgacaccctcaaggtaccgtatctgtatgtaaatgttgtgcccaatgctacacagacattattttaaaactattttctgcctttggtaaatagactaaactgttttctttattcctcaaaagaattagatcatacttcagtgttgattttgttgctaatgggacatggagatgtctggatgataataaatattcctgtggtatggtcactgaagcctttaagagttatgctgtagtttgtgtgtaaagaagtgacttaaatcctcctttcagacagcttccttacgcatataggaaacctctgtttcattaggagatgaatatgatatttcattttagttgttcttgttgacatacaacttttttctcttctgaaatagcatgtttttattataatttgcttgattgccattattagatatttttgtcatgccatccactgaaatactcagaaatcatgctttatagtaacaatataatttttcatatctatatttgttattaaaatttagatctaatttttatacaataaaatgcacagttctgcctctcagaaccttcctgctgccacatttgcaccttgctgctctagcctctggggtgcattccatcctttcagcctgcaactagcagagaaaaaaagttacatattttcttgccccatgcataccttgaggcgagcaaaaaaattaaaataaattttaaccatgagggaaatcgtgcacatccaggcctgtcagtgtggcaaccggatgggtgccaagtgctgggatgtgatcagtgatgaacgtgaaatcgaccccaccagcacctaacatggggacagcgacctgcagctggactgtgtctccatgtactacagtgaagccatagatggcaaatatgttccttgtgctaacctggtggatctagaacctgggaccatggactctgctagctcaggcccttttggccaggtgcttaaaccagacaactttgtttttggtcaatctggggcaggcaacaactgggccaaaggccactacatagagggggccaagctggttgattcagttgtagatgtggtgcaggaggagtaagagagctgtgactgcctgcagggcttgcagctgacccactcaatgggctctggaatgggtactctctttatcagcaagatccgagaagagtgccctgattgcatcatgaacaccctcagtgtggtgcctccacccaaagtgtctgacaccgtggtcgagccctacaacatcaccctctccatccatcagtcggtagagaacactgatgagacctactgcattgacaatgaggccctctatgacatctgctcccgcactttgaagctgaccacaccaaactatggggacttgaaccaccttgtctcagccaccacaagcagtgttaccacctgtctccacttccctggccagctcaatgctgacctccgcaagttggcagtcaaactggtgcccttaccacatctccactacttcatggctggctttgccctctcaccagctgtggaagctagcagcatcgagctttcacagtgcccaaactcatcaggtaggatttcaatgccaagaacataatgagacccctgccacagcttatatctcaccgtggctgctgtctttgtggatggatgtccatgagcagttgctcaacgtgcagaaccagaacagcagctactttgtggagtggatccccaacaacatcaagacagctgtctgtgacatcccacctcatggcttcaagatggcggtcaccttaatcggcagcagcacggccatccaggagctcttcaggtgcatcttggagcagttcactgccatgttcccctggaaggccttcctccactggtacacagctgagggcatggatgagacgagagttcaacaaggctgagagcaacatgaacgacctcgtctctgagtatcagcagtaccaggatgccaccacagaagaggaggaggattttggtgaggaggctgaagaggaggcctaaggcagagcccccatcgcctcaggcttctcagttcccttagccatcttactcacctgccccttttctctacctcagaatttgtgtttgctgcctgaaacacaaatctagatctagaacagtgcttagcacgtagtaggcactcaataagtatttgtctgttgaatgtttcctttctctttccactctgggaagcctaggtttctgccactctgggtgaccctgtatttccttctggtgcccatcccttccatctgtccagttaatatttcctcctttttaaaatctccaagaagctgggtctcatccagatctcatttagaaccaactgggttttgaaagcccatgtggataatggccaccatcctaagcccaaagcgaaagatggtagaaggtggcaggtagaagtcactgcaaggaaggggatgggattttccatcctaaaagttttggagagggaaatccaggctattaaagtcataatttccaggtatttctattttccatttctcagcttcaagagaggtgttagcagtattttctccattttcagtctccctccaagctctgccctttggagaggtctgccccactctgtcaagtggaatctttccctctctggctctacctctctcatatattgaattcctccctttcccctgattagagaaggggatcaaggggggaaagagatcagccttggtccctaggcctccagaaatgccctcctaatctccaccttttcttaacccccaaaaaggattaacatccctgactttatgtgggatagtatatactgccacatcagtgtttgagtcattccccagagggaaggggaaccctcctccatcttttttgcaacatctcctatcttccttttgctgttgcttttttcccacttacacttggttttgttctatcctacactacagatttctattttgaacttgctgccttttttcatattgaaaatgtgacattgctccaagagccaaaaataaatgtgaattggaaaaaaaaatgcacagttctcacaaaaatgtgtacactgatgtttacagcagcattattcataatagtcaaaagctggaaacaagccagatgtctatcatcaactgatgagcaaaatgtggtatatttatttttatttttttagatttttttccagacagtctcactctgtccccgaggttagagtgcagtgatgcgatcttggctcattgcaacttctgcctccctggttcaagtgattctcctgcctcagcctcctgagtatgtgggattacaggcacctgccaccatgcccagctaatttttgtatttttagtagagacagggtttcattatgttggccaggctggtctcaaactcctgacctcaaatgatccaccctcctcggccttccagatgtgagccactgtgtccggccaaaatgtggtatatttatactatggaatattttttggccatgaaaggaatgaggtaccgaaatatgctacaatatagatgaaccttgaaaacatttttaaattccatttttatgacatgtccagaataggcaaatccatagagacagaaaatagattagtggttgcttaggactagggaacacaggagagagataactgaagggtatgtgtggagtttctttttgagatgatgaaaatgtcctaaaattgattgtggtgctagttgcacaactctgtgaatacactaaaaaccactgaattatatactttaaatcgataattgtttttgaaaattatatacatccaggtagcaaccagccaaaaccagatcaaaaacattttcattacccccaaaagttctagcctgtctatttccagtcaatcctctggcctccctgaaacatttctctctcactctccaccaccaccaggctgagatgtttgacttctctcgtgatagattagttttgctgatcctagaacttcatataaatggaatcatacagcacatgtatgtattcttttgtgtttggcttctttcactcagcagattataaaattaatacaagtttttctttttatcagtagttcttttttattgccaagtagtattctattgttgaaatatatcagtttgcttatccattgtcctgtggatggatatttgaattgtttcctgtttagggctgcatgaataaaattgctatgaatgtttgtatacaagtctatttggagacatatatttttatttatcttgggttgataacctggagcaaaatttctgggtcataggacagatctatatgagtaactgtcaaaaaggccaggtgcagtagctcacgcctgtaatcccagcactttgggaggctgaggtgggaggattgcttgaagccaggaatttgagaccggcctgggcagcaaagcaagactttgtctctacaaaatattaaaaaattaactgggagcaatagcatgcacctgtagtctcagctacccaagaggccgaggtagggggattgcttgagcccaggagtttgagaccggcctgggcaacatggtgaaaccccatctctacaaaaaatacaaaaattagtcaggcgtggtggcgcacgtctgtggtcccagctacctgtgtctgtccatacttttgcaggtatatccataggataaatttcaaacagtggaatcattgtgtcaaagggtagtatacatttaaaaatcagtgcagattgccaaattttcttcagaaaagattgttatcggcgtatatttccaacagcagagtatgagactgcctcttttccttcagtcttgttaatattggattttttcctcaaatgttaaaaattttgccagtcttgacaggtcatctgtttttcttccctgggtactgaacaggtaacctaaaacaccccaggaagatagaatttactcaatttttaaatattcaaagagagactcgcattcaaagagatacctcaggaaatctgcagtatcctttgataaccctttctaacatttgagtctacactgttggtaaatttttccttttatcattaatctttgagatattatgtctagtgatggtatagcattttttgggaaaaaaattatgaatcttgatgacttgagtggtagtctgaatagggatgaggaattattgaaaagtaaatgtttccttgctacatattgaggatttggatatacttcgaggaaatctggcacatggccattagctgtaatgtgccccaagacagaattcagacttattgaatttatatcacaatgacagttatgagtagcttaaacattttttctctagttacttggataacaaactgcaatagaattctaagagattcagaaaatggtcaagcgaagttccaaaatatgttaagactagtgatgagggtgtaagattctcttctgtaaatggtgttaatttaattgtaaggcagtgctactttggttgggaactcagtattggggaattagctttaaaaattaaagcttcatgatactggtttctgattttgtttagatctggatgaaagtttctacctgccataacagtatcaatagtaaaagaaaattgtagttttcagcatttgaattgagtattcttttgttcattgttagtttaaaaacattaattccttttagatttccattcaggaaaattacattaaacttgaactttttttgattactttgcagtgatcgtatgacaaaaaacacattagtgttcaggtaataatgtcatattttattccagttttcaaagtgcttttacatatactatccaacacttactgaacacttgtttttttttttttttttttgagacagagtcttactctgttgcccaggctggagtacagtggcatgatctcagctcattgcaacctctgcctcccaggttcaagtgattcttctgcctcaacctccggagtagctgggattacagggacctgtcaccatgcccggctaatttttgtatttttagtagagctggggtttcactatgttggccaggctggcctcgaactactgacctcaagtgatccaccttccaaagtgctgggattacaggcgtgagctgtcacacccggcctggtcacttgttttaaatgaataaatgttggacatggtggctcatgcccataatcccagcactttgtgaggccaaggcaggaggatagcttgaagccaggagtttgagaccagcctgggcaacaaagcgagaccctagtttctaccaaaaaaaaaaaaaaaaaagaaagaataagtaaaatttggctttagtttattcttagctatctctactttttaaaaaatccatattaatgtctgtaatctactgaaaggacatgaaagtgcctttgagataaagctcttgacaaaggattattgattgctttgaagctagaagtgggtttttttagtttggccttttgtcgtagttcagcctggccttttaggccttttagaaaggcctctgtgcctttccataggcttcaacctagtgttaggtcctgatcttctgttattcagtcaacatcagttcagtagtgacttattgtgcacccacctcatcattaggtactgtagggctgtgaaatacgaggtctactcatagaccaattcggagcctcctgaagcttttaaaagtatatgttcttgcctgagtgtggtggcttatgcctgtaatcccagcattttgggaggctgaggcgggcagatcgcttgagctcaggagttcgagaccaacctgggcaagatggtgaaaccctgtctctacaaaatgcaaaaattagccgggcctgatggtgcatacctgtagtcccagctactcgggagcctgaggtgggagggtagcttgagcccagtaggcagaggttgcagtgagctgagatcatgccactacactccaacctgtgtggtagagccagactttgtctccaaaaaaagaaaaaaattatatatatatattacatatgttctctctctctatatgtatgttcctgtcctacccttagacattttcttgggtctgggttggtcctaaacaatttatatttttttaaagttccgccagagcttctcatgcatagccagatttgagggctagggttaggatatacaaggtaactactagtctcaggaagtgtataagaggcagataatacaagaacacaaatacttatatatttaaataagtaattataatacaaggcagaatgtgctgtagaagaagtacaaagcagaagtatgaagaggagaaaaagggaaaggaggatggcagggtcatgaagatttgctaaatcccatcacatgcctggtgttttgccagcatttctatctacttgagttttggggaaggagatgcacaaagaggaagcatgtttaaaccaaactgtttgcttttaccaaacaggtttaattccttcttgcctatacaaactctacctttgttattttctcaataataatacactgttctaagtatacttcatgtacaagtgcattcaattttcatatcgatttttctcttttacaaaagaagaaaatagaggcatggagagtttaaatgatttgcatgaagtcatcaagctagagagtggcaaagctaagattcaaacacaggctatgtattcctagcgtccagggtcttaaccattatactgttcttcagtgtcctttcctcactggaaacgcccatcttcaagtgctctctcaaatgctatccaccttatgaagcttttcctgtttcactgattctttccatagattgaattaatctttcccttttctgaactcctatactttctcagtacttttcttttgacatttatgctcatagtatatattatcattatttataggctttaaaaaaatcttccctatttaggccgggtgcggtggctcatgcctgtaatcccagcactttgggaggccaagatgggtggatcatgaggtcaggagatcgagaccatcctggctaacatggtgaaaccccgtctctactaaaaattcaaaaaattagctgggtgtggtggcaggcgcctgtagtcccagctactcaggaggctgaggcaggagaatggcgtgagcctgggaggcggcggagcttgcagtgagccgagatcacgccactgcactccagcctgggtgacagagtgagactccgtctcaaaaaaaaaaaaaacaaagaaagaaaaaagaaaaaaatatcttccctatttaagagcctatgaagtcaggattcatatttcatttgtctctctaccttgaacagtgtgcaatacattgcatatttaaagggatagttgaatatattattgctcctttaacatctagaacgtggcatggagcaaagggaatacatttgtttaatgtgggaagaattaggatcattaggaagaattcattggaagttatattttggccggatacaagagaactttctaacatggcttctcaaaaatggaataggttgcctcctgagagcatgcatttacctgtcagagaggctgtgcacaaaaaatacatgtaacaacttgataggaatgttgtaaggagaattttgcccatctgttgggccttagatttgatgaattcatagatccttttcaattctattataagatgctctgatctcctgtgcgaagtaattatttctttttctgcattcacatagttcttgatgtttctaatgacacgtatattattattctatcctgtgatttttgtttacatgtttcagtacttttaaaggcattataaacttcttaggtcttaagaatttgggtgaaaatgatgtgagaagaagtggaattttaaccaagggaccgagcattttcaaatcaaaccatggcttatctcgtctactctgtaagaggttgccaaaataaatcctaggacgatgactggtaaggcctaaatccaatataaactcttaaaaagccagcaagtcagtaagagctaattagcttttcaccaaaatttcttttttacctttcatcatatcctccaggccacccatccttgtttccattgcccagagttttgcatttttaccactgcaatgtgaggagaggtaaattttatcattaaactctatctgtgccaggacaaatggagcccaggagatggtgtctactctagatacctgttgctagctagagataactaggagaaagccctgaatttctgtttctatttcttttctttttttatttttgaaaccaggatttcgctctgttgctctggctggagtgcagtggcatgatcatggctcattgtagcctcgatttcttgggctcaaatgattctactatctcagtctcccaagtagttgggactgcaggcacgcaccttcatacctggctaattttttacatttttggtagagacgggctttcgccatgttgcttaggctggtctcgaactcctgggataaagcaatctgcccatgttggctttccaaagtgctgagattataggcatgagccatcatgccttctttttctttttttgagatagagtcttcctctgttgcccaggctgaagtgcagtgcaaacatggtgcaaacatgcttactgcagtctctacttcctgggctcaagtgatcctcccgcctcagtctcccaagtagctgggaccacaggtgcacaccatcatgcccagctaattttattttattttttcttttgtagagatggggtctccctatgcttcccaggctggtctcaaactcctgggctcaagtggtcctctctccttggcctccccaaaagctgggattacaggcgtgagtcaccacacccagcccctttttctttcttcacaatttcacggatagaaaattcattgttactgtagatcttagcaacctcagcatgccatttttttcccttaaagttgggaacttccaccttttcatttaaaggaagcacttgtatgcacatctgaatcgccacttcactcctcttgcgctttggggccatcattaagtaaactaaggatgacttgaacacgagcagtacccatcacagtacccatcacagtcattctaataacaaagatagctactaactgactaacgggtgggtgggatgtaccacttggatatgctgggcaaagggatgattcacatcccaggtggggtggagctgaatggtgcgagattttatcatgctactcagaacagcatgcaacttaaaacttatgaattgtttatttctggcattttctattcaatatttttagactgtaatcgactgagggtaactgaaactgtggaaagtgaaaccatggatgtgagggcactactgtattttacttttttttgaaatatattttacatgtgatagataattttgtcaggcctctgagcccaagctaagccatcatatcccctgtgacctgcacgtatacatccagatggcctgaagcaactgaagatccacaaaagaagtgaaaatagtcagttcctgccttaactgatgacatgccaccattgtgatctgttcctgccccactctaactgatcaattgactttgtgacaatacatcctccccacccttgcgataatgtattttgtgatattcaccgcccttgtgaatgtactttgtagggtataccctccctgcctttaagaaggttccaagatggccaaataggagcagctccagtctacagctcccagcgtgagtgacgcagaagatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagcctcgcttgctgctagcacagcagtctgagattaaactgcaaggtgacagcgaggcttggggaggggcatccgcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttctgcagacttaaacgtccctgtctgacagctttgaagagagtaatggttctcccagcatggagtttgagatctgagaatgaacagattgccttaagtgggtccctgacccccgagtagcctaactgggagacacctcccagtaggggctgaccaacacctcatacagccgggtgtccctctgagatgaagcatccaagggaaggatcaggcagcaacatttgctgttctgcaatatttggtgttctgcagtctccgctggtgatacccaggcaaacagggtctggagtggacctccagcaaactccaacagacctgcagctgagggtcctgactgttagaaggaaaattaacaaacagaaaggacattcacaccaaaaccccatctgtacgtcaccatcatcaaagaccaaaggtagataaatccacaaagatgaggagaaactagagcagaaaagctgaaaattctaaaaatcagagtgcctcttccctccaaaggagcacagctcctcaccagcaatggaacaaatttggacgcagagtgactttgatgagttgagagaagaaggcttcagatgatcggtaataacaaacttctctgagctaaaggaggatgttcaaacccatcgcaaagaagctaaaaaccttgaaaaaaagattagacgaatggctaattagaataaacagcatagagaagaccttaaatgacctgatggagctgaaaaccatggcacaagaactatgtgacacatgccaaagcttcagtagccgatttgatcaagtggaagaaagggtatcagtgattgaagatcaaatgaatgaaatgaagtgagaagagaagttcagagaaaaaagaataaaaagaaatgaacaaagcctccaagaaatatgggactatgtgaaaagaccaaatctacgtctgactggtgtacctgaaagtgagggggagaatggaaccaagttggaaaacactcttcaggatattatccaggagaacttccccaacctagcaaggcaggccaacattcaaattcaggaaatacatagaacgccacaaagatactcctcgagaagagcaactccaagacacgtaattgtcagattcactaaagttgaaatgaaggaaaaaatattaagggcagccacagagaaaggtcgggttacccacaaagggaagcccaacagactaacagcggatctctcggcagaaactctacaagccagaagagagtgggggccaatattcaacattcttaaagaaaagaattttcaacccaaaatttcatatccagccaaactaagcttcataagtgaaggagaaataaaatcctttacacacaggcaaatgctgagagattttgtcaccaccaggcctgccttacaagagctcctgaaggaagtactaaacatggaaaggaacaactggtaccagccactgaaaaaacatgccaaattgtaaagatcattgatgctaggaagaaactgcatcaactaatgagcaaaataaccagctaacatcataatgaccaggatcaaattcacacataacaatattaaccttaaatgtaaatgggctaaatgctccaattaaaagacacagactggcaaattggataaagagtcaagacccatcagtgtgctgtattcaggagacccatctcacgtgcagagacacacataggctcaaaataaagggatggaggaagatctaccaagcaaatggaaaacaaaaaaaagcaggggttgcaatcctagtctctgataaaacagactttaaaccgacaaagatcaaaagagacaaagaaggccattacataatgataaaagggatcaattcaacaaggaagagataactatcctaaatatatattcacccaatacaggagcacccggattcataaagcaagtccttagagacctacaaagagaattagactcccacacaataataatgggagactttaataccccactgtcaacattagatcaacgagagagaaagttaacaaggatatccaggacttgaactcagctctgcaccaagtggccttaatagacatctacagaactctccaccccaaatcaacagaatatatattcttctcagcaccacatcacacttattccaaaattgaccatgtagttggaagtaaagcactcctcagcaaatgtaaaagaacagaaattataacaaactgtctctcagaccatagtgcaatcaaactagaactcaggattaagaaactcactcaaaaccgctcaactacatggaaactgaacagcctgctcctgaatgactactgggtacataatgaaatgaaggaagaaataaagatgttctttgaagccaatgagaacaaagacacaacataccagaatctctgggaaacatttaaagcagtgtgtagagggaaatttatagcactaaatgtacacaaggagaaagcaggaaagatctaaaattgacaccctaacatcacaattaaaagaactagaggaagcaagagcaaacacattcaaaagctagcagaaggcaagaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactcccattcacaattgcttcaagggaataaaatacctaggaatccaacttacaagggatgtgaaggaccccttcaaggagaactacaaaccactgctcaacgaaataaaagaggacacaaacaaatggaagaacattccatgctcatgggtaggaagaatgaatatcgtgaaaatggccgtactgcccaaggtaatttatagattcagtgccatccccatcaagttaccaatgaccttcttcacagaattggaaaaaactactttaaagttaatatgaaaccaaaaaagaggccgcattgccaagacaatcctaagccaaaagaacaaagctggaggcatcacgctacctgacttcaaactatactacaaggctacagtaaccaaaacagcatggtactggtatcaaaacagagatatagaccaatggaacagaacagagccctcagaaataataccacacatctacaaccatctgatctttgacaaacctgacaaaaacaagaaatgggggaaggattccctatttagtaaacggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggccataggcatgggcaaggacttcatgactaaaacaccaaaagcaatggcaacaaaagccaaaattgacaaatgggatctaattaaactgaagagcttctgcacagcaaaagaaactaccatcagagtacacaggcaacctacagaatgggagaaaatttttgcaacctacctatctgagaaagggctaatatccagaatctacaaagaacttaaacaaatttacaagaaaaaatcaaacaaccccatcaaaaagcgggagaaggatatgaacagacactcctcaaaagaagatatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaactaggaacacttttacactgttggtgggactgtaaactagttcaaccattgtggaagacagtgtggcaattcctcagggatctagaactagaaatagcatttgacccagccatcccattactgggtatatacccaaaggattataaatcatgctgctataaagacacatgcacacgtatgtttattgtggcactattcacaatagcaaagacttggaaccaacccaaatgtccatcaatgatatagtggattaagaaaatgtggcacatatacaccacggaatactatgcagccataaaaaaggatgagttcatgtcctttgtagggacatggatgaagctggaaaccatcattctgagcaaactgtcggaaggacagaaaaccaaacaccacatgttctcactcataggtgggaattgaacaatgagaacacttggacacatggtggggaacatcacacactggggtctgtcgttgggtgggggaagggggaagggatagcattaggagatatacctaatataaatgacgagttaatgggtgcagcacaccaacatggcacatgtatatatatgtaacaaagctgcacattgtgcacatggaccctagaacttaaagtataacaataaaaaaaggtactttgtagtattctccctgcccttgagaatgtactttgtgagattcaccccctgcccacaaaaaattgctcctaactccaccatctctcccaaaacctataagaactaatgataatcccaccaccttttgctgactcctttttcagactcagcccgcctgcacccaggtgaaataaacagccttgttgctcacacaaagcctgttgggtggtctcttcacatggacgtgcgtgacaaattttatatcttttggagagaaaaactgctctattataaatatacattcttcagtgtatgctgagtctatgaaaactttttgctgtttgaagctcaacaagccttttcttcctcaaaaattcaggctctgatagtagaaaaccatgctttttaatgttgtttttggaaaagcatttaaatgtctaatttgaaactaaagccggattatgactttattgtacttggctgtcttgatagtataggaaggtttatacgttcaaggagaaggaggaaaagacctcagagaataactcaaaatgttatctcctatagcttttccattctgtgtctattcatagcacttaacgtccttatctttgttagcactttgcatttacattacactgtgaatcctctgttatctttaacatttggtagagtgtttgatacatgttcgaatggtttatttttagaagcaaccagattgtatacccttatgtatgtagctgagtcctaggtcagttactttcatgtaaaaaggttgaccaacatcttgttaggaaatgtttgcagcaagatgatgttttgtaaccagttggttggaagtacaggtggcttggacttgcatttggcatctgaagtatgaacagcctggtgggactcagccctcaacccatgggatctgacactatctccaggtaaatagtgttagaattgaaatgaattacagaatacctcatcggtatctgtaaaagaatcgatttgctatttgggggaagccctcacctttccgacatctagtcacagaagtgtgctgtgagtatgttgagtagaaaggaaaaacagcttgctttttctatttacatctagcttttaatttacatcaccgttagggcttagaaaacaatacaccaaaataaaagcctcagaagcaaaaatttttctctggccttctcctggcctcctgtctctcagtcccattctccccaccaaggccagccgtagaaactagaatccctcttcctcaaggcagatcatgaaagccataaccccttttccccaaagccagtcataaaacctagaatactactataacttcccttcacctttctgtgtaaaaactagccataaagaaattatctgacctatcttgtttgactgggggtcataagacccccattccagaaagggacctgccccacgcccagaaggaaggaatgcgtgctcagagaggccaagaagaacctagatggacaggcctggctgggtttccccactcagtctattagcattagatcatatgctttttgtccaatcatatttctatagggctgttccatactttgttgaacttaagcataaaatggacaacttcccctgtatctttgggtctttattctgaatgctcctatgtatacatgttaaataaatttgtataccctttctctaattaatctgacttttacaagttgatttttcaggaaaccttcagagggccaaggagcatttgctccctttgcccctctctacgtaaccattccccagttacttcacttctagattatctagtttttcactgttataacagtatgatgaacagatagctttgtgtgtaaaactttccctacatttgattatttccatggaatggttttgaaggcattttaaagactcttcataactttgtacattgctttccaaaaaggttgtcctggtttaaactttgaccagttctgtatagaggtggctatcttgccatagtttcccctgcattgattattcccatttttacatattcttaccaatttgattggtgtaaaatggtatctatttgatttttatcaatggtgagattgagtattttctcaaatagttgtaaattgcatctgttcttttgtgaagacaactagcagcgtatctaagaccagtttgaatattttttgtcttttttgtcttacatattcatttataaaggcagatttccagtaaaactgattgcccccaagtttgggtataatagagtcatttcactttgaccttcctcattaatttctaaattgttcacaattcaaaaagttattaccagttgtggagctacctttttttttttttttttttttttgagacagggtctccccctataatcttgccctgctggagtgcagtggcatgattataactcactgcagccttgacttcctgggctcaggccatcctccttcctcagcctcttgagtagctagggctacagacatgttgtccccatgcctggctgatttaaaaaaattttatttttaggccgggtgcggtggctcatgcctgtaatcccagcacttggggaggccaaggtgggcagatcacgaggtcaggagttcaagaccagcctggcgaatatagtgaaaccccgtctctactaaaaaaaaaaaaaaaaaaaaaaaaatagctgggagtggtggcgcatgcctggagtcccagctacttgggaggctgaggcaggagaatcgctggaacctgggaggtggaggttgcagtgagccaagatcgtgccactgcactctatcctgggcaacagagcaagactctgtctcaaacataataaataaaataaatttatttttagtagagatgaggtcttgctatgttgtccacactgggagctacctatttttaaatagtgtttaagatacatggtctgtaaatatatagacactgcttagaaatgaaaagcagcagttaaatttcttggggaagttggggtttatacaggaaattgtcacaggtactcaggaattggaagttgtggctggggatgtgtatggaagaataggcactgtaagtagtagacctgcagaccagtctgccctgatagaacattctttttttttttttttttttttttttttttttgagacggagtcttgctctgtcgcccaggctggagtgcagtggcccgatctcagctcactgcaagctctgcctcccgggttcacgccattctcctgcctcagcctccctagtagctgggactagaggcgcctgccaccacgcccggctaattttttttttttttttgtatttttagtagagacggggtttcaccgtgttagccaggatggtcttgatctcctgacctcgtgatctgccctcctcggcctcccaaagtgctgggattacaggcgtgagccaccgcgcccggccctgatagaacattcttaacccagctctccttcaatagctggtccgatagaaaggcaaacaaatatacatctggagtcatgggttctaaccttacctctgaaattagcctgctttgtaaccattcacagattaacctttctgtttctcagtgtttacatcagtaagttcctttcagctctaaacatctttgattttattattcaggggacagaatgttatccttttgaatccagaacctttcttgtgaatatctgtgaataggtctggaaaacaactcattgttgttgggaactacttggaggaaaataataggaaaaatttcccataccagctaaacttttagggaatgtgaacttccaaatccttgtttattttcttttaatacattaaaaatggtaaaattaaattatttttatgccattttccctggactagagaattgtagattcggtgttttctctttcaacatgccagaaaacgacaggttaagttgaaagagtgcaggaaagaaatttagagagaaaataactagctgcaaaacccttcggtgttttaagagaagttactatttacacaaacgtggcctcggcttaatcaaatgctttaatttaaagtcacaaacatcccttttctggcttgagaaagctggtggaagcagctcagtgctctgtgttcgatttgttaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccaggtgagtgacattcagagttttgtgtgtcagttaatccttctgacttttcacagttgatgatgttttacatgtaaaaatttcttattttattgtcttagtatttaaggaaaagtatctcattacattgttttaagaacatggctttaaaagtggccatcaggttttaaatttaaccaactttaggtgaattctgttgaaaaaggacccaggatagtcacgagagtactgaactagaagcctgagctagctgggtatgggtctcggccctagcaacctaagttatttaggcaggtctcctcatggccttccaggcttctgaggtggtttagggagtcactaaatgtgctgattggatctttgcaaatttgtatttccgagtccagctaataagccctcgttgatgctagaattctttttgtctcttgctgactttcttcctctccttcaactgcccatgctcctcaatttgcaggcactttctttcgcatcccactcaggatccctcaactcccttgcttatctctcaaagaaatgttcctccccagaggaaaaaagcgcccctcctgtcaaaggctcagctttccttgttccatgcttttgtttccagtcactttctgtaacttggttatctttccattgactcctttccctctgtcagcatacatgttcaggtcttcccttagatctctttttctccttgccttaattgttgttgttcatgatgagccttttatgttgagccacctttatttttccaagccggaatacctcacagtctaatttttacctcaccactgaggtcagtgtcaggtaaggccaccaggatctaaatgaaattgaataactttgtctttattttccctatttactctctttaacccggctgtagcttttgacattaattggctcccttttttcttttgaaattcttggtaattatttaatcatttattcacacttttttgtttctccaacaaaggatatgagacacacttctttttttttattattatactttaagttgtagggttcatgtgcacaacctgcaggtttgttgcatatgtatacatggagacacacttcttttattgagtctatgttattcttctgtaagctcttggatctcttctcttgtcctctcctctttctctgcccagaatataatttctgttgtaaaacttataatttaaagcccgtctcaaataccatctctttttgaatatccacagcactttgtatgtttttgggtactatctagttggtttggttgcactgtatccggtttttaattccctttattatatgaaatccttgaggcctaagactgtgacttacatctcttgttcctggagtctctcatatgtttattgaatgggagtaaaaagtattgaatcttaagtttttgtggggtttttttcttttttgagacagagtcttgtatggtcctctaaatatatggggaaggcaacatacttttttcaaaatgctgtagaagctcagaggaagaaattattatgaagaaagtaaatttgaactgagatgactaggattgcccaacagaagtataggggaagggcattccaagtctgtacaataggtatagaaatttgaaaatacaaggaggtttgacaagtggttgtgctgtgtgggtacagagtagattattttgtgtgtgcctgggtagagggacaaagtgggattatggttttgaaatgattcagatgcaatgctcaggagtttggaatttatcctatagaatatggaaagatattctttagcaaaagatcatgtgactatattacacattaggtagatcagtctgacattactttgagctggtggtggagagaccagaggccaggaatgcttaggaagctgttgtaggagtgtggaggagaaatgtttagtgttgcaacacaggctgtgaacaatgaagaggagaggtcacatttaagggctgtgaacaactacatttaattcacaattaaactttaatttagaccagttttgaacatgaatatcaactttgtattataacatcctattcattttacgtaagagaggagcttttgtgctacagactgagaataggtatgtattctatattctgttaaataaaacccccttttaaagcccaactttgttttgtatttctttttttaaaattaaggtataatttacatacagtaaaattcattctttgtattatatttccacaagttttgataaacatacagtcgtattactaccaccataatcaaaatataaaatagttttattgcccaaaaatgttccttgtgcacccatgtagtcaacccttctccttctcttctagcctctggcaaccactgatctgttttccacccatgtagtactcctttttgcagagtgtcatgtgaatggaatcaaaaagcctttgagtctggcttctttcacttagtattacacattttaaaattcatccacgttattgtgtgtatcagtaatttgtccccttttattgctcaataatattccattgtatggaagtgttagttgcttacccattctttggttgaggcatatttggattattcccattttctttttaatggaaaactaagttagcttgaaagtttaacccagtgggtactatttgaagatcctaagtcatataagaagttaaattagaagtaaaaattgtttctatataatgattacaactgtatgcatgcctataaataaagacaacaagaagcaatacagaaaaatggatagagaaaaattgttggagtagtagcattgcaggtgattaacttgttcgtattttcttttttcttttcttttttgagacagagtttggctcttgtcacccaggctgcagtgcaatggcacaatctcggctcactgcaacctccgcctcccaggtgcaagtgattctcttgcctcagcctcccaagtagctgggattacaggtgctcactaccacgcccggcttatttttctatttgtagtaaagacagggtttcaccatgttggccaggctggtcttgaactcctgacctcaggtaatccacctgcctctgcctcccaaagtgctgagattacaggcatggaccattgcgcctggcctgaatttctttttcaattagaacctgttaggtagttacaaacaaacaggaaaaaattctaagaataatacaaggaactcccttataccttctacctagatttaccaattgttgacattttgcccatttgctttatcatttttcctctacatatatttatatctgtatacattttttcttaactatctgagagaaaggtggagttgttatgcttctttatccctaaatatttcagtgtgtaattgtagaaacaatgatattcttttgcttaaccacagtagttataaaactcaagaaacttaacagggttgggcgtggtatctcatgcctgtaatcccagcactttgggaggctgaggcgagtggatggcttgcggtcaggagtttgagaccagcctggacaacatggcgaaaccccctctctactaaaaatcaaaaattagccaggcgtggtagcacatgcctgtagtcccagctactcaggaggctgtggcatgagaatcgcttgagcctgggaggcagaggttggggtgagctgagatcatgccactgaactccagcctgggcaacagagcaagactctgtttcaaaaaaaaaaaaagaaaaaagaaagacatggatacaatactatgaactcattcaaataacatagtcacagttcaacaactgtcccaataatatatttataaaatatactctaaactttattttttctccctgtcaggagaaatccctaaaaatgcatttagctgtcatgtctctttagtttcctttaatgtgaaatgatccctcagactttctttgtatttcttgaccatgatttttttgaagagtgcaagtatattctttaatagtagaatgcttctcagtttgcaattgcctaatgtttccccaaattagattcagattatacattttttgcagcatgaaattatgttgtgtccttctaggtgcatcatatctggaggtgcatgaggttgtttaacccatattggtgttgttagctttaatcacttaatgtggcatctaccatgttttcctctgaaaagttgctgttcttttctttgtaattaataagtaatttgtagcaagatgctttgagatgataccattttttctatacttattaactggcattattctgtaaagaagagctttcccttgtcttccatttcaaaatttattcatatatttatatatgtatgcatacaaactcatgaattcttattgtattcactgggttatagtaaagtggtatcaattattttgattttcaaaatgcccctgatttggccagtgggaacctgatcaagttgattcatttttccctatgattccttttagtagttccttactttctggcgcaagaagatattccaggctcgtcctgtgctttccatgcctcagccctaggatcagtcatttctctgagtcctggttccttttagtagagaatggtatatggaaaccacaaatggctgttagctgtgtgcttgttattattacttctaggccttttcagcaagcgcagtagcacacacaagcattactttagttttgttttaagacagatatttaaggaatgcacgcaataatcttaatgtgatgtatatctgtttccatactcatgtagccaccagtttgttagcagttagaatgaggaatttataaaactagttaaatgtcacttgtatgtgacaactttttaaattttatagactagagttaccggagacagatttttgtttttttgagacagagtctccctctgtcatctaggctggagcgcagtagcacattctcagctcactgcaacttccacctcctgggttcatgcaattcttgtgcctaagcctcctgagtagctgggattacaggtgcatgccaccatgcctggctaatttttgtatttttagtagagacggagttttgccatgttgtccaggctggtcttgaactcctgaactcaagtgatctgcctgcctcggcctcccaaagtgctgggattacagacatgagccaccatgccatgccatcagagacagttttgatcagtgggaagagtaccttaatcaactttttgatcacactactggctttgagcatattaatttagccttttccttatttagaaaatactgaaaatatgtactttagggatcagaaaataacaaattaaaaatatctgccacacattgtagttgctcaataaacttttggttttttatttcccagtgcattttcctttcttctttcctatttctctagttgtgtcactggttaaaggtcaaaaatagttttatcttagtttaatttaattcaattttatagagacagggttttgctatgttgcccaggctggtctcagactcctggagtcaagcagtctgcccacctcagcctccagtagtgctgggattacaggtgtgagccactgtgcccagcctgaaaatggttttatttattaattataaatattacttaggggtataggaaaaaaatgaacttaaatttttagtacagtatggggaacatatccaactcattgaagcctacagcttggccaaagaggatcttatcatatctcccaccatacctctatgaggtttctttgtttgtcttccaactctcaactctgtgggctgtatttctatgtgtgatggacccatgtgcctgctctgaggtcatggggagtagctgattacaaatgaacttgatattccctgaaacttacgcgtactgtacgaccgtctccagtcagaacaaactgattactggttaaattttcgttttagggatgaaggtttgattacaatgcaggactttataatcttcccaaacactaagaataacagcaaccacttttttttttagacagagtctcactctgtcatccaggctggattgcagtggtgttatcttgggttactgcagcctcgacctccccaggctcagataatcttcccacctcagcctcctgagtagtttggaccacaggcacacaccgtcatgcccagctaatttttgtattttttttgtagaggtagggtttcaccatgtcgcccaggttggtcttgaactcttgggctcaagtgatccacctgccttggcctcccaaagtgctgagatgacaggcatgagccaccatgcctggccgtcaaccactttttttttttttttttgagatggagtcttgctctgtcgcccaggctggagtgcagttgcgcaatcttggctcactgcagcctttgcctcccgggttcaagcaattctcctgcctcagcctcttgagtagctgggactacaggcacgcaccaccaggcctagctggctaatttttgtatttttagtagagatggggtttcccatgttggccaggctagtcttgaactcctgacctcaagtaatcctcccaccttggcctcccaaagtgctgggattacaggcatgagccaccgagctcgggctttttctttccttttctttttctttctttttttttttttttttgggacagagtcttgccttgtcacccaggctggagtgcagcagtatgatctcatctcactacaatctctgcctcctgggttcaagcgattcttgtgcctcagactcccgagtagctgggactacagtcataggccaccaggcccagctaatttttgtatttttagaagagacggtgttttgccattttttccaggctggtcttgaactcctggcctcatgtgatccacctgccttggactcccaaagtgctgggattacaggcatgagccaccatgcccggcctcatcaaccattttttaaaaattatttcagataactttattaagacctaattcacatgcccacaattcacgcattttaagtgtacgttcagtggtttttagcatatcacaaagttgtgcagtcattactgcaattaatcttagaacgttttcgtcacctcaagagaaagtgtgtacccattagtaatccctccttcttgcagtctctggcaaacactaacctactttctgtctctatggatttgcctgttatggacgttgtatgtaaatgaaatcatacattgtatggcctttggtgactggcttctttcatttagcataatgttgtcaagattcatccatgttgtggcatatatcagtacttgattcctttatatggctgaaggttcccatttctccacattctgtcattacttcttgttacctatctttttagtgttagccatcctagtggttgtgtagtggtatttcattgttctttgcatttccctgatggctattgatgatcagcatcttttcatgtttattggctatatgcatatcttctttggagaaaagcctattcagatcctttggcatttgaaaactggggtctttgtattttaattattgagttgtgagagctctttcacaatcactttttgagggcctggtatgtgccaggaccacactaggcgtttcacatgtacttctttgtttaatcctcataaaagtcccacacattaggtatttctgtttatagatgagattgatgatcagagttaaaataacttatctaaggagagagagccttgagtggtaggaatcaaggttctagctgagtgcggtgcttctgttttcctggctactctgtgctctcagtctttgacattgttgtagcagagcctgttttaggccttagaatgaaaattttcaagaatcatggagggaattcatatgctgagtaggttatttgctggtttttatcttcaagtttcctttcaatgtttatatactagatttattccaggaaacatatataaaccaaattaaaaaaataaaaccaattggaatttagtttctgataaaagaactttttatgtaaagaaatcatgaggaacatccttttgtgaatgtgaatactctctgagtttaagttgatatattcagttttcttagagcagggcacatatataaattttaaggaatgaggggttttcagaaaacattgataaaactttacatattaacttttaatctggatgaaaagttggttcatcactaacttcatgagcttttcaaaacaagcaagataaaagacacacctgtgacctttgggaacatgcaagatgtggcaagtttggaaaagggcacaatgatgattaaaagtaactgaaaaattggaccaatgaaatgaaattggcttgtggagaactagctgtggctacttgattttaggtcacatattcagacttttgaccaagacgatatactgtaccatagataattctgctctgaatggaacaggaaggaattaggagttaggcaagggagaattcagggtaacttcagttccattcagtcactattcactaaatgcttatgatttgctgggaactggcaatacagagattttttttaaagaaaaggtatggtatctgctcttaagccgttgacatttagtagggtttcacagaaaagtagtttcctgaaagggctgggtctcgaagggagaaatggagtttgctaagatggaggtattctggacccagggagcagcagtggcaaaggcatagaagtgtgaggtggcattctgtgcaacgaggactgcacagagtctgcttgctggagatgaggttccattccctgttcatatattaatatgattcctctagtaggctctcttttcaatttagactctccacacccttcctttcaccctcactctctgctgattactttgccttatactttgttgagaaatagaagccattaaacccaaacttcctcaacttccatccaagacctacagacccactacacgagaattacacccatctgatcctctttcttcgcttgagtctcctcgtcctgtcacaggccacaagatttttctccttccatctcctttttccaggttccttaccatcatcaggcatacctgttctgatttgttcatcttaaaatgaaacccagcctttttgaaaatcctgacatgctgcaagatggatgatccttgagaacattatgccaagtgatatgtcagtcacaaaaagacaaatactatatgattccacttagaatcatagtacctagaggtacctagagtattcaaaattatagagacagaaagtagaatggtggttgccaggggttggaagcaggggggagtgaggagttactctttaatgggtagagtttcagttttgcaagatgaaaagagttatggagatgaaaggtgatgatggttgcacaacattatgactgtatttaatactactaaactgaacacttaaatatggttaggatggtaaattttatgtgtattttaacataataaaaaattggaaaataaaatattttttaaaagttataggactctcatatgcccacatccagaaggaaatgctacatttctttctttctttttttttctttttttttttgagatggagtcttgctctgttgcccaggctggagtgcagtggcatgatctctgctcactgcaacctttgtctcctgggttcaagcgaattctcctgcctcagactcccgagtagctgagtttacaggcgcacaccacaatgcccggctaatttttgtatttttagtagagacggggtttcactatgttggccaggctggtctcgaactcctgacctcaggtgatccacctgcctcggcgtcccaaagtgctgggattacaggtgtgagctaccacgcctgcccagaaatgctacatttctttaagagattagtgaaaataaagatgtcatctttatcccccccaccaaaaaaatcccacaactcttccttgataccaccacattcctctccagagaccacctcattttactgttccactaagactaatgtctcaaaagagccacgctgtgtctatttccctcttctattcactcttcaattcactataatctgacttccaccctccactgaaaactgcttttgtcaaggtcaggtcatctgtactctccatgtgcacatctagtggatacttgaccttgtggcagcatttgacagtttgcccctccctcctggaatcttgctcccggctcctatgacaccatgctggttttcctcttgcatcactggctgctgctttcccttctgtccctgactctgagtaatggaggtctaaagggcattgtgctggactctcttgtttctctataattctgttacagtccctgcccagggatttaaatgctttcactatgctgatgatttctccattttatctctagctggccctctccactgagctccagactctcatatccatggctttcttgttttataaaatagtatacttactgtgccttaaacagaacttggatcccctctattcccactacattcctccttgtcctcgtaatggcctctccatcacccagttattcaggccaaatgcctggataatccttgccctttcctctttgtatctccctcacccccacagcaaggcttgtggattctatttctattttgaatctattcccactctctatctactggcagactgcctctgtagtccaggccaccatcacctcctatctggattattccaacagcctcctaactagtgcccactcctcttgctcctctctccatcgtcattcgttcagcacactgttgtaagaataatcacaaatcaaacaatttcacttccatgttatcatttctatggatttccaaattccctactttggcctgcctgcatcatcatttggcctgcctagttctccaatttcatttcatgtcactctccccacacctactgtattatagagactctggtcttatttgactttcttttaacatactcctttctccctcaggatctttgcagtttcctctttgaatggctagctccttttcttcctttaataaggtcttagaggtcattccttgactgtccttcctaaagtaggttccttttttttaaatttaaaattattttttattgatgcataactgatgtacatagtctcagggtacaagtactaatttaatacattcatgtaatttgtgaaaatcaaatcagtatacttgggatatccatcaccttaaatatttgtcttttctttattctaggaacatttgaattattctcttttgattattctctttttgctatttagaaatgtaaatgtatagtaaactatagtcaccctactcctgtttcaaagtacttggtacagtttgcagttattttgtgtttacttctttttctcctccactggaagaatataaactaagtgagtgcaaggactgggtctgatctgttcactatcatatccccagtgttttgaaatgtcttgcttggcatgtagcaagaagtcattaaatatttatgaaacgaggccaggcacagtggctcacatctgtaatctcagcaccttgggaggccaatgtgggaggatcgattgagcccaggagtttgagaccagcctgggcaacataacaaggcccctgtctctacaaaaaatttgaaaaattagctgggcatggtggcatgcgcctatagtcccagcttacttgggaggctgaggcaagattgcctgagaccaggagttcgaggttacagtaagctgtgacaggaccactgcaccccagcctgggcgacagagtccctgtgggaaagagagagagaaaaagtatgtaaataatagaaggaaaagggaaagaggaaggagaaatggatttgaggactgcagggagacatacatgagaggagaggggtagaaaaagacagatgcttattgatctactgctgcactttttgtttttttttgacaggttctcataaatcacccaggtggggtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggccaatttttgtgttttttatagagacggggtttcaacatgttgcccaggctggtctcgaactcctgagctcaagcgatctgtccgccttggcctcccaaagtgtaggattacaggtgtgagccactgtgcctggctaactatattatttatttttttgtttctaaattgtctcctccactaggatgtaagattcatgagggtagcttctttggtttactgtattttcaagaaaaacttctagctcctaatgagctgattatgtgttgaaaaaatgagaagaagagcttaattgtttctttgtttatgacggagtttcgctcttgttgcccagcatggagtgcaatggtgccatctcggctcactgcaacctccgcctcctaggttcaagcgattctcctacctcagcctcctgagttgctgggattacaggcatgcgccatcatgcccagctaatttttgtatttttagtagatacggggtttctccatggtggccaggctggtctcgaactcccgactacaggtgatccactcgcctcggcctcccaaagtgcagggactataggcattgagccatcgcgcccggccaagcttaattattttatatgcttactaaagatttcctttggataagatttgcaacatctctgttcttagggtttttgaaaattttgaaaattactattttataaatgttgaaaaacctagtacctatgtgactccatgaattgaaacagtttcttttccccagttcttttagaactcatcaaattgaagctgttccaaccagctctgcaagtgatggatttaaggcaaatcttgtttttaaggagattgagaagaaacttgaagaggtaagatttatgtaaaatattgccaggaaggaccttgaggctagaggaagcagacacaggtttcaggtgttgccacgaggtggtacaattgaaaatttatatcatgttgtcaagtattgagtgtagttagatttctgagtgtctattaaggcttccttgtaattctaaaaggaatgcatttcagaaatgtatgaatctccagatttgagctaaagaactataataaatactgttaaaattgtcactcttttctaggtcctctttgtcagagggtcattcagtcatgggcaaagttcaaatataaagggattctaatttattttgctgtaatttcctttgaattaaaacggtcttacttaaaatcatttcaaagaataatatttaaaatgagccttttttgtatatatatcaaaattctttgtaaaaagaaattgtgttttgatttcttaaagtagttaaaaaatttttttgttttaaaaatgatgttaatttaaaaaatactatacagaaatatatgtttatgaatagtataaattttatactatacttttgttttaaccttttaaacaaaagtttaaaatctccccaaattctgccactcagagtttactgaaatgttaacagtggttaacattctttcagacatctttctctgtgtatattaacttacagttttaacctagggtcaaaaaaacctattgttttttgttttgttttgttctgagacagtgtcttgctctgtcacccaggctggagtgcagtggtatgatcttgggtcactgcaaccttcacctcccgggttcaagtgattcttgttcctctgcctcctgagtagctgggattacaggcacccaccaccacgccaggctaatttttgtatttttagtagagacagggtttcaccatgttggtcaggctggtcttgaactcctgacctcaagtgatccacccgccttggcctcccaaagtgctaggattacaggggtgagccaccgtgcccaccacaacacctgttgttttttattatactatatatgcggatctatttttatatacaataattagttcttgataggtaataatcatactaaggcaatctaaaaataactctccagaaagaaagttattctcttcacgcaaaattgatatttatttcattgttttaaacttagaagaatcttgggatctctttctgtttttttttttttttgaaacagagtctcactttgtcgcccagaatggagtgcagtggcatgatcacggctcactgcagccttgagcccctgggctcaagtgatcctttcaccttggccccccaaagtgttgggattacaggcgtgagcctctgcctggatgtatttcattatggattttagatctgagaccgtataaggcatggttacagccataatcacaatgcaaattacacatctattaaggtgatcaaagtgggctggaataaatagaatgtttaaactgtatttcactcacgttagagccatggtgtgaaaggcaaacattgtgcttatctcataacccttattgtaggccagaggactacttaatatctgagatgattgcactgtggatgggaatacaggtgatataactgatgtgtcttgtgaaagaacccagtattcccaggactttcattataatctacaaccgtcctgagggagagcagggccaggcattggcctagaagctgcagacctgtcctgcaaccatcttgggatgcatccacatggggctacctgttttataacctatgtttttcttttgacattatgttccatggccataaatctaaatctttaccccctgtttttttttttgaaacaaagtctcgctctgtcacccaggctggagtgcagtggcgcgatcttggctcactgcaacctccacctcccgggttcaagcgattctcgtgcctcagcctcccgagtagctggcattacaggcacgtgccaccacacccagctaatttttgtatttttagtagagatggggtttcaccatatttgccagggtggtctcttatctcctgacctcgtcatcttcccaccttggcctcccaaagtgctgggattacaggcatgagccatcgtgcccggccgtttaccctcatttttaatacatagtatgtattcatatgtatttgtcaaaatttaagtagcttcctgtgatgaatatcaggttgtatttaacattttcaagtaaaacagtgctgtaataaatttcctgttgcactcatatttaagtatttaagctatgatcaatttaatataaataaaggaggaaaattgttgggtggttggctacgtgcattttgtatgctgatacatattgccaaactacccaccagaaagagagtactaacttacaaacattaccaattcatgagagtgactattttttccttttaaaacatttatttatttttatttttgtaaagatggggtcttgctatgttggagactaactatttttacttcacacctctgatactatgttggctggtttttaaaaaaatctctgggctgggcacagtggcacacccctgtaatcccagcattatggaaggctgaggcgggtggatcacttgatgtcaggagttcaagaccaacctggccaacatagcaaaaccctgtctctactaaaaatataaaaattagccaggcatgatggcgcagtcccagatagctgtagtcccagctactagagaggctgaggcaggagaatcgcttgaacctggaaggcggaggttgcagtgagccaagatcacgccactgtactccagcctgggtgacagagcgagactccacctcaaaaaaattaaaaaaaaaaaaaaaaaaaaaggctttgccaacctagtaggaaaaaatatctcattgtttcttgaacttctttcattacaagtgttcctataaaatgaagttgcactctataaagtctcggcttaaaagttttggtttttaaaaatgctgccaatatattcctgcagaggaacacataggatagtggcgtctgacaagttgcttcatttatttcaaccctattccatctaaaaaaaaaatcaactaaattaatgtagagattatctactatgaagtatgagatatggcagtatatcagtcattgaatacttcattactgggatttacaaattagtgtggtttttattttacagtattcttttagctttgcaaatgtatgcctcttgctccattttaattcttttctctataacctccctaccaaccttgttcccttgtttctttctccttcccacgattgtcagtttcctaagtgtttgcagcactagaaagtaaaagtcttggaatcttttgtcaattcatgcattttctgcattagcaaaggcagcctggcaaaagattttatttccacttttgtctttgttagcaattctccattgcccttctttgaattctgtcttaattttttgtccctattaagtttgccacaggacctactccttaaccttttgcctactcagaaagaagtacttttcttcaagcaaggaggcactcagaactttctcagtactaatgatctccaatttcacaactgtattttattttccctttaaactctttctcctcatcagtttccttaccctctctcactcccacttcaattgaaaatgttttattgtcgaagggatgtgattttataagaggatcagttgtttctgaaaagtagcagcaagtgcagattattctctatctattttaaggaggtgggaggagaagtagtaaggttataggaatttctcttcaagtatgcaggtagaatttctaaatgtttgctggtgttttcctgctgtaacttgttggtgtctgcacatagctgtattcctgaggcactgtgcaagcagatggcatggatgcacctggaaatagtcattcatgggccactggctctagagaaagctttcctctcaggtggcctagcacactattaaccccctctcctatattatttctacagaaccttgagagataaaagattttaaggaatgtgaagaagactttgaactttcttcattttatggtgccagatacagctctgctgtcatcggctaaagtttagaaatgttgatgtgacctacagtttcagtgtggtatggtcaaatggaagtagcattgaatttgggattaaagcaacctgggattgagttctggttgtactacccactagccatatgtccctgcctctcagggaacacagagtttagtgggaagagagacatggaaaaatatttccagaaaaaagcaacatgggtttatgtgcagagggccatcaaaatatctggtggagatagagactccttcccaaaagagttagcatgtgagctgagatttgaatgatgaggtcaggggtgggagtagaggctaggaagaagtgagtgtcctgggatggggtatgagtaagggcatggaggcatacaagcacttggcacgtaagttcatggaattcaacatgttcatggaattcagagatgaagaggaagagaaagtggctggagataagaacagacaaatatccttcggatcatgaagactctaggataatatgtaaagacagacttcatcctgttggctgtggggagccactaagaagttcaagcctgagagtgtcagatggatatgttagtgttagatggactacttggcagcagtatagaggagaagcattcttaatctttataagcctcaattgctttttctgcttaatgagctaatactaatgtctgcccaactatttgtatggttttgtgaagattaaagaaattatatatacaaaatatatttaatacaaaagtattaaaaacttgaagggccctcaaaatattagtattgttagtagtttttttctacagttaacttaaaataatttaagtgagctcttttaagggaagccaacataagagaatttctttttcacttaaaagaaaaacctgacagtcattttggtttcttggtttaagtagaaaatattggtagttaatttcaggatactcacatgtaagagatgctgccatgactattcagataagtagtccctgactaaatattttaggactacttattaaaactaaacattttaggactacttattaatccttaatattttaggataaaacaaaatatttagtcctaagacccatgtctaagattccaggtggctctcagggaatgtacctatatgtaagaaaaaggttgacataccgggcacagtggctcacgcctgtaatcccagcactttggaaggccgaggtgggtggatcacttgaggccaggagttcaagaccagcctggccaacatggtgaaaccccatctctaccaaaaatacaaaaaaattagctgtgtgtggtagcgtgtgcctgtaatcccagctacttgggaggctgaggcaggagaatcacttgaaccgaggaggcagacgttgcagtgagctgagattgcaccacagcactccagcctgggagacagagcaaaactccatttccaaaaaaaaaaaaaaaaaaaaggttgacacacccagtaggatgactaaaataaaaaagacaataacaattgtttgtgaggatgtggagaaattggaaaccctcattaattgctggtagcattgtgacatgatnnnnnnnnnnnnnnnnnnnnccaacccacaggagagagagagacgcgagaccgcaacacccaccaaacccgaaagccccagcgcagaagcaaccacctcacacccagcagctcaggggtttcagtcagctaagattgcaccacagcacaccagcctggtaggcagagcaaaaccccacctcaaaaaaaaaaaaaaaaaaaaaggatgacacacccagtaggatgactaaaataaaaaagacaataacaattgtttgtgaggatgtggagaaattggaaaccctcattaattgctggtagcattgtgacatgatgtagccactttgggagtgccttaaaaaattaaacatcaccttatgacccagcaattacacttctagatatgtaaccaaaagaaattaggagcctatgttcacatgaaaacttgtacacaaatgtctatagcagtattattcataataggaaaaaatgaaaacaaccatcagctgctgaatacataaacaaaacatgttacatccatacaatggaatattatttagctgtagaaaggattgaaggaggccgggcatggtggctcatgcctgtaatcccagcactttgggaggccgaggtgggtggatcactcgaggtcaggagtttgagaccagccaggccaacatggtaaaaccccatctctactaaaaacaccaaaatttttagtacttttttttggcacgtggtggtgcgcgcctgtagtctcagctacttaggaggcagaggcaggagaatcacttgaacccgggaggaggaggttgcagtgagttgaaacatgccactgcactccagcctgggtgacagagtgactccatttaaaaaaaaaaaagattgaaagactgatcgatgtatgcatcaatgtggataaaccttgaaaacgtcatgcttaagtgaaagaagcagtcacaaatatatgatttcatttatatgaaatgtccagaataagcaaatctatagagacaggaagtagatttgtggttgccggggactgaggggtggaggagacagggaatgactgctaatgggtatgagtttcttttggggttaatgagaatgctctaaaattagatagtggttttggttgtacaaccttgaatatactaaaacaaccactgaattgaatattttaaaagagtgaattttataggatataaattatatctcaatgctgttgtaaaacaaaacacaacaaaaagaaatagtgaacttaggccaggctctctgcatacttagaaacagaggttagtatctaatgtcagtttatgtaaattcctcaggggcagtaattatttgagtatttcaggtacttatcagagtgcctgaacattgtaaacacttaagtctttcttaaaataattaatattatgaggccaggcacggtggctcacgcctgtaatctcagcactttgggaggccgaggcaggcggatcatgaggtcaggagattgagaccatcttggctaacacggtgaaaccccgtctctactaaaaatacaaaaaattagccaggtgtggtggcgggcacctgtagtcccagctacttgggaggctgaggcaggagaatggcatgaacctgggaggcggagcttgcagtaagctgagatcacgccactgcactcccagcctgggtgacagagtgagactctgtctcaaagaaaaaaaaaaaaattaatatgataccaaaaggaagaattttgtgtataaattattgcagatatgtaaggctgaaataaagaagataggaaataaaagctattagaaattaaagagaactcaacaggttgccagttccaaaataaacattaaaagattagtatattttctatatatttgcaataacctggccataaaatttaatgcaaagatgtgctattaacaaaaacaatataaaatacctaagaataaacttatcaagaaatgtacagaagtctatgttggcaaaaaaaagacaacattttcccaaaggacattaaagaaaaggtgaagatttactatattcgtggatgggaagacttaatattgtgaagatactacctctctcctaaacagatctatatattttatgtaaccccatccaactccaacaacattttgggagaagaactaagtgattataaagtacatataaaggaaaatgtgtccaaaaaaaaatccaaaatagccaagaatatttggaagagaagaattataattgagatttgctgtgtcagagtaaagtgtattataaagctataatattggcacagaaatagctagatcatagaataaaacaacaacaacaagatgctaacattcattgagtactctgtgtgttgtgggtatttacataattctcttacagctctgtgagggtagttactgttttattcccatttaacagataagataaccgagattcatacaaaaatgcaaaaaattagccgggcgtggtagcgggcgcctgtagtcccagctactcgggaggctgaggcaggagaatggcgtgaacccgggaggcggagcttgcagtgagccgagatcaggccactgcactccagcctgggcgacagagcgagactccgtctcaaaaaaaaaaaaaaaaaaaaagaaaactgagattcagaaagtaacttggctaacttgttgataacaatcaacaggatattggttaaataaatatggtatacttttacaattaaagactatatgtgaccatttaaaattatgtagaatattattagtgacacagtaattaggataattatattaaacaaaaaaagtagattataaaacaatatgatcccatttaagatatatatataaaagctttatatataacatatatatactatattttatttaatcaataccctgttaattgttattcaggctcgtgctaacttctggctcttaaaacaatgctgtgaataacattctcatatctaaatatttttacagagcctcatttatttaagggtaaatccctagaattaaactttgctaattaagaacaccaaatctaggaatcaaaataggtttgaattcttgctcttccttgtacttctacaaacctagccaagttattagaccttcttgaatatatatataataatatatatgtagcatatataaatcttatatatatatatcttaagtgggatcatattgttttgtaatctactttttctgtttaatataattaaacagatcccatttaagatacatatatatataatcttttctgtttaatataattaaacagattccatttaaaagatatatatcttaaatgagatcatattttgtaatctactttttctgtttacagaaagattttcttgtttttggtacaaaacccattttttttctctgcatatatatgtaccaaaaatgattttctttgagtgataaagttatgaatgattttggccgtgtgcagtagctcacacctgtaatcctagcattttgggaggctgaggcagtggatcacttgaggtcaggagttcgagaccagcctggccaacatagtgaaaccccgtctctactaaaaatacaaaaaattagcatggtggcgtgtgctgtagtcccagctactcagaaggctgaggcaagagaatcgctcgaacccaggaggcagaggttgcagtgaggcaagatcatgctactgcactccagcctgggtgagagagcaagactctgtctcaaaaaataataataataataaatgatgaatgatttatattttcttcttcttgcttactgatattttctaatttttccacagtgaaataaatgttccttctctaaaaattttttttcaataaaattattaggttgctcttgtttcttttaaacaaggtgtgtgagtttgttgtcctccttttgttattcaccctgccagctggcttagctgctcctctgtgctcctgcagtcccctgtgtttcccttgatcgcagcgtattgtcatagtgatcatagcgtattgacattacttacttttctgactcctatctctatatccttggtgcctgtaacaatatttggctcaataaatgcttcaggaaggaaaggctgggaatgaagggaaaaaaaagaggacgggagggagaagggaaacccccttgcagagatataggtctgagttttttttctgtatttaggccagcttctttccctgatgtccaaaagcaagtggtggatggtatattactcctataattctttatactgatagagaaaatgagttgaacaacaacaaaaaaggccttgatttcagaaccacttgtctttaagttctgattgcaaggaaccaaaaatatacataaggctagctgtggtggctaacccctgtatcccagcactttgagaggctgaggcaggaggattgcttgagcccaggagtttgagaccagcctgggcaacatagggagatcctgtctctacatacacacacacacacacacacacacacacacacacacacacacacacacacagatccagatcctgtctctatacacacacacacacacacacacacacacacacacacattcaattaaccagttgtggtggcacatgcttgtagtcccaactacttgggggaggctgaagtataaggattgcttgagcactggagatcgaccctgcagtgagccctgattgtgccactgcactccagcctgggtgacagagtgagaccttgtctcaaaaaaaaagaaaaaaaacctatatgtgtatatatatataatttatatgtgtttatatatataccatttatacgcttatatatatatgtcatttatatatgtgtgtgtacacacacacacacggagaagggcaggttgggatctctacattaaagatgccagagtgaatctttcccaacttattgaaacatacgagggctattttggcagaaaatgctgccctgtccctccttcccttccaccagttgtatctaaaaagccctttttgttcttttttgagacaaggtcttgctttgttgcccaggctggagtgcagtggcatgatcatagctcaccataacctcaaactcctgggctcaagtgatcctcccatttcagcctcctgagtaggtgggaccacaggcatgcaccaccatgcctggctaatttttttatttttagtagagaccaggtctcactatgttgcccaggctggcctccaactcttgggctcaagtgatccccccacctctgcctcccaaagtgctgagattacaggaatgagccaccatggctggcttaaaaagccatttttaataaaagacttggcagatgtgggagttgttgcctgcttgcctttcagacttttctgggtaaaagatcataagggaccttggggaccgctccctggcccgtatactcatatcatgtatctatttaaacatgaatttgcttgaggagaaagccagagaaatggacttaatgtaaccccagtgttatttttctttccaggaaggggaacagtttgtgaagaaaatcggtggtatttttgccttcaaggtgaaagatggccctgggggtaaagaggccacctgggtggtggatgtgaagaatggcaaaggatcagtgcttcctaactcaggttagtttgggaatgacttcattctaggagcactgacgagtttacgaaggctgtcagctgggaaaatgggggtctgctttactgttcccaaaaaggactggcttttaatgttaaagaaccagtaaattccagggaacaggaacaggtcaaagccacctcctcccaaggatttggaggctccatcacagagttgccaatcttaggctttggaattaggcaaacttgggttggagtcccatccatgccattcacataatgtgaccttgaacaagttatttaactttctgagactcagttttctcttctgtaaatgggcttaataaatggccccttttcataaggttggtatgaagattaagaggattctttcttaattaaccgtaaggcacacggtccagtgcatggctggtggccttggaagacctgtccatactcacaatcgccagttattcttatccaaatcttttttgaccccactctagtcagcttttgtcctcatcactatccccagactgttcctgtcaagatcaccagtgactaccacattgctaaattcagtggtaaattcccagccctcatgatattacacttacacgttttccttacctactgactgttcctccttggcctctcttgatggtttctttttgtcttcaaatttctaagcattggagtgttccaaggctcagttctatttgccttaattccttggggatcttaactagtcccatgctttgaaacagtttctacactgatgactttgtctttagtatggacccagccactgaactacaaggtatacatccagctgcttaactgacaagtttacttggacacctaataggtatcgcaaagctaacgtgtgaaactgaactacagatatttcttctcccctctaagtatgtactcctcctgctgttgcaattggtaaattgctcctgtgtcctactggttccttggtctaaaagccttgaagtcatctttggccactttttttctcttatactccacagtttaacccatcaacacatcttgtcctcctctgtaaccaccaccaccctggtctaagccagcatcattgttttatccggtctccccgattctgttcttgcccactactctgcacacctgccagagtgatcattgaaaaacttgtcgaattgttaccttcctctgctcaaaagcatccaatagctttgtctcactgcaggtaaagttcttaaaattgcactgtatgatctggcctcagttttcactgtcttactatgtatgtccttgctcacttggctccagtaacactgacttttttgctgttgcatgaatgtgggattctcttggttgggggctttctgctctctgttccctgtccggaattaccttctcccagatatccttgtggcctgttccctcctttcctttggatctttgctcaaatttcaccttctcagtgagccactccctaaccaccctttttaaaatcttaaccccacggtgaaaccccatctctactaaaaatacaaaaaaattagccaggcgtagtggcgggcacgtgtagccccagctactcaggaggctgaggcaggagaatggtgtgaacccaggaggcggagcttgcagtgagccaagatcacgccactgcactccagcctgggcgacagagcgagactccgtctaaaaaaaaacaaaaatcttacccccattactattccctattgcctttttctgccttatttttctccatagcacttattaccatctcatataccatgtaatattttacttattttcttattgtccatctctctcacttgaattgtaagttccttgaagacagagctttttgtctgaggtacactgctgcattcccagtgcttagaatgtacccgagacatggaaggccttcaaaaatgaataatttaaaaatggacaacagaatgaatggcatcgagtaagcattcagtaagtggtagctgtactgtactgttatgcttctcttgttggagagagcctagggtaatttagaaacactgtggattgggaccagctctttggagggcttaaaatgccatgataggggctgggcacggtggctcacgcctgtaatcctagcactttgggaggccgaggcgggcggattacgagatcaggagttcgagaccagcatggccaacatggtgaaaccctgtctctactaaaaatacaaaaaattagctgggtgtgtggtgcgtgcctgtaatcccagctacttgggaggctgaggcaggaaaattgcttgaacccaggaggcggaggttgcagtgagccgagatggcaccattgcactccagcctgggcggcagagcaagactctgtcttgagaaaaaaaaaaaaaatgacatgataggaactttgaaagtcgttttgtatataactagtataccaaagcttttaaatatacattagagcttcctaagtagaaaagtgaagtcagagctgtgttttagaggatgaagctggtacattagacctgatgaattgaaaggggtgagagatcagaaacagagagagccatcaggaggatagatgttgccactgtctaagtgagcggagaggatgaccagccttagtgtaggcagtgggaaaagtaagtgttctgagagtagatgccagagatactggaggtgaaggtaatgggacctgggaattgtatagaagaagcgtgtctatcaaagatggtgaaatttcgttactggcacatttttgagggaggtcctgtaggaaaggatgacatcgggagcacaggtggaagcaaggttacctctagtaagaaggggtggatggaaacttctttctctgcaagggtagttaaatattcaggggcattttgagaggagaggaggttggcaagctcctggaatagagtgtagagcttggagtccggagaaaaagtgaagagcactgttaacgtgcacggttgaataagggattgatgagagatgaatgaaagaaaaattgagcagtagttagggcatccgtctagtgtgggcagcatggctttgttgtggaagtttcctgaattatacagagtccctttttttccttccaaaatgaatgggaaaaaaatggccatagctttgcattctatgagctgccactctaaggtggtgtacaaagaaaagctaaaggctttatctggattccagcttttagaaatagaacttcaggaattatagtagtgatcttttttttttttaatgactgaaggttaatggttacttttatatttagatatgcccatactgatattaaggttgttttttttttaatttctccttttcctcctattttgttgttggttgatagcgttggtttgtcatcaaagatcaaatgctgatggaaagctgttgaatgattttggaaaagctgtgttccctccagatacgttcttgccatgttcttcccacattaggtgctgtaccccagaccccaagggatcttaccctggggaaggatagtttctgctgaaactgacacttattggcagccaagagtggtgttgaaatacagacttaccaagaaaagccatcactggaaattgccagctccttttacatcaaccaacaaatggctatttgttagagattagctacattaaagcattaataacctgtcctagtttgaaccggcatcttaaggagaattgctagttcatttggcatgtacataatgttagggggtttgtttattgttaacaaagtaagatttacttaaatgtattttgtaagagcttggtaatgattactgagatgattatattatggatttttagattttgtgcattttccatcatctctttttgcttcctgggtgccttttagtatcttctccatgagttctgcctttccctcatctcctttgaaacgactcatatagcatatctccaggaggccatctttgattaatctaacataacatattattccttcattcctttattctgacccttcagcaccttgagttctcaactctgtccctttatgggcagcatgatacagaaagcttcagggtctcctatccccaaggtaaactagaaagagcatagccaaaagaaacagccaaacctgggttcagatctaggctctgtcactcagagggtatataccttccctgagagtccaatggtcttatctaaatatgatgagaataatttctatccatagaactgttgtggggattaaatgagataaggaagatagagcacctagtgtagtaagtgctcagtaaatcattgtttcctccccagaccatatgttaaacattaattttgcttagacacataggtttgtctcagcccctcaaaagggctttgaaaacttggaaaccatctgggattcatcaaatgctatgaatcagtgaaggtgcagttaaaactgagctgttgaatgtttacatacttcctaaaacaaaaggaagctgtagagcataggaattgggagtatgagctttggcaacaggaatctgcattcagatgtagctcagctacttactagctatgtggtcttgggcaagttatttggtccctctgacccttataggattgttataaagatcagatgagaccagatatgttgaagtgttcagcatagtgagagctcaataaatgctgatattatagcagcagcagtagcagattttacttcctgaagccccctttcaatgaccgagagtcctttcttggactgttaggaccaggtccaactatctcagtttgttttttacctcgtgctctttgatgttatatatctgcaatagaactggattttctaggctgtaaatttgtttattttttaaggatttagaccttttttcgagtattaagagaagattttctcagcagctaagttaggatgaccattgaatctcagtctttttaggggcgatccctgagttgtaagacacataataaaacctttttttctatcttgtttcagtgatttaatactataggcatactatgctttaacagtttattccatctctttttttttttgagatggagtctcactcttgtcacccaggttggagtgcaatggcacgaacttggctcactgcaacctctgctcctgggttcaagcgattctcctgcctcagcctgccgagtagctggaattacaggcacctgccaccatgctcggctaatttttgtatttttagtagagatggggtttcaccatgttggccaggctagtcttgaactcctgacctcaggtgatccgcccacctcagcctcccaaagtgttgggattacaggtgtgagccagcgcacccggcttctattccgtctcttttattaaggcacagattatctgattagctattatgacataatttgatcatcttttgaaattcacataatctattaatttattcaacaagtatttattgatttcctatgtgtcaagtactcttcaaggacctgtgcatatagcagtgatcaacactgacaagggctctgcccccttgaagttttcattctattggacaaatacagacagaaaacacatacacatataagtagtttcagatcagtgcactgtgaataaaatgtgacttcattttagggagaggccagctttaatttgagctaattcttaatgagaggaggagccaactgttagaatcctattgttatattaattgattgcctaaaacgttgactgctgaaaatgttgatttcttggtgaatttttccttttgcacttgaaacctctcatttggacaaggtagacatggctgatttagcaatgagatattagtctttgttgtccagtcttttttccactattttactttgataataaaattaatattttaaaagctttgtattattaaaattgcatacacttgattttaaaaaattagaaaagatagacaaacgaaacgaagaactaccctaccaaaattccactgtccaggttaggagttggcaaattatggcctgcagaccaaatctagcccatcacctgtttttttgttttgcgttttgtaaaatttttgttgaagtctagcctgtagtaaagggcgtaattccagagtgtaccacgtgatgaatgtttacaaatgagtacacctccaaggtcaagacacagaatgttgccagtactccagaagcctccctcctgcccccctgctatcactattcactcccaaaaggaaccattatttcaaatcctatcaccatagcttgattttatttattttagaaattcatacaaatggaaccatagaacaataacatttactcttttttaggtctggcttttttttgttcaacagcataagattcattcatatggttgcgtgtggcaatagtttgtgtttactaggcgaataccccagaatttattccttgtgcatttgatgtatctttgcattgtttcaatctgggagcctgatgaataaagttgttatgaatattcttatagatgtcttttagtggacatttccatcgtacttacttctactggacacgcacccagggctaggtgataaagtgcaggttttgggtatggatgtactattttacatttccttccatattacatgagagttttagttcctccacatttttgacagtacttggtacttgccaggtttttttaaaaatcaggttaattgatgtacaattaacaataaacaataaaatcaaccctttttagatgtataattctgtgaatttagacaaatgcatacagttgtgtaactatcaccagaaatcaagatacagacagtttccattaccccagaaagtgtcctcatgtccctctatagtcagccccctcaggcccttttagccactagtttgatttctctccctgtagttttgctttccttaggaagtcatacacatgaaatgatacagtatgtagctttttgagcctccttctttcactgaaatttattcatgctgttgcatggatcatgaagtattttattcttttttgctgctgaatggttaccccttcaccagttgatgcacatttgggttttttccagcttttggcaagtatgaatcttaaagccactataagcattcacatacaggtttttgtgtggacgtaagttttcatttttcttcggtaaatacctaggaataggattgctagttcatatagtatgtgtatgtttagctttatgtgaaacttccagactgttttctgaaagtggctgcatcattttacagtctttctggtattatgttgacctttcatttgtttcccatcctcactaacactgggtattgtctttttttttttttttttaaatttcagccatttgttctagtaggtatgtggcactcatcatgattttaatgtgaattttctgatgattaatgaagtgaagcactgtttcatgtgtttcttggccatttggagatcttcttttatataatgcctacatgtgtcatttgctcatttttatattggatcgtctaaccttttctagttgagcagtaggagttcttttttttatcttttcctgtaatccactgtaccttagaaaggagttcttcatatagtctgtatatgagttgtttgtcagagatatatgagttgcaaatatcttctcctccctctgtctgccacctgtttaaaataattttattggaacatagccaacatttgtttatatattatctatgactgcttttgcactacaggggcagaattgggtagttgtgatagagacctactgacctgcaaagcctaaaatatttagtgtctgatctgttacagaaagtttgttaacccttgatctagagaaccgtattcattttctattactgcataacaaattgccacaaatttagtagcttaaaacaatgcccacatttattagcccacagtttccatggataagtaggctgaggacagcttagctgggtcctctgcatagagtcacacaaggctacagttaagcttttggccagggctgggctctcatctggaggcttcaatggggaaggatccatgtccaagttcattcaggttgctggcagaattcatttccctgtggccttgggaatgatagcttccctcttttactggctataggccagagctggccctcagctcctaacggccagttccctgccacgtggccctctccataggaagtccacaacatagcagtgagctcattcagagccagcaggagagcaagaatgagtctgctagcaaggtagaatcatttaatgtaacaaaatgacaagagtgacatctcattatctttgccatattctgttagctagaagcaagtcacaggttctactcacactggaaggaaggggatgtacaccaggagggtcaccttagagtctgtcacagttactattagtaatatattggtgtcttaagtttacagatgtttttctatgtttatatagttgaattctgttttaagcaaaaatggcatcatacagtttcttttgtaactggcttatataataatatcatgaataatgtaacatgaacattttttcatgtcagtaaatccagatccatatcatttcttattgtggcttgtatcatacctcactatttgaatataccataatttatttaatcaattccgtcttgttaaatatcaggattgcttgtggtttatgtcacattttaccaggctgccatagaagtatatgtgagtgcccatttccccacactgcctcagtgctggttataattctgttgcagtcagtggctcttgacaaaaatgtatatgtgaaactgaacacctcctattctccttccttctcctgtgtatctgttttagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttgacagacgtctgtggagcaagctgtgtgccacacactgtcttgtgtgctggaagtgcccagaagagtaagaaagttcccacgctcagggcatccacagatgtgtaaaagagtcagtgcagccagagatccaaggtgccacacctggcttgtggtcaggggaggatgaaggcaggagcagccatatctctctgggccatcagggagagcaccacagaggaagcagctcttgagcttagtacccaggcggaaagtaggagtgttccaggaggagggaggggtggcatgaacaaaggcctgaccttttacattccatttatttgcccatgctcttctttttgcctgacctgtccttacctgacaaatgacttgtctttcaaaattagctcagatattatctccaaggacctctttccaagttgctggggagctgtaaccagtccctctcctgagccacgtactggactgccagcttagtgcctgttgtgttatgttagtcataatatgcctctctctcttccctgttaggctgtgagtgtctcaaagcatcaaagcacatcttatttgtctttatgtttccagaatttagcacagtatctgatgtttttaggtattctgtaaacaactgttggactaaattgcatttgtctaaagtgtgtttatgccttgtatagattttcctagtccccaaattgtcaagggtcctcttaggctcttcagctgcagtgttgaatggacttgatatagtgagctttctgtcaacttgatatatactgagctttccattaataaaaaagaaactaagacgtttctttccaatgtaacttaattttttctgttgtctcagtctggtttgttttaggttttattcctgtggttctctggtaatttccaagattggataaaacaactaaatctcactcccacttgcttttttaaaatgctttttctacgtaaccaagcacattttagttgatgccatgacaagtgagaaatttgcatctgtgatgtttcagctgaatacacaccattggcactgacatttccactgagcctgctccagaaatctggacagaacagaggccaccagtataggagctggctgtcatcctccttcccacccactgcacatgccatgcacagctttggcaggctgttcagacttcacacatcagctgccttcattctctcaatttatctttgtactgcccattttgggggcaaggtgtcagcttattttccttcagcacctgttaacacccaaaggaattaaagataaaaatagcagacctttctattaatgtgctaatggacttcccttatgctcagaggatttccagaggatttgactggaaatcgttaaatgcagtggaaattctaatttcagtgtttggctccagcagcaagcgtacatgaagaacacctaggggccagattaaaatcatctttatgtatggactctctgaagggtgaagattcatgttttctctattgttagtaaataaaaagtgattttctttgttaacttacaaaggagaaaggtggcgagtttctcctgtactactggtccgtatttttaaatgatgtttgttcaatatattgtgttctgagacacctgacctttaaggcatcagacagaaggctttgtgccatatagaaaggaaatatttagtttgtccagacagaggaaggggaaaaaaaggaattagtcacccttaccaggaggtacagaaaaaaacagagctccttacattcccatggatgatgtagaagagctcctagcttcttaatgtactgttaaaaacctaggactaccagaagctttttttttaaatctagcccttccttattttaagcattcagttaaaatactgagatcatggcagggaaattatgctacgttcccaattttgctgtttctcttaagttttcctgggattttgttacatggtaaatttagcaaacatcatgtgatctaatcccaggcagttgttaaatggaacaaattgtggctctgcacttcagattggtttgatttttcttgttgagccaaagagtaacacaagcacctcattctcagcaggctctgtgccctctgtagggataagtcctttatcattggtggcatttcattcacatgcatgttggattgaatcccaagagtttctgtgttttttgtgtatgctttttctctcagcagcctgctaaaaatttcagttcatatttcccacctacatggaatgttttaaaacataatcagtgtagtatgaacccactttgaggaggacaggtgaaaacaggctcaatttctatgagaaatttgggaaagctgctcctttctgctgatctgcaaaaagtgtggcctttacaaattcttccttttgaagaatgtggttccaaatctattccagaaagccaagtttcatattttagagaaagtcatgtgacctggataaataaatgatctcagggctagatagtgtagaaacatcagcaatcttaaaacaaaaaaacaccaagtaatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactgtgtatgttcttgctcagggctctctagataatgcagaataaagagaaacgttgggggatttataaactgaatgttatctggacataatcactagtttttgattggggaggcagtgtggtataatagaaagagcacttgactgggagccaagagacttgcttctcttaggcagataactgcctgcctggacctgtttgctaaactattaggagatttaagtagatgatcccaaaggtcccttctgctcagaatcctgtgagtttcctcagagcacagtagaatggtttgggaattacccaggccccacctttctgttgtttactcattacttcacccataggtggtcagaggtagacaaccagctggtatcatttgtttaggtgtttggagcccttgctgatatagtcaggactatggatcagatctcctaagaccatttagctttgcatgttttgtgaccagcagaacagcatttggtgatagggcaagaggatacattaagccaatagaagttgatcccaagttccataaaatgaattcagaacacagacctacttcctaatcatagtagcttcttactctgagaagaaaaagacttcaagaaaagagtttcaacaaaatgtctgatttctctgtagtttggatttgctgcatcattctttcctcacttgtcccagataacaagagatacctgaaataggctttaggatgaacctcaaaaactaaaaggaaaaacaaaaactggttcttacagtaggattatattcatatatgatgtaatttgtgtgcatgatagaaaagtacttagtgataaaatagtttgatttttttcccccttctggtattatagtttggaggaaggagattaagttttaatttgagttaaaactgccattactagttgtgctagttgaagagatcaagtcttagttgcccgattgataaagtggagatactaatatcggcttcctaggattatgagaagctggagagataacatgtaaagtacctatagcagttgctagtttagggtagtcattcagtaaatgtgagttcccttgctcttctcaccattagcagcaccacttgctcctgtgatatatgataatgatgtttgtagtgttatgtcccacttttggagtctttcgtttgttcatttaacgagtatttattgagtgcctaccatgtacagagcactatatagaaggcataatctcactggagatactagtcagctctttttctcaaggtgcttacattctaatgggtgagacagtcagtcaaagagacaattattattgactatgaagtgcccagcaggaaatggttagggtgctctgataagcagtcatagcgagggaccttgataaagtagttaaaagagatgtctttgaggaagtaatttttaagctgagatctgaaggttaagaaggagcaaaccatgcaaagaacattgcatgaaagggtggaaacaggcttgatttgttccaaaaattgcaagggggccagtgtgagtggaatagtgagcaggaaggataggcccgagataagatcggatagatacacagaagctagttttattgggatttgttcattacggtaaggctttttttgtatttcattctt

SEQ ID NO: 12167 - DNA, 27578 bp, Human
atatgttcatccttttttttttttttttgagacggactctcgctgtgtcccccaggctggagagcaatggcatgatctcggctcactgcaacctccgcctcctggcttcaagtgactctcctgcctcagcctctcaagtagctgggattacaggcacccgccacgatcctcccgagtagctgggattataggcacctgccaccatatccggctaatttttgtatttttagtagagatggggattcaccgtgttagccaggctggtcgagaactcctgacctcaggtgatctgcccgcctcggcctcccaaagtgctggggttacaggcgtgagccatcgcgcttggccgtgagtgacttttaaaaaatgaaaagactccatcaaatcctccctgaccccagtttcctctgttgtgagcagtagagaaaggtaagattccaaaattcctatttttccaccatactgggttgaagggatctgtggagccaccctctggtagaggtagaaccttcgaaaagggcatttttaatccacagggactcctcgagctcggctggacctccgtggtgccgtgctgtgagaccatccatcactcaggcactcagcgagcccacatcggcccccaagaaccctgatgaaggtcttcctgccccctagacagacttggggagacggacaccccaaaagcgagagctctttgaggtcaaacaggtgctcaggagcaggggtacaagcaggccatcatcttttagtgctgtgaggaggagtggggggatgagatggggacgcaggaggctgctcggctccagagcctgctccacggtggaaggtggaggagagtccagggtcccacggtcagtccctgcgtggcccaggaaggtttaattcttttaaagaggaacactggacacttcccgatattttcttggtccccagctcaggccgacccaagttcttgccttccgcctagggaagacaggggaggacgacgccatctttggtctcagggcccaggtgcgaaggtcgtttggcaccatctctcctgcctgccagatgtgggcagggcccgtccggttcttcccctttgctctctcggccgtttcccctacacccgcaggccttccacagctttttgaactgaggcccagggcctcgcaggggatctcgaaggagcagcaactgcacggtgctcctcagatccgcgtgcccgaggtcaccggggaacaaagaagttacttatttttccttttagctcagatgaagagagagggcgttgtcttccacagaaagacgctgcgaactccgcccccgtccccctttttcttgcagcccttccgtgcgggtgcagctgtttaaactaaggccccaagtctccagcactttgtggagtgcaggaagaacgcgagcgtacgggagaatctgggccggcggggcgcagcgagccgcatcgcagctggaggacagccggggtgtgtctgtgtgtgtttgcccgtcggttgaaggccccatcgcccccgggtccccgccctgccccagaaagcgttccccaagagagctaggagtcctgcgcacctggagcgcgctccgcgtccacgcccagagggcgctgcacactcgcgcccgaggactgcctgccccccttcagcccctctcccgggctgcgcctccgcactccgggcccgggcagaagggggtgcgcctcggccccaccacccagggagcagccgagctgaaaggccgggaaccgcggcttgcggggaccacagctcccgaaagcgacgttcggccaccggaggagcgggagccaagcaggcaagaaccttaggagcgggccgggggtggggcgttccgaaggggccgggaggggtggctggggggcggggtcctggggggtgtggactggggctggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccggtgagtgcggccggcggccaggcggggaggcggcgggaagccgggactggtcacccgcggatgccggcgggtgcacgtggagggggagggggagcgaagacttcccttcttcccgcgctagcccagcgggtcccgggacggtgagccccgagaccagggctccagccccaatttcctccgctgtcggtgggtgccgcaccggtcccgcgctggggagggtggggggccggggccccgcgctcaattatgtaaaacgtctccacatctgtcggagcccgccagcccacagcggcgcccggggtcgcccgttcccaccctcctcgccccggccaccgcggcggccgggcccccgtcggtgacccggggggatgcagtgaccgcggccacaacgccccccctgcagaccctaattcaaaccagacccgcgggcttgcgccccagcgccgccgagcccgggcgccccgccccttgcgccagggcaagtttgggcgcagcgcggccggcgcgggagcgggaggcggccgcgttggcccggggagccgggccagggctgcgtggggggcgcgggcgagcgtctgcagggccctcgggcttgccgtgggcggctcgaggtgagctgagccggcccggcagcgggaggttccgggaagttggcctcggaacgctggagacccggaggagcccaacttctgggctgctgaagttgagctggccccggagggcgcgttcccgtgccgggcacggccgaggcgcaggcgccttccacgcgaggggacccgggaatggcctcccgctccccggctcggctttgtgctgaagccgcgcggagggaaggcgggtcccttggcccgcccagtgcagctgggagaaaagaggggcagatgtggagctcggggctgtaagaggcctttgggtgggatgcagcatccaccttcagcggggctgacgctccactaaagagggacgtggccgacaaagagcagcctgagggtccccagaaagtggctctcccgccccggccaccggccgctagcccgccttccccaatgggggcgctttgttctcggcccctgtaaccctttcctgggaacagccccgtaacgccggccttgacgggggctgggacctgggccgcagccaggtgtcagcgcgggccgcccggtgcccgagtctgccgcccgagttcgcctccccagcccccgcgcccggtgctggcgtcccggggtccctcctgcgggccggctcggccatccccagggatgcagaggggaggtgcggagccaggggcgcttccccttccggaagtggcggtgtctcgccactacatctggacagttcgacttccccagctctggcaaagggaggcacgtgggcagggaaggggcgggggcggggtgggcactcgggttctccactgctaatgtggcatctggacaagtctcagcagcgctgaccctccgtaagcgttgcctcgtgtagtagctgccagttattgagcgctttggttttttttttctttacagagtctgtctcatgggagatgaggtagggacagtcgtttctgagaccgatgtgtaaagcgccctccctgcttcccaggtgactcgtgcttccagacattttccggtccaggagaggtccctgtgcctattgaactgtgaatgggctggactgtgaggggtatctgggagcacggggagggccatgatttccgagctgggtctcatgcactcctggctttcaggtccaagaagctgctctctagggtggtggtttctgtggaactgagactgtgcttggagtcttcgctccgagtttggagaagagaatggagctgggtgccttacctccctggaccgctgggcatcacctcactgccccattctcgcacatgatggggcctcagcaggggcggctgaagttgggtcctccacctatttccggctggatttaggagggctgctggttcccttgcctgcctggggtaaagcagacattccagagccctgggatcccaccgcacccgttaatgctggggaggcaggtggagtttgggcttccccgtgaactgcctttcctggagttttctgtgggctggggcagatgctgcagtgtgaggcattatttcttgcccagaaacttggacatagggcccaggaggcaggagagtctcaaaaggggaaaggagggagactccctggagctgcagggagggaaggcttcctggaggaggtgcttgagctgagcctgaaagccccacctgagctttggggtcagactctggcttgaagcttaggtgttctttttgctttttctgatcttacaaagattagtttgttttctctttcccagttctgccctcttcctcttacagtgaatgtccatgttaggttaaaggtgggggcatgcactgccttcccaaagctctgatacccctttcctaaaagaaatcaggcagctgggatttgctttaagatgggagaaggtatttgcaagtggcagagatctgaccctctctgaaagttcactctggccccagtgggaagcaggtcagaaaccccctggggaccagggaagcaaggagtgactgaatgggtgaggggaggctgctaggagaggaggttgctcaaaaccactcccaagagactaaaacaggtttgtctaaaaaggtttctctctctctttctctctgtgtgtgtgtgtgtgtgtgtgtttactgtggtcttttgtttctgccatgtaagaaaaatggcttgttctggaatagttatttgctgtttttcattctttctctcttctctttcttgaaaggcataaaatcccttttgccctaattatgggggctagtagagacattttcccacagcctggcagagagggtatgggggggaggcactagctgcctccgctcaggctcagagccttctagaagtgatgtcatccctggcttcagctctacagggagggtggagcggtttaagtctctacctgtggctcatgatgggttccagtaaaacctcattaacacacattggtagggagacagtaagaaaggagagagcctggaaagaattaatgaaaagcttgacttctgcagttttttagaggaatcttttctgttgcagcagaattttggattcctgaaatcccttgggaatgaggtgtcctgtgtattcatattttttcatcaagctaagaatccctattaccctcgagtattcttactctgggcatgactctctgaagtatttatttcccttcctttatcaaccaaaaaatgctaggcatgatttaatctctgcctgccagggtcgtcctcctcatcattgtgctgggttaggacattgtctcctggatttactgtgctctgaagagcactttgcccctctgcctggtgccccaggttgctctgttttgaattctggtctttctcctttttccagagagcagccagaagtgacatttatgtgcctgagtgtagccagcagcttttctgatcagttctaatttgttacttttctccagtggcactaagaaactaatcagatgagttaggcttatttccaagctgagagttttaggctctgggtaagggccttgcctgtgagtgagactgatgatctgtgatatgtggattttgtacccttcatgaacttcagctgggacctgttgcagtctcccctctacctccctgcaccccacctagagtaacaaagaggtgctgccaaggtgaggcctttaggggcctctctcagtggagaaaaatgagtcatctcttgggggaagtgcttgctgacccccatgttccaagttcctcgacctggtttgacttgtaagtgacttgctggtcacaggtagctggactgaccagctgagggccattattctttagccttgactgttactctcagcttcggtcatgcccccaactcttcaccacatgtttgatttggattttagttcctgtttctatataatgtgcatccatactgtgtgacaggccagaaatggctttggattaagtagagccccaggactgagtctcaactctgccactaatttactccataatctggggtgagtcactttccttccaagtcttgttgtcctcatctgtaaagcggacatcatgatacctgttctccctgtcctcattctgtcatttgcgtattcatttcataatggatatgtgaaagtactttgtgatgaaaccgcctgaggaaagttagctgtcgatataattaaggttacctttttttgagtgcctactgttgagtgctcagtacttttctttcattcttatttgaactttacccaaaacctttacaatatatatcattgccccactttgtggatgaggaagctgaggcctagggtggcgggcccctccattggctgagacaggatttgtgtgtgtgtgtgcagtgtgtgtgtgtgtgcgcatgtgtatgggtatggtgtgaatacatcgcaagactgtcaagtctcccctgagaagcctggcatttgggggctggctgaaccctgcaaggctctactgggcatttgctggtccgtcctgaagaccatggatatgagcgttttgggctgagggggctgggccaggctgagctggcctgaacagtgccatcaggcaaacaacactgggttgggttcaactgatggcccctcagggacaggcgagagctcctcacaggaagtaaattgggacctgagagagcagggtgggaaccatgtggactgggtgtggaggggcctgtttggatggcgccctcaggccagaccccaggtggtgcccagcttgcaccatcttttaccttgggcgctggggaaacattcttggaattagcagattcttttgtaagcctgggaggcgggcagcatggcgcgggtggtggccagaacccaggactcctggctctggtgccacagtcacctcctggtcccctccaacaccaggtcctgctgggggtggggacagcccatgaggaactggtcattaggcgattgccgggcttcaactgttgcccgattgccttcttttcaccaaccagttttggaatcttgggttgaaagggcccctgaggccctgagagattcagggagtttgtggaaagagggctttggtgctgggatcctgtaccctgtcacttctctctcagctgttccagcagaggttgggttttggatgggagcatgtattctggaaccttccactgaatgggacatgcgtgccctgacaggctccaggggaaggctgatgtgtgtatgcccctcaccacaaggaggtatgtttggggtgcaggttgtagaggtgaggccgcagaggcaagaccctgggcttggggctacttcagcaactgtcttatccagctgcaggtggtcatggggcccacgccatcgcttcccctggaagagtgagctttacctgtgatgttactgcttttgcccgccctcaggaagctttcatttaggtggagagacagtgtgagaaggtccctggcattcctgagacaggtgcaccgggtcagcttgcctgtggtcagtactgtggggatctcggggaggggtggcctgagcctcccctggcaagtgtcctgctttttggcagggcctgtaagggtgggggcaagcttatggggcaaggggggtgtgccgtgggaaatcttgggtcttggggccattgagtcaggagagcagaacaggcggcggctggacctgctcctgcactcagtcacttgcccagcgacctctcctgctgcgctcggggcttcccgaggctgccactggttcctctccccactgggagcccctcaagggtctctgacctcctggcttttatggcttcgtggctgcctaattttgtgtagaggatgggcctcctctggccgtcagccctgggaaaaactctctgcctagtgattcacctgagggttgcagcaccatgagatgctgtgtgtgtgtgtgtctgtgtgtgtgtgtgtctgcgtgtgtatgtctgtgtgtatatctgtgtgtctccatgtgtctgtgtgtgtgtccatgcatctgtgtgtctttgtccatgtacgtgtgtgtgtccctctatgtgtctgtctctttgtgtttgtgtgcgtccgtgtgtgtgtccgtgtgtacgtgtgtctctgtgtgtgtgtgtgtctgtgtgtttatgtgtctgtgtgtgtctgcgtccgtgtatatttgtatctgtgtgtgtctgtgtccgtgtatatgtgtgtctctgtgtgtgtgtgtctgtgtgtgtgtgtgtctgtgtgtgtggtgggggggtgcttactgcacaggttgccactgcatttgggccttgcctgggcactcctgacttgccttcccctgtcaggctgcagtctcagttttggggggcctggtcactacctggctgcagcttccttttcagacaccagcttcctttctgcctcccacctctgctggtggccttttctctttttcactgtggctctgacatccatcatggccttggccttggaaatctgtgggagttattcctacagagacgggcagtcaggtcacctggccttcctggttcagctgagccccgactgtttggctgtggcaggccattgcctctctgggcctcagtttcctcctctgccaaagggtcgttcttcctgtcctcagttctgagagccacatggttacagagagaccttatcctgggaagggcagaggtggcactgaaggacttgttgggggctcacatttctctgccagtattctttcttgggactcgaaggagagttggttgcccaaggggtcatcggtgggatgggcaaggccagtggagggcagggcaggctgcttgaggggtggattcgagctccttgtgggagctggagtggacagaggtgcctgggtgacgttgggccagggctggggctgtatgatgttctccgcacacacacccaagagtcctggcacctgcccgaggtccgctcagcagcaggaatgaaggctgtggcgggcaggttggggcagtggggaaggcgggcatgttgatcagtccactcatcagctgagtcatggtgccagggccacgggtcctcccctgagactcacccaaccaaccttgatccactgcaagccctctgggggccggcacgaggcagagagtgcagcaagacacagccggggctcaggggcctggctttctgtcttggccctgcctcctctctctcgagtgactgtgtacagaggcctctcttggtctcagtgaacccatctgtgacatagggggaaggggctgagaggcagaggtgaggcaatgcttttgggtgtgcatggcctcttgtggctgtgtcgtgtgactggtgggtatctgggggcctgcctgtgctctgctgcctcaagttctgagggcttcatgagacctatctggcttgaccagatctaaagcccagatcctgggtacctgctgtgtgcgtagccctgtgcagtggtgagagttccatatctggtccaggggattcctgtaagagagggtggctgttactggaaccagacgagagaggtggtctctgcagtgacaatgaacgggattcgcgattcagcacctgtcacgtctccccacaggaagggttttgtcccagagtcccacgatacagcagtatcgaactaggagcctgggctgtaaggcaggacattttatggagctccaaacctgtggggctgccttctggccatgggaagtgtcagggcagggggtctccctgagggagctgcaaaggctgccagtcctgctctaggaccactcgtgtgcaccatggatctccaaaggtgttcagggaactcttccccacggtggcgtgagcttgagttcatagtcatttccacgtggggctgcctggctctctctgtggatcttctgtgctactcagcaggctgagagacagaactctggcgcctggcctgggatgcgtacggtgaggattgcacgtctgccagggtgggatgtggggaggttggaggaacttctggagggccgaggagctcgtggccaactatggcatttgtcatgaactgggtcccagaaagccctttagaacttgggccctggccctgctgttcccatgctaccaataccagtggtggccgctgatgctccagggaccttacctggttggggacttgattgtgtcagagtggcattgactctacctccagtagcttcctgtcatccctgctgcccaggaaactgtccgaggccttggaaggcccatcttatctgtagtgttccaggcgaatatgatggtcaggtttgggcttgcagggcccgaggttgtggggcgtttcaggagcctctgagaccttcctagaggctggtgtcattccagcttctcccagagaaaaccgcagggtgcagtgctgctgtgatggtgaccatatctcttccaggatggggtatcggggagggtccgggcggcaagacctcaaggctggccagggcctgcggggctgagggccaggctgggattgtgggccgtgcttgggctgcatgagatcttcaggccctgccccccaccttcctccctgaaagggacttggggcctgggggaagagcacaggaggagtttccctggggtcaggcctggaaagtccaggaagctcacccctgagtctcctcgggtgaatctgcagcagtgactggttgtcttgggctcagggaattgtagaaagggcatagagccccctgcctccctccccacctcccgtgaatgaggttcattcttagagatcttgtctggaggctgggcatgcagtgggcactctggcccacctgtcttccctgtgtaaggcagtcacctgagcctgaaggcctgggccttcctgcctttattgagtcctgagaccttggggcttcacagctgaggtgggaccgagaactagctggcgtggttagtcccggctcgggctggagtggagaggtgttgtggaggccaggaggagcacaggacacggagtctagcccacctggatcacatccggacttcattgcttcctccctgtgtcatcgtgagcacgattcttcacctaccccagcctcagtttcctcatctgtaaaatggagtttctcatatcctgccccagagggcttttgcagaggttccatgaaataccatatgtgatatgattggggccccttccttgcctagagcacagagaagcaagtctaggggagcactgaggctgacctgtgggaaggggtgcagtctgacccagcctgagcgtggagtcactctgtgtgaatggcctgctggtctgaccccagtgctgctgacgttaacagggcctgcaaacatggcttttgcccttctcagaaacatgagccttcactagcaggctagactttgctctcttccacccgagcctctgccaggggctgcctcctgacctgagaaggtacgggctgggttgcctcctgacctgagaaggtatgggctgggctggcagatgggagaggaggccaggcaaagccagacattggggcaccctggcaggggctcaggcctgctgggcaggacccctagcaatggggcacggtggcctgtccccagaacttcagactgatggctgtcctggagaaggagctgggttttctatggatgccgacaaagctgggccagactgcagggtgccaccagtggaaatgatggctgttgtcttcctgagagtgagagagccctgtgggcttcactgtgatgggtggttcatggcatgactgccagagcaagactgctggcttcagtggctgtgtgccttgggacagatgacatagctcctttgcctcaattttctcatctgtaaaatgtgcatggtactagaacctaaggtgactgtgaagatcaaactaattaattcagagaaagtgcttggaaaaaactgattgccagctcctctggcccagaggactcaataaacattagctatgatcactttttctccctagagcctaattcagttgtttctattcttcaagtaatctccagtccagatcagaggcttagactcttcttccaccacaccccctgcccaccaactcccctggtagtccctgagctctgggcaaggcatgtggctacttccctttcctagggtcatgctgagcttttcagactggagctgtgtccacagtctccctttcagccatctcaacacccaccgtgtgcagaggctgagagggctaggagctctgtgctgggggttggaggctgtgcagatctgccagcccatcagagggagggcaagccacttgacctggggccctgccagtaatctggaggatccacctggcttcccaggtggcttctccctcttcagagagagccgtcacagaaaattctgtctcccatcccccaaaccagaagggaccagccccaccctcccctgggactccttcagggacactctgccttcccgtgtctctgggcttctcagcagcctcagtgcttactcaatctgaattgttctttatctgagaggcaggttcccaggctagcccattgttctgtacgtgggaggagaaaccgtgtacatctgtgactccaggaagagcaaagagaatttcttcctcctttcctgggtatggcattgttggcatccacattttgacaaaggttaaaaactttgcccttgacatcttccagcctctctgttgtaatcctgttccctctcccagagctcccacctacccgcagtggcctagttccagagttagcccctccccacctggaagtgatttatgctgtagtgtgagtgctggtaccctttagccttcccagaggacttgttttcaaagggatattgtgcaatgacagggacactgataggagagattttggtaataaagttggagcttgttcccctcccccaccttcacacacagctggagccctggccggctgcaggtgtgtcaaaagtgcagtttctgcctctgtgaaacttgaggacactttatttagcaagtacaagggggaggatgtccctagaagtccatctggcagaggtgccccggtccccaggtccggtggctacccattccaggggacctggtggggactgacagggctgggcttctcagtaagggccgactggggaaatcttggctgagattctgaccttggtgggctctttagggcagacagggctgggggagggacagtgctttggaggcttggctgccccctctgtccccatagggtgccagttgccccacggtcaccttgatttaggatatctctggcatcctgcctaagccatgactccccttgggaagctgagggtgatgataccaagtcagtgtgatcgagtgtccttgtgggtccctaagtggggggtgtttggcgagtcttgggagacagatcccttgtttggctctcggagcagaactaggcactgaggctgcagggcctgggttgggttgctttgctcatcgcctgcctggatgaaaccttgccctgcctggcctggcccgggttttgccagggggggaaagcagaggaactggtcttccagctccacggctccacgcccagccctcagctgagcctgttctgagaccagtcctggcatgtgggctgctgaggcaggcgccagctctgtggaagggtaggtatgggggtgctgggggcagcactggcttggcttgggcatcggagctggcatgaggctgccaggatccctcctccttcaataaacgcccccggtgtactgtgagcaggcagtgcggtgcagggcaaaaagcccagggctgggaggctcggctctgcgaccttgacctcaggcttcccatctgtaaagccctgacctcacactaaatggaaaatattacccgaaagtagtcttgaaggccaaatgtgaatgccgtccctccaccctggccctgccctggaagcccccaggacagtgaggggtccgtctccaagtggcagggtggggctgtgcttgggggtgccgtccagagtgtccccgaaaggtgctcctcctctcagaagtgctgctggggacagcctcctcttcctgcccatttctgtctccctcctgccctgggccgggcccatcactccctgcctgtcataccctcggcaggccccggcttgccttgttctcagtagagagccagtgagctgataaattgctgtgcctgtcaccggaaatgctgatgctgccttgaggccccagtgaggcccctcctcctgggaatggcttcagtgggggatttcgggtctggaggcccagaccccatctgcagcctcagcctgcctccctggcgggctgtgttttcccggctcctgagttcggaaaccagccttaggagaggagtgatgtgtctagcacttcctccacaaccccgaggctgggggagcccagtgtctcctggcctgtggccctgccctgctgcctactcccacgagtcccaccattttggccaaacctccgttgtacagatggacaacctgaggcaaggtgtttctggcaccaccccgtaatttagggacagaggccagactgtcaccagactatccccatgttggacctggtcattttccctgggccaccctctggtgatcagtgctgtgggtccctgaggagggggcatttggagagtcttgggggacagaacccctgtctagttcccagagcagcaccaggtgctaaagccgccgggccagcctgtcagccgtaaagcactttagcgttatccaccaagccccttctggcgtctaggtggagaacaggtctagagagaggctgaaagctgcccaggtccccagcacgggagccgcatggcggattccagccctttcccagagacccttgctcctgggtgctcggatatgacctgcctgctcagtgcttaggccgttttcagtccaggctgaaggaaagggtcacagggctccccacagagggaaggcagccacagatccacactgcagggcactgaggcgttcggaaggcagtgggactgggagagggtgttgcagctttttctcccgtgccctcccactggtacccctggaaaagcaggaccaggccctgcagcctgtgctgccttccaggcccagccttcgtccccggagcccacctgcctgtcagctccagcagctgtcttctgctcagccctgctgggtccagccgggccggctggtgggaagccagtgggctcagccccaggcacgaaggagcctcagcccagcttcaggtagacacttcccagtcatgtaggtgcttctggatgttcagtgggccttcagctcctgggggagggaggctgggctgccaccgtggtgtgctatctatgcgagtggacgtgtcggaaatgtagaggacattgctgagctttccctggtcctttggccactagagcttgttcacagggctctgttgctactcagtgccttgactttgaacactggactcaagtgaaacgagctcttgcctcctccaggctgggccactctgggggatgccttttcctcccctcattgttttcaaagtgcagtctgaagaccccctacaggacctggggcttgtgaatgacagagtcagcctctgggcggggaactcgaaagacttcatttgtagtggtctcctggtgattcttggggaccctgaagctgagagcccccagtctggatgcaggtgatggtttggttatcaccctcagccagtatggtgtcttgatgcagaggtgggggtaaaggctggggctctgcagctcagagatatcagcccccaagagtcctgaagtctaggggaggggagagtcagcctgttttccttgtatgtgtagatctgactgagaaaccaagggggtaaagaagatttctaaacaactgtgaccctgtttcaagcctcctgaggacatttgccattgtgtggaatctcgggatggggagggtgggtgtccagcctgccatgaccatgggccctcctgcctcatgacctcgcagcctgggcttctggaacaggtctgggtctctcctgtccactggccccagagccagtgccatggcccctggtccaggttgcttgtcaaaggtggtgacctagctcctttgataaggggcagctctttatccctggtttgttggggtttgttgattcagtgactgggctcccacagaagccggggatttcgtggccacacggggcaggtacagctgacagatcagcttccctttcctgctccaccacgaatgactgcgaatcagaggccccctgcgctgcccaagttagtgcctggggtgagcgttgtcttatcctctcctgagttggtttgggggcttcaaggcctggccttagtagtccccttagggaagccctctgtacttcagcctctgaagctccccctttttaaatccccctggagccggacacctggccatatgttctgaggagctgggagctctgccgggccaggaccagactgtttcttccctcttttctccaaaagctcctggcgtgatcttggctcactgcaacctccacctcctgggttcaagtgattctcctgcctcagcctcccaagtagctgggagtacaggtgcacaccgccacgcccagctaattttgtatttttagtagagacggggtttcaccatgttggccaggctggtttggaattcctgacctcaggtgatccgcctacctcggcctcccgaagtgctgggatcacaggcgggagccaccgcgcctagtagtaatgctttttaaggggtttgtgttttacccatcactcacttcaagcagcaggtgaccaatgtcagtgattcagggtgcgggctggaaaccaaaggccttctgacctggtggcctcaggctgatggcggggggtagatgggcaacctctcgggttagcgactgggcccgctgccccccgtccaacctgtctgagatgcccactggacatcctggcttctgaggcagccaaggcacttctgagctgtcttgcagaggagctgcagcgcagctgccccttagccccagggctggccaggacaaggggctctgctgagacggaggttgccaaggagagtggccctctttacctctgttacgggagcgaaagctggcagttggcttgaggctgccttctggaagcttctctgccagctctctgcccacagacttcagatgtgctctttgtaatggctggcagccggtgatgatgactccccatccctggtggcacaggtcccgttctggtctacgccatttcctctccacctctcaaatgtgggctggtccctgggtagcgtcaccactggggcaggctcagcgactccagctcagtgaaactccatcccactgaggagccttagacaggttttccttaaaactgattgggtcaactggtagggctggggagagagaaggggatggcaggtgaggagagcagtgctgctgcacggggagttgtagtgtctgggcggccttgggcaagtccctcacctttcagagtctctagtccttatctgctagagacagtgatctcagccccgctgcctcatctgcaggggagttgtagggaagaaagaggaatgggtggaaagtgtttccagccttagagaaggccgcactccttcacactctctttcttgctgggtcagagccctgaccccaggattctctccagggtccccagggtatggccaggagaccagcatggctgagatggagatgggctgacctgacccttactcccttactccctgtccccagactccaggcagttgcctcttgatcccccagcccctaggcgagccaaaccttgggctttctaatcagtgagcttctagggtctgcgctgtgggtggggaaggggcaaggcatcccttgctttgaacaacagaatgagtggaagcctagatcttacctagcacaaagttgttgattcgttctatgaacagttggttttcctgggacttacagaggttaaaggctggttagcctgttgccttcctgggcagggcattaggtagtctccaagctgaggccacctgttcctgagcagccttgagccgtggccaggcagcctcggaagcacccaggttggagatgatgctggggagagctacccaggaggcctagagggagtttgctgccggctgtcagcacagcaggcctgctaaaggaaatcgaaagtctcaccagaaactccgggagtcagctggcaccttggtaatccaagttcaaactcagcagtttctgctaatttcctcctcagggggctgaaatctcaccttctcatctgaggggctgtcccagaagattcaagctggagaagatttgggaggtctctctagcctgtccccttagtggagactgaaggcccagggaggggagaggcccccggaggccagggagctggtttcagtggagaaaacatttgcttaagagcttgttgtgtaaacaagattgcagagggataagccagccgaactgagggaacaaattgtttttagggacagggcagactgaaatgcttatctagtcaggaggaaagccctgctcttgggaaactgctaacgtgttggggcctccctggcgttcctgggtctcactgggcggtgtctcccaggttgtacatgggccccagtgtgtgtgtcttccctgtgggcttcggttgcctcattgttgaatggagcatggatccaatggttctagcttctgctgaaagattcggcactctacaatgcagcagaggctcgtggggtcgaagtgccagtgccttgccccatccctgccccatcttgagctttctcttgggggaggcggtgcagcaggagagggcagggcagagtccttggatgagagtgaagccatgatcccagtgagtatgggtgggggtgcccactctgtgatcccccggtgggcagtattctttgatgatgaaggagacaggttgagggaggccagggcagcttcagagctctgggaaggcagcacaggtgtttgaagcaccacatggagatgttgtagatcggatgtggccttgtgtggaggcggggggagcatggaccatgactgtttgtttttattgattgattgattgagacggagtcttgctgtgtcacgcaggctggagtgcagtggcacaatctcagctcactgcaacctcttgcctcccggattcaggggattctcctgcctcagcctcccaagtagctgggactataggcccgcaccaccatgcctggctaatttttgtatttttagtagagatgggggtttcaccatgttggccaggctggtctggaactcctgagctcaagtgatcctcccaaagtgctgggattacaggcgtgagccactgcaccagtcaagtcaatgactgtttattgtagatgggccatggtggactgtgactgttcattgcaggtgagccttggcggaatgtgacttgttactgtagatgggctatgaattgcccttctagggtcaaaacctttctcttgggggaaggaagatacagtttagcttttgtcctttcaaaggaagttcagtgttatttctgaccttgtggtttctacacgtgtctgacgcttccctctgacctaggcccctggacgtggagcctccacctggtctggctctgccccagggctgcctcaggaggcaggaggtcttgtctgtccctctctgctttgcactacccagaagtgagacccgtgggcctgtggccagggcctggcaaggcctcttgggctgaggaggcccttttcctttggagcccagcctcaggtgggccccctctgacaagtcagtgcagaggcttctggtgaacagacttcttcctgcccccgtcttctcatgaaactttatctacctccctttcaccctctttctagacaggcctgctggcatttgaggctcccctagttagacagtggccactgtttgtgggtgcccactgggtgccaggctgtgttaggcatagcttcattgaattttggcagcagtcctggaatgtagatgttattatttccccattttacagatggagagacagaagccataagcagtttaatgacatcccaggaccacgcatctagtgagtggcaggatccggagttcctaaagctagtgctctggactgtgctgttctgcatattttttcattctttgttctggtcccagacattggggccctctcaagatagactgtgtagtgagtggggtccttgggtctaagtctcgcaggtgaatagggctctcaaagccacacttctcgccacctggctgctgggttctctcttccttacctgaggtcttggggccagtgtgaagggcagaggcagtcctgactttctgccctccctgccgaccagggttctgcacaggcctgctcactgtgtgtggcgtgatcctgcctccccgcccccgcccccggtcctgccagtcagccccggcctcaggaactggagagatgtgtatatgtttgccctctggcccctttgcctcttggagctgggcaggcgggcagcattcctgggactgctgtttgccagcagggcgcgtcccaggcccacagcccacttcttggaggcttgtcagtgcagggccccttccagattagccttatatgtccccagcctgatggacaccctgtccttccttccccaaggaggatgatactctgaccaaagggcctgcacccagtctttactatagacaggaactgggccaagtgtgggaaggtgtatcagggccaggcctggggttgccctgtgtgggcagacctgcctcagaacagacagttccttgtgcccagccctgcccctgccccttgtgccgtcctcggtatccacacctgggggccagcatgcctggaggctgcctctgcatccaggttgtcctgagattgttcttgggggtttttgaaagcctctcagtggggctgggtcggcaatctttggccccaaagctccctggctgatggcccccaagagctggttcacagtgtagggtgggctgatggggtcccatggggaccacagcctctgttcccaataacagctccctgtctgcccttctgagaggtctggagctccctcaccagactgagcttctcagggtgagggccctgcctactctgttgtgcccctgcagccctgcacccagtaccaggctgtgttgtagcatcaggggatggggcctggggaccaaagtgctgcccagagctgagggtcctggagccacatgagaaggcttctccctgtgtacctgtgcagcacagggtagggtgagtccactcagctgtctaggagaggacccaggagcagcagagacccggccaagcctttactcataccatattctgatccttttccagcaaattgtggctactaatttgccccctgaagatcaagatggctctggggatgactctgacaacttctccggctcaggtgcaggtgaggttgtcatgggggccccccccacccaagacggcaacaggtcatgcctgggggcagtggtcaggcagtctcctgtgtttactgagcatgtactgagtgcaccctgcctgccctgtctccacccagctggctccaaagggcaatgctgaggagaggaatggggtccgtgagctgcctggttaaggagagctcatgctcggaggtgaggtgaaggctgtgagctccagaaggccccagggccgcctgctgcacgcaggctcatattcactaggaatagctttactcactaagaaacctctggaacccccttcagaaggttatttgactcctgagcctctgttttctcatctgcaaaatgggaataataccttgacctgataagcttgtggagctgtaaggcagcacagagccagctggggtgtagctcttccatccaagctcccttccttacttcccctttccctgtgggggactgggggagagaagtccctgagctggaggtggtcagggaagcttcacagaggaggtggctcttgagtggacctcagaagaggggtgagagagctaaggaaggaggctgaggtcatccctggggaagtgacctagcggaggcctgagagctgcaaggtaggatatctgttgttggaagtgtctgttgttggaagtgggggcctttttttcagggagggtggggccagagaagtgtgtgccctgggataagtaggataaccacagtagttatgcccctaagggatgcccaccccacccctgtggtcacagaaaagctttcccaggtggcctaggcacctgtctcgtggctccagagaccaggctgcacctggacacacacaatgggaagggacagctctccttgtccattttccaaggagcttagcctcagctgccttgtccaggtactagcctccctcatagcctgagcttggccagcccaggtgctctggagcctcccccgacccacccaacacactctgcttctggtcctccccaccccccacctccccaacacactctgcttctggtcctgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggtgagtggcctctgcattccttgggaaattgagtgggttggtcctaatgcctggcacttggcaggccctacacctgtgccctgcgggcatctcgtattcctcaccaggaagacagggcacaggggcccgccttcccctacccccagggcctcgcccagagcaggacagactaactatgagatcagagcagaagcacccttaaagatcacccaagagagggctccccaaactcacaatccaaacttgcagcccctgctgcaagagtgaacgttataccaagtccaattttttattttatagcttcgtgggaattttacgctttacactaaaataagtctgcttatttccatacaaaaatgtgtgctttgtatcactttttgtgatatccatgccatggtccagccagggtccggagttgatgtggcaagaaggcctggctttcgggccctgtgcgatcctggtttgggtgcatctgagtgggtggtggcaaagatcagggaggcaggagctgcttctgggtcttgtagtggagctggttgctgctgctggcggtgacctggccaacccaatctgcccctgccctcccacaggacttcacctttgaaacctcgggggagaatacggctgtagtggccgtggagcctgaccgccggaaccagtccccagtggatcagggggccacgggggcctcacagggcctcctggacaggaaagaggtgctgggaggtgagttttctttcaggggggtagtttggggtgaattgctgctgtggggtcagggtggggctgaccacagccaaggccactgctttggggagggtctgcagcagagcccaaggagccgctgagctgagctggccccgtctacctgccctaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaacggctgctgtggtggtggttgagtctcttcttggcctggcgatgtccagccgtgtcaccttctaggggtgggagcctggttctgggcaatgctctggcttggtacagaacagcagaattcatgctggtccctcctgtcgtggaagacagagtccatctctgccctcctcccccaaacccctgtgcaggcattcagcatctcgccttcctcctcccggggctcttggccctcctgcccagcactccttgttccttaaggctccactggatcattcccttcctcaaggacttgatgggctccctactgattctcaaagcttgctatttattctttgctcactgtgatttctgtacactcactagcaacagtctttaagtgccagaggtctaaaaaaaccatgtgcctagtagggaaaaatgacagtgaaagacctggaggttgaggcagcacgctgcaccgcaggggtccttagtgtcctagagcatctattatagctggcttcccagtcttgtccaggctgctggcccactctgtccctggtgcaggtcaccccctgaccctagaccccagaccccaggaatggcctgggccctgcagagcaggagggaccgtttcttccccgcccctgcacctgctgatggagcagggactgctggctccaggtggctttgcaggatggagaattctattcttcctgacacattgtgttccaaagggtttggaggccgagataaagttttccaggtcatttattcattcaacaaacactgaaaataccagtgcctatctcctgccagttcctggactggacagggagggcccacttgtagaattggccatcagatagtaatacttttattaataacatattaataaccctccacatgggacctgcaaggttccaagaccccagctccctgggctgcctgtccccatatatccaaatcaaactgcaccccgtcccacctcttggccctgcttgttcttaatgccctctcgcaactctgtgcttccattctgagtcccccaccccagggcacccccagggcagggctgtgccatcaaacagactgccgcatgtttgagactaacagtaaaaaaggtggaggtgtttaaatgtcatccttgggcaccccttcctcaagcagtgactgcccacctccccttgggcctcagcctgctgtcctgtgtcgcaaagcctaatccccatctcttcactttcccacttgccctgcctgggaggggagcagtgggcactatttcctttttccgttccctttacatcatgcccacagtctgg

SEQ ID NO: 12168 - DNA, 16738 bp, Human
tctcaaaacaaaaaaaagaaatggaaagatactgcccagatgtggtggctcacacctgtaaccccagcactttgggaggccaaggcaggcggaccacctgaggtcaggagttcgagaccagcttggccaacatgatgaaatcctatttctactaaaactacaaaaattagctgggcgtggtgatacatgcctgcaatcccaactactcagaaggctgaggtgggagaatcagttgaacctgggaggcagaggttgcagtgatcgagactgcagcactgcactccagcctgggcaacagagactccgtctcaaaaaaaagaaagaaataaacgtgagtggatggctgtgctgtttgtatggaccaggaaaacttctagaaggataggtaaggcagtgtccataactcaacctgggaattgaagccagggtggggaggaaaaggcaacagttggtttcattctattttgtttctgtgcctgtattacttccaaaataaacaaactagtttcactttcacaacatgaaatgctttatcaggatatgcgttttcctccaacccccagtggtgtcccctcacgggacaaaagcctgccagccttcagctgccctccagagcctcacggtgcaggtgctcctgcctaagcagccggacccccctgcccccaggaactgcagccccctctgagttgagagatctagtaggcaggaaaaaaggagaaggaagctgtggctgctgggggatgtggcctcggggacaagcccctctgtgcagaggacgtgggcaggtgggatttcagccccctctccagcatctcactggcagccagggtggctggggtttccccgagggcgggggctggggaatctgacctctgtgccccggccatggtgccgtcttgctgggaggatgacaggctgtgtttcacctgccaatttggcgacagtttctcttttggaacatcccgggggactttgttctgtgccacccacctctggaccctgggtctgatggctgagctgcaggctccaaggttcagcgtccagtctggccctgctccgtccattccccacatttgagggtttcccggagtttggttctgcttcttcctctcttccatgaaactgggggcattgcccacgccccagtgtcccccatcatctgcccggtggggacttgcccactcacgtgactgcagcctgtggggcctcctcctagtgtcccgaagatacctggtcatccttgaccccgcccgcacctgcccgcgtgccccctcgggttctagtggaggacgtggcccgcctgccaccccgccaggcgccgggtcctccaggcctcctcgagccacctcctgcccacctgggatgtctgtgggttcccggcccggatgcgtcttggagccttctacccgcaccccaatctcctgccccaacaggctgggcccctcctcccgggctggccaggccagcacctccgcaggggccgcaggacgcctgaaggcccaggccgcaggtgcaggaccctctgcgggggagctgggggacatcactcctctgctctgcgcgcttttatgaaagggcctctgaccctccgggggtccagctcactctgcccgcgcactcccaggcatctgggggccgccccccgccctccctccccgcggcccactcggcccgcccagctcgccccgtgcacagactcgaggcctccaggagcggagccaaacagccccgcggggaacgcgcgccgcacgcgagctggacccgcccaggcacgaactctcctggaaaaatgctcccggcggctttcctgcttcctttagcgtgaaccgcgggtgcggtgcctcccgtgaaaataataaattcaccgtcacgcttgttgtgaacgcgggtggttcccgaaacttggaggcttcccgtaaacccagctccttcctcatctgggaggtgggtcccgcgcgggtccgccgcctcctccctggcccctccctctcgtgtctttcattttcctggggctccggggcgcggagaagctgcatcccagaggagcgcgtccaggagcggacccggtgaggcgcggagaggggcgggcgggggaaccagaggggcgggctcggtgctggggactcggtgctggggactcggtgctggggactcggtgctgagggcccggtgctggggactcggtgctgggggctcggtgttagggcctcttggtgcactggggttgccggtccgcgcagggatggggactctggggctgcggcgcctctgcctctgggaccgtcaccccccgctggccctgagcgtgcgtcgcaggccaggcgggcggggtcgcagcgggcgtacccgagtatgggcgggaacgagctgccggccggtgtggggacccgcgtccctgccctgtgcgccaggctcgactcttgaagggacagaggcggcgtctcggacccggggctcccctaagtccgatgggtcggagccccctcctcccttcccggtcctcggcctcacccggggttccctgcgccgtcgctgcgaccaagctgggagcaaaacgcactcgctcatatgcgtgcacacaagctggtggacacacgcacatgagcacacgcaggcacgcgtggactgttgcacactccacagccacagcctcgtgtgcactcacagcaaactcatgaaacaggaaccgtgaggcttccctcacccggcaggccctcagctgcccgttctcacgcgggttttgctgactccgcagtaatcaccacattcagttccttgcccactactggtgaatcacctgcagcttgagaagcacgttttctgccggtggtcagcagaggatccccggcttctaggaggcccagggcgaccggctgcaggagcccgcgtaggaggcctgtctccagcagggcgggggtggtggcagggcctctccacggggctgctgctgagcccagagcgggaggacaggaggccaccagcagaggggacaggtgaacaggtgctgagcaggaagggttagcccggtctagccccaggcctggggggctttgctgctcacctggggtcccctctgggcctggctcagcagagaccagggcagagccgtccacaccgtgggcctgggtggggtccatggcctctgcaggctgcagctgtcttctgagaggtgttggtgtgctcattctcggtagagacgtggggtcacctgtgttccctgagcccctgcagcagctgggaaagcagtgtcagccacccctcaggtgctgtgggggtacagagtccactgaccacacaggaggaccccaatgaacccagcccgagggggccggagcttccacacacccagcacccatgggagccgggacaggcaggcgcccggggcaccagggagcgggaacaggcatgcgcaggcgtgctgggcggtgcgtgaactttcctaggcgtgtcactggcatggctccaagcctgcgcatcatcgcttgtcagggagcactcagaccctgccgtgtctggtgccggcgcctcagataccgacccctgtgttcgtggtttgagagaaatctgattgccgcctccatcttttcccgctctagaagtttgttttttgttttgtttggtttgagacggagtttcgctcttgttgcccaggctggaatgtagtggccagatcttggctcaccacaacctccacctccctggttcaagcgattctcctgcctcagcctcccaagtaactgggattacaggcgtgcaccaccacgcccggctaatttttttgtatttttagtagagacggggtttcaccacgttgttcagactggtctcaaactcccgacctcaggtgatccacctgcctcagcctcccaaagtgctgggattgcaggcatgcgccaccgcgcccggcccactctagaagttttgaggctccgtgcgcctcgtctccctgtacctggtctccctgtgccaggtctccctgtgccacacacggagctgcccggccagtcaccgcccacctggccactttccctggggccgcgccctgccgcctgccctctctctgatttttagccactgcgtggcattcaactcaagcccacgcctctggtcaggaggatggcaggagaggactcaggcagacgggcagagtggcagagctgccaacaaaaacgcaggatacccagtaacatctgagtttgagatcgttaatcgtgttttaatataagtgtgtcccgagtgtcccacgggacaagctttcaccaggacatcattggttgtttatctgagactcagatgtgaccagatgtgcctggtgacctgagaggggcctgtgttgccagggtgcgttttcttctgacaaacggagcaaattcccacagcaacccaaagtcgctgacacctgctgcccagacagagctggggccacgcatggtccgcagcctgaagcctcggggtagagccagacctgccgctctcctcccggtctccccccagctccctaccccctgagcccttcaaagtcattctcaagccaaagacaggggtcttccaggcccagggctcccctccacggctgactcattccacacctttcccgccacttgccgggtgtggaccgacagaagggcaccgccacctgctcctagtaccctccagcccatcccttgccgcccttcacccctggctggacaagggtcagggtcgccaacattggagggcactcagtggggagctggtgaaggtgctgggaggaagggaggaccggggagaggcagtgagaggacccgcgtgtgagaagcagcggccgccaccacagttgggctaaagggacttggtggggaggcagcatctccggaacggtgcagtccaggccgccaggggctgagaccatggagaggatgaggccagaaagacggacagtgccagcttctcactcccacccccctctccccaaccactgcagcccagggccccaggtcttcaggaagcaatcggcagggaggctaggagccagcactgcagggtccaccctcggtggcagaggcatctaggagcagctgtagcccccgagagcagaggctccaccgagctgctggccccatggaatgcacagcgggcagacttgggacactcagggtggaggggaggcagatgcagccactgccaggcgggaggagcttggcatgaagccaggtgcgtgcagctggcccttgggggcctccaggacccagctgctgaggtctggctcagggtgcagctctctgccgagtcagggctgactcaggacacagacgggtggcagagccagcacctgggtgggcaggtggggtggacgcagcgctgtcggggctctctggggatctgtgacctttggctgtgtgcccagaattcccacccctaacacatggcaggggcagtccctggaagcatttgtgaaacagactcagatggcctccaggctccaggtgagggcaggactccccagagcagcctggggagagcagcagggcatcccctcccggacacggtcggcggggtggtgcggagagcagtgggggagcccccagcagccccgaccctccctgctgtccatctgcacggttccaaggtgggtggctgagctggcatcgtggagcgtggggtgagggagccggacccaggccccctggggtctccttgtgtgaacctcacctccatgcaggggtctgcaggtggcctgggtctcccaccgcactgggggtgggggttctgtggtcggctaccagtccccaaagatgtcacgtcctcatcccagaacctgacatggcaaagagactatgcagatgggatgaagcctcgggtgctgagctggggcatgtgtcctgggtcacccaggggggcccttgatgccatcacagggtctccaggagagggagagaggagggggagtcagggagatgagggaagcagctggggggcagtggtggggagatggcagaggggccatgagccgagggatgcggatgcctctggacgctggagacggagagggacagattccgcctggagcctccagaagggaccaccctgacccaccccttgattttaacccagggagaccccgtcggacttccagctaatctagaatgctggacgtatgatgggagatggggcccgagcctgtctccaagcccatctgagcagccctgaggggtcacagcaggaaagggggtgttagtgaggggccacaaaaggtctcaggtgtgggttccctccccttgcactcagccctgacagggtggggtggggtttccaacagaagggactggacttgtactgagcatagcggctgcctggagtggggaacccagacctcaggacacggcacccgcagcctgcgccaatgtgggaccatccctgagcctcagcagcacctcggggttggtgacgtgcctcccagcagtgacagtgtccccacacctgcactctgcggctggcagggtcttccacgtggaggcaggaccatggtgagagtatgggaatgaccgggtggctgcctgtggctgtgcagggcccagggatgactagaggcatgttcacagggggttggagcgcttggggcaatgggacgagaaggccggagcccgtctgcaagccaggtcctcagcaggcccagactccaggctccaggaggacccctggtaacatggggtccccggggttggtgacgtgtcctgctgtgacactttctggtggtttatttgtttggagaaacacacatctataaatctatagacatctataaatagcacgtctgaaggtcgctttacagagttccctcatgggagttccctgcaggtcatctgcactccggcgtgtgggctgcactgggagctgggagaggcagggctggagttgccgccctacctagggacttttcctagcaggggtgcaggcacccgagaggcagggcagcctggccacgaacccttgccccagccgccttcgaaggtggagttctctcggctgaaaggcgtgtcctgccagggctcctgctgggccttacccgctgccccacctggaacagacccaggctgcctcccctcactttcccttccctggtccctttcaaagtccagcaggaacgtcaacaggttcatgcaaaagcacgtcacctggtccacgtgagggcctgacctttgaccagcccaggcatcggcccagaccccaccggcgggactgactgagttagggttggggttaggttagggtagtctcctgtgcaaggctgagctcctgcgtggaggcaggtggggctttgtggagcttccacacagggaccctcatcccccagccactctcaggggatccagatccacacggatccagcacctcctgtatgcagggcatgagtggggaccccgtgggaagcacagaagcggcgacctcgctggggcctgtgagaggctcatcactgcctgtcgggccctcccccagcaccgtgggtgtgtgccctggagccgcctctgcctggcgggagaggagccacacagctagggggcccctagtgtttgcaggcctgagacaagatggcacaaggaggctcgcctgctggaagctgcccagcagcctgccttgccagtgagagcagcagaggtaaagctgacttgcgcattaggaacacacagaggtgtaaacgatggattcgaaaggaacgcaactgagtgctgccccgggaggggggctggtggacgggcagggtggtgggggggctggtggacaggccggggaggctgatggacaggctggggaggccggtggacgggcagggtgggggggctggtggacgggctgggggggccgctggctgcaggttgtggtcagcgctgggcttggctgggggagtcggaccctgggtgctggtcatgtgagggtctctgtgagtgactggaggtctggacaggacccacgaggagacagacacgctccaagaattgtaatgccgaagctctgtgccctgggtgtgcagtgatatcaaacacatgctcctaggtagacggaaaattggtttcatgcttagcgttggtgaggggctggggctggaggctggtcttagtatagtgttaggtcagacacggctaccaacgattccacctgtcctgacccatttctataggaaacatgctcaggcacagttacgagtaatttattgtaaaacaaaagggctgacccgcaaggcagatggggtccccgctgtgctgcgggcaactctgtctcccgcccccgcgtgtcttctttgtttcgtgaggtcagcattgcacaccctctacaggcacagggaagggaaggagggcaggggctccagcatccagagcaggtcggggaagagctcggggacccccagcctcccagcccccgccaggtgacagccgctcccgctgtccccttcagcagctgcagggggctctgacccatgggctttccttcctccagggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggtaggtctcggggccccgcctctctgctggggaaaggggggcccggtgggggcatgacaggggcaggaggggtggactgaggttgggtccaggtgccaccagacccccgataatgactgactctgcagacccagggcctgaccatgtggagctgggctgcctcaggtggcggtgagtggaccgtgtcccgccgtgggtggagggtggtggtgagtgggccgtgtcccgccgtgggtggagggcggtggtgcccgctgtggtacctggtggtcactgtcagagcaattgtggggaaggaccaagatcacgaccagtttccaagggagagggtctgggtcagttgcgacctgtgccatggccgggaacagacagcagccctggcctgggggctccttagtcaggcgcacctcaggcctgccaggagtggatctgcatttgaacagggtcccccagtgagatcctccccagctctctagatccccaacctgtcagcaaagtgacctgaggggcttttcttttcttatcttttttttttgagacgggttctacctctatcgcccaggctggacgcccaggctggagtgcagtggtacaatcacagctcaccgcagcctcgacctcctgggctcaggtgatcctcccacctcagcctcccgagtagctgggactacaggcatgcacaccatacctggctaaattgtgtattttttgtagagatggggttttgccatgttgctcaggctggtctcaaactcctgggctcaagtgatcctcccacctcggcctcccaaagtgctgggattacaggcgtgagccactgagccacccgaggggcttttaaaagatgtcagagctcagccacatcccaaaccacatcccaaagcagttcagtcagaatcctaagaacgaacaaaaaacaaaacaaaactgaaagggaagaatcccaggtggaagaaccctggtttcgggagattctgcccccaccccccaacagtggttccaaagtgtaactgggctggggcaccccctggacagccgcccgctgccctcgggacggtgtgaatttgtgcagtggccttagaggccctgcagtccctgaacactcagagcgtccaggcaggcagccagcctgctcgtcagaggaaactcagtccagcccgaaggccaggtgcccctgaagcccacctcctcccatgggcaccaaggcccctggcacttgccagcacatggcacccaccatgtggttttgtatttggtgaaatgtggccaaatggcggctccaaccagcatgctgtgtgctccccgagagctcaccctgccgtccgtctgtccgtccatccgtccgtgtccagtcactggtggacgctgacgcagcagggacagtagcagcaccaagacctcaggctggtaccatgctcgggcccgacggcctgaatctcaggcatccttgagctggctgctggggcaaaggccccagaccctctgagggaagcagctgcacgggtcgctatggggcagggttcacccaggaggcgggagagagagactgacacgccggcttgtgtcaaggacttgacctcccaggactgtggagctgtgtatggagctggcccagcaacctggagctgagcgggtggccgggaggggaaagggaatgttgggggtggcacaagcaggctgggccccacaaggacaggctggaacccatgtctgctctgcttgcctctgaggctggcctgtgggtgtctgcagaagccctgcccttcctcacgcagccgagcacctgcacctggcctaggccttggagaaacaggagggagctgggggcggtggggcctggccactgcttcccacgaggagggtgattcggcaggtcagtggcagcactcctgccacagcgcagccgcccggcacacacctgaggctctgacttcacccaccccagtggaaatatacaggggagggagttgataggaaatgccttcgtccaagctgacacaccccaaggaacagacgtgggtgtgagcacgcacacacacacacatacacacacacagagccacccgtcttttttgttgctattttattcttcccacacgagatatatgtgctgattgggtcgggtggatgtatacatagttcactgtgtcccttagaggccctgtctcctgccctggccctggccctgggcacagcagccagccaatgccctgaggtccagccctgatccgtgtgtgcctctgtctggccctacaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgaggggaggctcggggaagcaagggggaggggagtgagaggggacacggggaggggagggggcctgggcagggggagggctgagactgagagggaaggaggaggaagaagagcaggcatgagccgggctgccaggagacagggttggcgggtagagagttggggtggaggcctcttgacctcctgggacagttcttcctttgggaggggcaggggtcaggcaggaggctcagggggcacagaccccacagtggggtgggacccacagagggcagccggagtcccacaaacaacacagaacacaaagctgctcctcaaaggagcccagtctgcctgtcaggggtgggctgcaccctgcagccaggaagcccaggcaccccccgcctccctgccacccccaccccggctgtgtggggaaactgcaccccaaatacctgtgctctgagaggccctccagacccgcagcacctggcttcgaggcacctgccctccctttactggggtcacccagaggtgctcaaggtcgcccgcgcagcacccttagtgaccacgaacaggggcctcccaggctgccacggtcctgccccgcccctcccactcccactcccatgttgtccacctcgacaagcacctagaccacacctgccctcgccactcctgtcttcagggctgggaccacccccgacccttctctgtccccacccctctcctcctgccctcaggggatgctcgctgccccactctctgcctcagctcccccgacacaggcatgatcaccacccactcatgtccccactagcccagcccactgctccctctgcctcttctcccccgactcagggcccacagccgtcaccaccagctacttatctggttcaaccagaaagcagtggtggccagcagagcagcccccaggccctctgttctgccctccaagcccctcccacctgctccctaggccctgagcggccaccccaccgtgcggggccactgacccctctagtcaccaaacccactccccacccctcccctccctttcctgcaaagctcaggagcctccacggcccctcccagccctcccaccttcaccacacccggttccgacctacccgggtcacccaaattgggttccgctttgctctccacccccagggcatctggtgagcccttcctgggctcaggcatgaggctcctcagatacctggccctgggtgggccacaacagggcaggcccctcccctgcccttgcatctcttccccagaaccccgaggcctgaaggaccgggccagcgcgcagctcctgggacctggcacatccaggggtagatgtttccctcgctgccccgacacacctgcgctctgggtctccttccacctctggtcctgcgccccctctcctcctggctccctcccacccctgtacctcctgggcaacggcggtgccgtcttccaaggctcattctcaccccagggagtgtgtaggaggaggaggctgggagctacacggaggaggtagggggtgggggatgcccagcccacctgtacacccctgaactgcctccttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggaggtaggaggccctgcaccccagtttgtgcggggtggggagtcttgggtggggctgccccaggctgaggtcagccttactgtcctgcacctgctggggctccaggagagggtggggggagcaccggtcccagagagccagtccccgccaggggcccagccggctatggtcaagaatacagagccaggctccccacccagacccgccctgcccttcctgcaagctctcactgtccccaggactccctggagggcagcatggcagggtgcgtggtctccatcagggacggaacttggagtttctgagccaagggagcctcttgctgagggtgccttggggagtgggttcaacctccagcagtttcagaacccaggcgagggctgggagtgtgcctgggggtgggggtgtgcatgagcacgtatgcccgtgagtgtgaacgcacgccccagggcagagctgtgggcacgggggcgcgcggctcacacaggcacctccttcctccccctgcagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaaacccacagacccggactccctttctgccaccccaggctggtccggccccaggtgtggggtccgctctctccactcccagggctccgcgcccaagtgagggggcccctgccggagcctcagacacactccagttcagggctgtggggggccttggccacatacctgtcccttggctatgagcaggctttgggggcccttccgcggcagccccgggggccgaggtagggtcgggggcttagaggctgggatggctcctggccccaccgccagggggcagcgcaggccgggctgggaggcggcggcggcggctcgggctggggggtcaggtggacgccgccctccggggctggacgcgcatccctcagtccctcggccacccgggggtcgctccctcgtgcccaccgcacctgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcagggacgcggcggcgcccggtgaccgaggcctcgcacagccggccgccctgagggtcgggccgagccagggtccaagaggggcgcgtttgtgtctcgggttaaaataaggttccgtccgcgtgctgggtcagaccctgttctgtgggcacagcgcccgggacccccgcacgggggtcacacctgcctacacaggctgaagagcattggcgtgtcttcaggtcaaagtttttctttctcttttttcttttctcttttttttttttttttttttggagatagggtctagatctgccgcccaggctggagtacacggtcgcgatcacggctcgacctcctgggctcaagcgattctcccactctggcctcccaaagtgttgggattacaggcatgagcccctgagcccagcctcaaagtcactttgaaatcggtagtgcggtcgccatgtcccctgcgcacccaggcaggaaacccaggaggagagcctggggctggagtccgtgaggattttcatcttttcctggtggcttatctctgcttctgttttccctactgggatttagtgctggtcctcacgctgccttccccctccgtgtgtggaagtctgtgtctccctctgcagcccccaaccccacccggccccatgctgtcctcagacacaccaggcacgctctggcctcagggattctgccctactgatcccgctgcgtggaatgctgttccccggggccccagttggtttcacccacggcccgttcctgggttggcctttgagggccacacccacaccctgtgtcctgctggctgtccacctggcctccctgaggtcagctccaggcgggagggctcctggtccacactgccccctgctcctggcacagacgctggcataaagacgcccggtgaacgttggtgacccaatgcatgcatggagcaaaggccagaggaggggctgctccggcaagtgctgttacccaccgcctcgagccacagccttgctagggtgctccagggtctctgcgcaagattctgcccccaaaccctctgtctctcgtttatggagagcctgggggaggaaaaccggctcccccaggaccctcggcccagcagaaaacctgcaccaccccacagccccacccgtgtctccgcaccggctgctgtggctgggacttctggggaaggagctcagggctgcaggtccgtgtgtgagtcacgggcacacatctctgcacacacgcgtgagtcacgtgcacccttctctgcacacacacgtgtccacatgcacccgtttctgcacacacgcatggagtcgcgcacccgtctctgcacacacgcatggagtgacgcgcacccgtctctgcacacacgtgtgtccacacgcacccctctgcacacatgcgtggagtcacgcgcacccgtctcctcacacacgcgtgtccacacacacctgtctgcacacgagtgtccacacattcccgtctctgcacacgcatgtccacgcgctcccgtctctgcacacacacgtgtccacacgcacccctctctgcacacacacatgtccacacgctcctatctctgtacacacgcgtggtcatgcacacccgtctctgcatacatgtgtggagtcacgcgcacccgtctctgcacacacgcgagtcacgcacacccgtctctgcacacacacgtgttcacatgcacccgtctctgcaaacacgtgtggagtcacgcacacccgtctctgcacatgcgtggagccatgcgcacccgtctctgcacacacgcgtgtccacacgcacccgtctctgcacacacatgcgtggaatcacgcgcacccgtctctgcacacacgcgtggagtcatgcgcacccatctctgcacacacacgtgtccacacgcacccgtctctgcacatgcgtgtccacacacatccatctctgcacacacgcgtgtccacatgcacccgtctctgcacacatgcatggagtcacgcgcacccgtctctgcacacacaagtgtccacacacccgtctctgcacacgcacgtccacacacacccgtctctgcacacgcacgtgtccacacacatccgtctctgcacacacgcgtggagtcatgcgcacccatctgcacacac

SEQ ID NO: 12169 - DNA, 15503 bp, Human
acagggtctggcattgaccacaggctcaggaaacgttaagcgtttgtgttgtgaggctttgcaggtgatgaaactattcaactctgccgctgcaacgtgaaagcagccagagacaatatgtttacaccaattagtgtggctgtgtcccaagaaaactttatgaaaacggaatctcgaatttcgcacagtttttatgcatcacaaaacattttccaaccacttaaaaatgtaaccactattcttagctcacaagctgcacaaaaccacgtggcaggctggatgtgacagacagcttgcaaccactcacctccgctaatcagagagtgacctgcaggcagtcttgggtgtgtttagagtttctcagtcccctgtccctgaaggatggctatttccaaacctgctggggaagggtgaggggcctgggttctaggggtctcacttcccctcttgtggcttcagtttccctgtccgtgccggcagggtgagcttttggctgtttccagctgcagcttcttaaggtggctgagactgtgtcatggcgaacacctgctgggtctctggttttcattttaaaacaacctgtgtgcggctgggcacggtggctcacgcctgtaatcccagcactttgggaggccgaggcaggtggatcacctgaggtcgagagttcaagaccaaccagcctgacaaacgtggagaaaccccatctctactataaatacaaaattagccggggtggtggcacatgcctgtaatcccagatactcgggaggctgaggcagaagaatagcttgaacccgggaggcggaggttgcggtgagccgagattgtgccattgcactccagcctgggcaaaaagagtgaaactccatctcaaaaaaaaaaaaaaaaaacaactttgtgcaaggcaagatatgagtatctttctgtgcatgtcctgagcccttgcctggtgcaaagccgcagggcagatcctgggagacccccctattccctcccttctggaagtgtctgggtattcttaggcctcccagcctttgcctctgctgtgctctctgcctgggatgcccacctggcttgtcatctcaagtgccacttcttggaagctcctcctgttaacctccctcccccacccaggatggaaggagaggcccctcccttgctcaccgcaggatggcactcactgcgctgtgtcattgtggcatgatgttccaccgaattgtttactcgctggcctccccattggatggagggctaccagagggccacagcccagaattgctggcctttagacctcagggcatgcagtctggagtgccagagttggtcaaatgaacaaatttaggatgaagaaataagataagcaggacttgcccttgtggtatctgtagtccagctccctagagaggctcttggttgcagctgaaagggcctgtgctgtgcatctacagagagtgttttgagtcctgcgagaagaaatacaccatatttgcaaaccctttgaaggttcatattttgtgttttttgctccctgaccacctcccacccctccccacgccccaccaatcttgggcaagaagcgagaccattctcctttttctctggtcactcctgtccttcagggggctccctctggccccgactgtccattgctgctgaagtaatgctgtggcctttctcagtttgggccccacccaaaaccgaagaacttctccccagaaagcttctacttggttctcagtgttttcacagttatgggaacccaagaacagtgtcagacctaggaggtgccccactaccaccctgtctttatcaatgttgtcaccaaagctgtcacaaacaatggggtgtgggctgtcacatggccctgcctaagtaaccacattctcgcttcctccttccacacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtaagtgctggcttgcaaaaccacagggagtggctggaggtccccatgggccaagggcctgccttatagctgctggcaggcccgggtaggaccgccaggcccttcttgagctgcagcacctggggagggcaaactgaggctcctccgactcaagactaaagtcttcctggagtctgtggccttattctgtgactcttctgaatcctgctcctgccaactttttttttccttctttttttgagacagggtcttactctgtcacccaggctggagtgcagtggcacaatcatggctcactgcagccttaaactcctgggcacaagtgatcctcccacctcagcctcctgagtagctgggactacaggcgcacatcgccgcatgcagctaatatttttacctttcctagagatggggtctcactttgatgccgaggctggtctcaaactcctggcctcaagcctcttgcgttggcctcccaaagtgctgaaattacaggtgtgacccaccagccccagcctcccattaacttacttccctccctggccagtttgcctgcagcgtctggcttggcggcattctgattttgaaaatcagagaaaccatgagtgtttccctagaaatgatcttatcctctcctttcctggatgggaaactgaggtcgggagaggtgaagggatttgtttaggggcagagctgagattaggtctggaagactccagaaagtagggggagtgcaggatttctcttgaagctgcatgttatggacgcataaaaaagttcttttcagagaaagatgcattcttcccactttttataagactgaggaaatgacacttgtctgtggcaaactattaaaatattagaattaagatactattgttagcaaaagggaaaacaataataataataataattagaatacttggctgggtgcagtggcttacacctgtaatcccagccctttgggaggccgaggcaggtggatggcctgagctcaggagttctagaccaacctgggcaacatggtgaaacctcgtctctaccaaaaatacaaaaacttagctaggtgtagtggtgtatgcctgtggtctcagctacttgggaggctgaggtgggaggatcacttgaacctgggagggggaggtcgcagtaagccgagattgtgccactgcactccaacccgggtggcagagtgagaccctgtctcaaaaaaaaaaaaattagaatactcttattagtttgtatttgagatactttcaggacactaaaaggaaatggtgggggccagttgtgccctgctgtacacacattcacacacacacacacacacacacacacacacacacacaccccatattgtcgatatctgggcttctgttgcctggaattctcttcctctttcctctttcttctgttttccttttttttccatctctgactttgaggcccccagagccaggcccctcagtgggccggggcctcagaaggtggctcccaggccctcagacagccccagagtctcttccgaggccgtgccctgggtggttgatgcctccctcagcaggcttggccagcagccaggggagttaaacctcagagagcggaagggctgggctgctaggctgggcccagagtggggcattcagaggagctggggaatcaatcatccgagaaccttggagggtggacagtgccccttttacagatgagaaaactgaggcttgaaggggagaagcagctgcctctggcggcatggcttctggctgcaggatgcccatggagttcgtggtgaccctaggcctgtgtctcggcttcctttgctgaacttgaacaggaagatggcagtgggggccagtggtctagaaggagataagatggctggtgtgtgtgtgttgggggtctgtgtttgttaatctgtctgtctacacaggggtgtttagaaaactgtttaaagacagttgttcaactaaccagatgtaggtctcattgaattcatttgtgccaagtaccttactgcctctggatcaggccagcaagtttgggttccaacaggtgtaacttggttcttggtggggtggagggtggggaggggggtgtaacaaaaaaatctcaactaacactgtggtttgcaagccaccaaacattaaacagatacacagcatatctgtgctattaacttttcatgaggagggctggtcaccgtggctcatgcctataaatcccagcactttgggaggctgaagcagatggattgcttgagcccaggagtttgagaccaacctgggcaacatggggaaaacccatctctacaaaaaatttaaaagtagccgggtctggtggcatgcacctgtagtcctagctacttgggaggatcgcttgagcccaggagttcaagcctgcagtgagctatgattgcaccactgtagtcgagcctgggcaacagagaaagaccctatctctaaaattaaataaataaataaacctttcataagggcgatgataagtgggaaaaaatgtctacagagactccctgatgtgagttgaggtagatgacggaaagaggttggaaagtgtcagctggcaaatgtggtgtgaaaagtgtgaagacagcacgtgctgtgcagttctgtgcacgttcccctgcctcagtcacatgtcctcttctgcagaggcatttagtgaggcccctggggatgccaggagacccaggagagctcctgccctccaaaaacttgtggtctggtgggggcagcagagcagacagccacagtggttgccagccactggggcaagtgttgcgaggggtgtgtgcctgcccatcggctgaatcctgggcctgtggcctgatcagcaagacagctgtggttcctgccttctggaagtttaggagtcaatgtgaatacatttttagaaaataaatgaacagcagaaatgatttaaacacgggaggtgactaatcgtgcctggggcaatctggaaaggcttctgggaggactcagcatttccctggccctcttcaacccacaacaaccccataaaaagcgggtgctaccattgtccttgtattccagctaaggaacccacagctcagagaggtgaggtgagttgccccaggtcacacagcttctaagggacagagctggggattgacctggtttgatgtgactcccagggcacagcagggcagggcagggcctgtcctgtctacccagacttagatctgctgcctgtgcctcagttatctggggtctttccttctcttggtgactacttgacccaaaccctgagatgctcagtcttttgaattttagcattccaagatcctgcccgctctgaccaccagtttcaggattctcagtgcaaggttcctagcggcgtggagccccacgaggatctttcctgagcagctcagggcggccacacggcggggtctctggagctggagtctgggccccctgcagcctgctcctccacacagcctagatggggcccatatggggtctagatggggcctgggccagaagcagcctggttttagggcgaaagaggcaaacgagcagtctctgacctactctgttaggcaagtgttgagacaaataggacgtggtcactggagacgcctctgtcggagccctgccctggccccacttctgtgggactgttttttggccttccaggaagaggagaggtggaaggtggggcctgggagtgatcccgccgctccgggccttgcttgctaatcagtgtgatggcaccgttagagccagtgaacacaggggtgaggaggaatgaggtcaccagatagtgagaggatgaaatcatccctccgtgggaggggcttccacatatgtcatttttattgttgtataatacatttactgtagcaaatattaaggaggtattatgctacctgccatacacggtgagaaaactcagctcctcccccttctacctgtgtggcctcagctgagacaagatctctcagagcctcgggttttcttttctttcattaaaaaaaatatgtttttttcttagagacagggtcttactctgtcacccaggctggagtgcagtggtgcgatcatagctcactgcagccttgacctgggctcaagccatcctctggcctcagcctcccgagtagctgggactacaggcatcaccagcatacctggctaatttttaatttttttgtagatatgggtctcagtatgttgcccaggctggtcttgaacccctgccttcaagtcatcctcctgccttggcctcccaaagtgctaggagtacaagctcgaggcaccgtgcctggctgagcctcagattttctttctgttagatgggctgatgcctgctcagctgtggcctggctccaggctgctgtgtcttaaagccagtgggatggcagggaccaggctggggtgaccaacaaccccccacccccagtttgcctgggagtgaggggtttctggggttgagggactttcagcactgacaccaggaacatgtaggataaggtggttgctttagacgggcccaggaaaggaggtctgggctttccgaatgtaccaggtcttatcataacaggtacggaggtctctgctttctcaaagcccaaacacccacaggggaggtagagaggccgccatctccataccctctgagtctgagacctccatttcctctgctcatctgcctgcagcgccgaagagagtccttcagataaagtacccccggctggaagccagcgtctgggaacttccatacactcattcaattctcatgatgattttttttaagcaatattgccggttttacaatgaggaaactgaggcttagagagggtgaagcaacctgcccgagtttacacagccgctaagtgggggcaaatgtgggattcaggccccagcctctcctccaccccagctgtctctgggtgcaggaggctgtggggatggctgtaggggaagggtgggcaacagtgacagcctacctgaagaactgggccccagcaccctccgtgtttctgtgttattctcccagcctccgggctgctgcaagtccggccctgactcaccaagatgcctcccccaacccgggaaccagggagaccaggccttgcaactttgcccccaccttctctgcttccaggaagtggctgagggctttgccttccaggaacagagaactgcccaagtgggggttggtagctgtgagtgtgctcataagtatgaaatatgtctctaggctaatggcttcttcctaaagtccctgcctccaggaaagtggggccaaggttgggccgtagattcttcccccagataagaactctaccccaaagaaattctgctgccctgaaggcaaattgggaggcaaaagtgtgtgtgtgtgtgtgtgtgtgtgtgtgtgtgtgtgtgtgtgtgtgtgtgttacatttattaagcacctactgtaagcttggaacttttgttttcttgttttgttttgagacagggtctcactctgtcgcccaggctggagtgcagtggtacaatctcggctcactgcagtctcaaccttccaggcttaagcgatcctcccacattagcctccccagtagctgagacgataggtgtgcatcatcatgcctggctaatttttctatttaaaatttttttattttatttttgaggcagggtcttgctttgtcacccaggctggggtgcagtggcatgatcacagctcactgcagcctcaatctctccaggctcaagcaattctcccatctccgcctcctgagtagctgggactacaggggcacaccaccactcctggctaattttttgtattttgtagagacgagagacagggcttcaccatgttgcccaggctggtctggaactcctgagctcaagcaatccacctgccttggcctcccaaagtcctcggattacaggagtgagccaccgtgactggcctaatttttctatttgtgtcgagatggggatctcactatgttgcccgggctggtcttgaactcatgggctcaagtgatctgcctgccttggcttcccaaagtcctgggattacaggcatgagccaccatgcccaccagcctggaacttttgaatctatccccttgttgcactgtctcaacagccctgtgagatgggcactgtttcttatcccaattttacagatgggaaaactgaagctcagggaggcaagcatctgtgtcaaggtcatacagcttgtaagggacagagctaggacttgaacatcctttttgtctgaccccacatctatgctttcaaccctatgccctgcatggcacccggtaaatatgtggcaggcctttctgggggacataactttcaagctcctcctttttcttactctgccctccctctcccacccaagtccacaagcccagccttctgtctcctcaactaggtcaggtgtctcctgacggcctcatgccttcctgaacctcactgggtttcagtctgatcttgacctctcaccagctgtgtgtctttgggcaagtcacttcacttctcttaacctcagtgtggtccttggtaaaatggggataattgtgagggccagatgtctctggtgcaaatatcgtaaagtttggtttaagaaagtatttttttattttttagacagagttttgctcttgtctcccagactggagtgcagtggtgtgatcttggctcactgcaacctctggctcccaggttcaagcaattctcctgccttggcctcccaaatagctggaattacagggagcaccaccacgcccggctaatttttgtatttttagtagagacagggtttcaccatgttggccggactagtcttgaactcctgacatcaggtaagccacctgccttggcttctcaaacagttgggattacaggcgtgagccactacacctggcctaagaaattattttaagatgtgggtcgggtgtggtggctcatgcctataatctcagtgctttgagaggccgaggcaggaggattgcttgaggccaggagtttgagaccagcctggacaacagcaagaccccgtctctacaaaaaaaaaaaaattaaaaattaaccagatgtggtggcatgtgcatatagtccctactactcaggaggctgaggtgagagaatcacttgagcctaggaggtcgaagctgcagtgagctataattgcactactgcactccagactgggcgacaaagtgagaatctgtctctaatataagtaagtcaataaataaatggaaataaattagtttaagatatgatcagatttgcatatttgaaaccaacataggcctggcacggtggcccacgccctgtaatcccagcactttgggaggccgaggtgggcagattgcttgtggtcaggagtttgagaccagcctgaccaacatggcgaaaccccgtctctactaaaaatacaaaaattagctgggcatagttgtgtgcgcctgtagtcccagctacttgggaggctgaggaaggagaattgcttgaacccgggaggcggaggttgcagtgagccaaggtcgtgccactgcactccatcctgggcaacagagcgagactctgtcttggagaaaaaaaaaaaaaaaaaaaagaaaagaaaccaacataattctaactaacatatgaaagagatcagattgaacctggctggaaggtgaggggcccgtgagtgagttacagtcacccgaggaatgatgagcaactgttcgttcctccaaatcatgtgaatgaagtacaaaggaagagactggaaattgtccgggtgctattcttgaatgcccactctgcatcagacactattctaaaagttgtgtgctgctgaagggtgttatatccagggaatgcaggaatacctgaatcctgccccagaacgtggctgtcactcaccataggattctcagcatagaatttttaattctgtaaacaccagccagtgccaaggagagcatgaggggagagaaagaaaacaagaaagcacaggtgttcacaatgccaagaagaaagatcaatgagatgaccaaacaagaggcactgtcttttctggctacctagtagggaggacaatgtagagtctctgaatagacagtggtcctacccacaggcacactcagtgactataagcttcctgagagcagggctgttctgaagagatttgagttttctcctggccatggagagtgtaattaagtagccctgggcccttgaagacttatagtgcaggttgactgaaagaactaaatcagccagtctttgcggagaggttgtcatgcaaacgaagtgctaagggtcttgcatgcatcccttcattttatcctcacaataggctgtgaagtaggcaccgtcatccctgttgtgcattgtgcaggcaagaacaccaccaaagcaaatgggaccaagacaagacattgagaaggaatgagacaaactgagactctgaggactggcaagggctatggagggtggaagcaagataggagaaggaggaagacagacatatagaggtggcatggcagtgggcagggagagggggcagcaggtagaatcagactccaagaggcctcaaaggtccaataagcagcggtatctgggaggtctgtggtttacaaactcttctgcttatggacttcgtaagtggtcaattaatctatttatgaattctgtgcaggtactactttactcttatgatagattataaataatgtaatacttgaaattaagaaggagtgacatgaggtcgggcgcagtggctcatgcctaatcccagaactgtggaaggccaaggtgggcagataacttgaggccaggagtttgagaccagcctggccaacatagtgaaaccccgtctctactaaaaatacacaaattagctgggtgtggttgtgcatgcctgtaatcccagcttctcaggaggctgagacaggagaatcacttgaacccgggaggtggaggttgcagtgagctgagatagcgccactgtactccagcctgggtgacagagcaagactccatctaaaaaaaaaaaaaaagaaaaaaggagtgacatgaaaagttaatagaactagaagcagaagcactaaatctttctacaccccagtggattgtcttgtccacaaataaagtggcttaaccaaaatggagagggaggcaaatcaatttctatgcaccatctagaagaagttaaagggccctcctggatggctttattcatgttgatgagtaataataataactgctactggctgaggatcttctccatcccaggcatgtcagggatgcctaagtccccagtccctgctccagaccagacatgcttccagctgtggcagtagagggtggtggtctagggtgcttgctaagcccaagggtgaaactgtcttgacatccctccgcccattgtctcctcctaggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaacgatagcggaatccttcaaggtttcaaggctgtctccttcaggcagccttcccggaattctccatccctcagtgcaggatgggggctggtcctcagctgtctgccctcagcccctggccccccaggaagcctctttcatgggctgttaggttgacttcagttttgcctcttggacaacagggggtcttgtacatccttgggtgaccaggaaaagttcaggctatggggggccaaagggagggctgccccttccccaccagtgaccactttattccacttcctccattacccagttttggcccacagagtttggtcccccccaaacctcggaccaatatccctctaaacatcaatctatcctcctgttaaagaaaaaaaaaaatgggactgggagcagtggctcatgcctgtaatcccagcactttgggaggccgaggcaggtacatcacctgaggtcaggagttcaagactagcctggccaacatagtgaaaccctgtctctactaaaaatacaaagattagtcaggtgtggtggcacatgcctgtagtcccagctactggggaggctgaggcaggagaattgcttgaacccgggaagcggagggaggttgcagtgagctgagatcacgctactgcactccagcctgggtgacagagtaagactccgtctcaaaaaaaaaaaaaaagattcaatgacccttgttaaagcatggtaaggaagactttgttcaaggggagtgggactctctcaatcactgcagggactgcagctatgggattttgcagtgggggcatttgggctcaactatgagtacagcaggggcaagtgggagctgatagccagggaacagggttggatatctgcagctggaaaattaccaagaggaaacatcaggggaaggggaattctggctaaactgactgctggggatgggttctcggtcattttctacactgacctaacaggattcatactggaggcaggccagggtgctcagacatcaccggggggatggtggcagatgaggaacgtgatcagatataggaggtgatcagatatgggaggtgatcagatatggagtggtggggggagggttgttgctaagctgacttagcagagttcttgttagaactggattttatttatttatttattttgagatggagttttgctcttgttgcccaggctggagtgcaatggcgcgatctggctcactgcaacctccgcctcctgagttcaagtgattctcctgcctcagcctcctgagtagctgggattacaggcatgcgccaccacgcccagctaattttgtatttttagtagagatggtgtttctctatgttggtcaggctggtcttgaactcccgacctcaggtgattctcccgccttggcctcccaaagtgctgggattacaggtgtgagccaccacgcccggcccagaactggattttaaaaggaagtgcacagatgggcctaggagaggactcaggggcctgactgattaaagcttggccaagcacagaatctttcccactctccagaagctcaccctgacctctccttttcactcaggccctgtctctcattaacagccagtagcttattggtgatcctagatgcagcctgcaaccttttgtacaactcacagaagcactgatttgctgtcaaatggtggaaaagttcaagctgccaaactttttcttaaaggaccaaacagtgaatactgtaggccttaactgttgcaacaccatagcctctgttgcaacaactcaactctgtccttgtagtacaaaagcagccactgacaatatgtccataaatgaatgcgcatggttgtgttctaataaaactttatttacaaacgggcggcaggctcatttcagctccgtcagtttgctgacgcctgattttaagcatagggtgaccagtcgtcccagtttgcccggaactttcttgattttagcactgaaagtcccat

SEQ ID NO: 12170 - DNA, 49394 bp, Human
  misc_feature (1)...(49394): n = A,T,C or G
cctttggactcagagtgctgcaccatacccagcccaagctgtttcatattaggttatgtgcttcttgcctcaggaattcttccatgtgacttctaattctgcaagcaattacagtgacaacttcagtggatgtagttccctgatcagtaagtcacctccaaaccgcagacaactgtcagttttacccagaagtgataaaatattcccaggttacccaaatccacgcccaagcacagagacacaactttttttttaaggtgtggtatgaggacttgtaaacattctatcaaagtcatgctgtagtccagaaagattctcacatgctaatgtacctgactggtaaaatagtgagatactagtccagccaaggaaaatgtccatatttccttttagctccctgtggttaataagaaagaaaatttatttaggctgggtggagatgtcattgccaccccctactgaagctcaccaccatgacccaccatttccattttttttaagtctgcaaaaggatgatgaagtgtgtgcaaaggtatctcagttccagctgctggagtcaccgtggtggagtttggggtgcccaagggtcaggactgcttgacgcttgtgcctcagagatgctggcagcacttggaaccacaggcttgtcctcaagctgcatggcacctgcacctccttaatgaaaaatttcggcacttccctaggcaggaggtataaaagaccaagggacacagaggtaggctggtcttaacttcaaaggctgtctcccctccttgggtccagaagtgctagcaattcacttttgctcctgagggtgggacatggtactaatcatccaatagcaattgaagggcagagggagaatcgttcttaaatttcagcctatgtgagtatcaccaaggggagcttactaatatgtgggtcttggctcccacccccagacattctgattgggaaagtttgggaaggttggcaaaggggctctagaaccaaggtgctaggtttctctgatgccagcagttcacgggatcttactttgcaaaacattctcataggacctgcgtggcccggggatgagaggcaggaagttattttgtcatctccctctccccacatccacacttcatattgccgcagtcccttctgaagctctgtgagttcatcttacccggcatcagctaatagaggcaagttaaatgcaagggggaacgagccctctttccttaagactgagtacatttggctgtccaaggagtgtttctcacattttaatatgtatatgactcacttgaggaccagtgttaaaatgccgattctgaagggtaggtctgaggtgggcttgaattctgcatttcttttcttttttttcctcatatttttccagttttatttgtataaagacatacatggcctatccaatggagctttgtcaaataatccataagtacctaaagcacacatgactcgtaatgcttttaatatcaaaagaggttatttttcttaatccaaagattatataattttttttgcaaactactagtgggccatattaacatttgaataatcttttaaaaatttaaatataaattttggatttgggggcacatgtgcagctttgttacaagggtatattgtatgatgctgaggtttgggcttctattgactctattactcagatagtgaacatagtacccaataggaaatttcccaattcttgcccccaccccttcctccttttggagtccccagaattgattctgtctatcttgatgtccatgtggacccattgtttagctcccacttattagtaagaacatgtggcatttggatgtgactgcaaagcacaggattttgttattttttatggctgcgtagtattccatagtgtatgtgtaccacgtttccttgggtacccgggtgaggctgaagctgtgaagctgtcagtgtgcagaatgtactttgggtagggaagctctaacaggctgatggtttcaggtgcgtcctcaccccctgttacagtatcaccatctctatgatcagcacagcccatctcctaaggactcaaaatattgaccacgctttggaatgggaagaaaatcaaaccagagagtcatgcttataaacccaaagctggggctgatcttctcaacccactcattagatttcattcttgtcctagaccttagggttaattcttttccctcagaccctgctcattatggaaactcacaggttccttcctatttttcccatctattaacattatggactgtgccctttaccaaacttcccagtcctcagcccccatccccagacccaccaggggttgatggtgttaaccaactggtggtatgtacctggacaactaaagttacataggaatctgacaacaaaattgggactttccctgttccatttgctcatgtctgggcagtttcaacctcaggttatgggaggagccaagaaagagaggggaaattgaagtctttggagggaaaatcccacccctgatacattgaggacagcctgtcccctgcgctgacttactaggggagcaggcagtagggattgctgtcagcaaggtctaagggaggccacttgttgtaggtttggagaagatgggcaccagaacaagctccgaataggagcagaaagcgcctgcatcttcatgcatctgcagactatttagataagaaggggctgtacccaatcatggagagttgtttgcttaaataaaggaagggaaagctgcatgtgtgtgtgcttaaggggagaaggagggggtgggaagaaggagaaaggggccaggaattttccacagctgaaacccaccacgtggttatcattaggatgaccttcctatcacctgagcaaaaggactggtggatgggggctggtgaggaaggatttgggatccgatccctcggatttcagctaagttctgatgtggcagttgcaagcactaaggagaagttcttatttcccgcttccctggagtgcctgagtccacagtcctaaagctgtgtaccctcaggaagcctgcccattggctggccaggtaggatccagggatccagcttctctgagatccccgggtgtcagggcttaaatataaataaagcaatcagaacccacagtttgttggcatggatgcagtgaaaagggaatgcttatacactgttgatgggaatgaaagttagtataacctctacggaaaacaatatggagatttctcaaataactaagaatagagctaccattcgatctatcagtcgtactgctgggtatctacctaaaggaaaaaagtcattatatcaaaaaacacctacacctgtatgtttattacagcacaattcacagttgcaaagatgtggaatcaacctaagtacccatcatccaatgagtgaatataggaaatgtggtatacatacaccatggaatactactcagccataaaaaatgaaataatgtattttgcagcaacttgcgtggagctagaggccactatcctaagtgaagtaactcaggactggaaaaccaaatactggcatattctcacttataagtggaagctatgctgtgggtacacaggtccaccagagtggtataatggacactggagactcagaagatcagagggtgggagtggggtgaggaatgagaaattacctattgggtacagtgtacactgtttgggtgatggttacactaaaagcccagacttcactatataattcatccatgtaaccaaaaacaatctgtaccccctaaatctattgaaatggaaaaaaaaaaaacccagaactgcacaataaatttccttccaaggaagggaattagaaagaaaacaggagattctgctaaaatgctttgcacaagatccccatctctactgcactttttattttattttagttttatttatttattttgagacagggttttgctctgctgcccatgctggagttcagtggtgtgatcttggcttactgcagccttaaccttccaggctcagacaatccttccacctcagccttctgattaactggtactacaggcataagccaccaagccatgctaatttttaaatttttttgtagagacaagtctcactatgttgctcaggccggtcttgaactcctgggttcaagcaatcctcctgcctccacctcccaaactgctgggattacaggcatgagccaccgtgctcagccatctattgcactttttaatgatttacactagcatctgctgttattgtttgtacttgggaatggattgagggtggaaggggtggtttaggggcctcagtttccatttttgctgcatagttctctggggggcttatgcagatctgggtaatcttgccccatcaactagatgagtaggcccatcatctgaaggaataaagagatcacatgccacaacccaacccacaatctaagtgcatatttcacaatgtggcccaaggacaaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccaaggcccctacagaagaggaggagcaggaggcagccagtaattgcctagagaaaaaaataagtaccagcctgtaaattgcaatgtatatcagcgtgaagccttgctagctctgctccccacttgccaaccactgccacgcagaaactccctgcatcctctccagacttccccaggctgccgccttattttcagatgcctcctccctgcagtgccagaattgacagctatgaatgagaaacacaggctggagctggataaggaaggcatcccataatggagactgagtagatgtgcatgagacccagaggactgattttcactcaaccgatggaaggaaataatttacctttcgaaccctagaatgagcttcactgttctgtggatcttgatgaagaaaacaaggaaagctggtatgtcctggtacgtttggctccctgcaaaatatttctttcctaggccctcttcattagaaacctgcctctgccctgagttggagaagacaggccttttcccctgccgtgcacattttcccacagtcctgagactgaacctatagcagggccagagaaaatcctctccagttttctcactgtttcctccctgcctggtggatggaaaccagtttgctcaggagaagtggtttctaccgcagggataagagatccagcctctaagacaagtcaaataaaattcatgtgttacacacacacagacacacagacacacacacacacacacacacacacagtcacacagttgcccagggagagggtcgcagctctgcaccaggaggacaatttgttttaaggtgcatgctgccctggctctcaatttgttgctttcatttttataatcactgttgtgttccaattgttgtaagtggcactgggaatgtttgttctcatgtaattgcttgtttcctactgaaatttccatgtcagaccccttcattgttctcagtatcgctcgcctcccattctgtggggttggcatggattatcctagtggcggccggcagggcatgtgagcaccattccgctcagtcctgacgcagctgaggacggctgggggaaatggtcccggctgctgggccgaacactgggatgagagaatcttgacaagggcctggcctgcctcctgattctggactgggccaaattcggagtgcattttgcatccccacccccaagtatttcagaggaaatgtgaccctgtgtttctgattcatgtgcacttaactcgttaaaatgttgatttacaaagggtgggtggtgtccaaataaacctctggagcctcaattccaagccagcctttttttttttcggtgactttttgttgggagggtaggtgggaagaaggaatcaaagattttgtctttgatcgggaagttacattccaacaggaatgaaacttggacccagcaggcaggaacagggacccagacctttgcaattgattgggttctctattggatgagttatgtgcttccagacctaatcagaaccacctggacttcctcaaggctcatcactgtccatgccgcatgaagcatttgaacttgacctgcgctgaaattgagccagggtacataaaacgaaagcccagcatccacttacaggaataaatgtacatctgcagagaggacttggaattctgcaaaaaacactcagagcttggtgcttctcttcttcacctggaactctagcaactaccacccatgaacattaatctactcctttaaaaaccccaccccttccaggaagttggggtgtactttttataaggtgcatatgaaacctatctagaatggggcaaaggatggtgatatgttataaattcagccgggctgtcttcttgggcctccaaactgctttaggaagccctgggtttttgtccatttatcatttcttatttatttatttacttattttagagacagggtcttgctctgttgccccaggctggagtgcagtgtcgtgatcatagctcactgcaggctcaaactcctgggctcaagcagtcctcccagctcagcctcctgagcagctggggctacaggagtgcatcagcatgcctggctaatttttgtattttttgtagagatggcatcttgctaggttgcccaggctggtctccaactcaagcaatcttcctgccttggcctcccaaagcactggaatttcagttatgagccaccatgcccaacctatttatcatttcttttaggagaggaatgtttaaaaaaaaatgtatcccggcactgatgtgggaagagcacatcccttttttagggtgtgtgtgtatatgtatgggtatctgtgaatgtgtgtgggtgcatatcagtgtcagcgtgtgtgggtgctggcattgagatgtgtgcttgtgtttgtgttggtgtctgtgtgtacaatgtacctccaatgccaggtcactgggacttcccctcctcactggcccctctgctggaagcccctacatacttggggtcgagtggaatgttaaattgtggtaccaagtctgctttgtattgattaccttttttttttttttttttttggggatggagtctcactctgttgcccaggctggagtgcagtcgcgtgatctcggctcatgcaacctctgcctcccaggttcaagtgattcttctgcctcagcctcctgagagtagtagctggtactgcaggtgccagccaccacacctgtctaatttttttgtatttttagtagagatggggtttcaccatgttggccaggctggtctcgaactcctgacctcaggtgatctgcctacctcggcctcccaaagtgctgggattacaggtgtgaaccaccccgcccggcctgtattgatcactctttttcttgattgttccttcatcacttccacttgtctgtcagcaccatgaggacagctgccgtgtataatatgagctctgtgtctccctccccactgccattgccctcagtacagtgccttgcacatgccttaaattcaagaaacttgtaaggggtggttaagaaagaagaggaatgaattgaaccaattggacttcagagtgtggcagagcatggcctggtggggctacctggggaaaggcaagtgactctaaagtggggagagttgggcagcactccaggacctttcctgtccctgcctgcgaaactctcccccacccactattggcactattgggttgacgtcgtcgtccattaaactagctttgcttttccattgcgaaaagaaaatgatgcactcattccaatatatttggatgttttaaaggttggtctggcttcacagacgatgtccatcagtggctgacataccaatgaaattgaagaaaagctggttttccagtatttctttggcagagaatccagcagctgacactggatcagaattagggctcataaaacttagagccaggaccttgaatgctgagtgctcacttataagatgctttcaagtccttatcttgcagaacagttaaatgtctgcatctggctcactccccttgggatcactttttagaatgatccctcctggtgcaaagtgtggagagctgaactggccagcaaacctgggatgttttcttccgaataagtggttcatttgaatcctttatgtgaagttaattctgcaagattccttgctgcaggacttgaaaaaccatagtcagaaggcagagatacaaaccaaaacaccaccaacatcaaaacaaaacccaaccagacaatgaaacaacaaaaaagcccaaacacaaaaccttctatttagcataggtctgcaaagaaaggatttctgggaacctcacatacagactctgatagggaaggtaatggaagaggtgggttatgtcctaacttggtcaacaagttctggtgaggctaggctgaaatactggtggatgggggtgcacacactttgcagtcatcagggtagggttttatcttgttctttctcactttttttgtttgtttgtttgagactgagtctcgctctgtcgtcaggctggagtgcagtggcacgatctcagctcactgcaacctcagtctcctgggttcaagtgattctcctgcctcagcctccccagtagctgggactacaggcacacaccaccacatccagctaatttttgtatttttagtagagacggggtttcaccatgttggccaggatgatcttgatctcttgaccttgtgatccacctgccttggcctcccaaaatgctgggattacaggcattagctaccacacctggcctctctctcacatttagtgacatctcgagaaagtgccatagtattgcagttgacttaaaattctgcttctttgcatcaaaggacacaatcaacagagtgaaaaggcaacccacagcatgggagaaaatatttgaaaatcatacatttcataagggattaataaccagactatttaaagaactcctacaattctacaacaacaacaaaaaccaaatggcctaattaaaaaattcacaaaggacctgaatagacagttttctaaagaaggtatacaaatggcagataaacaagtaaaagatgttcaacattactaatcagtagagaaatgcaaatcaaaaccacaatgggatattacttcctgcccattcgaatggctactatcaaaaacagaaattatctggatgtggtgtcatgtgcctataatcccagctattaaggagggtgagggaggaggatcacttgagcccagaaattcgaggccagtctgggcaacatagcgagacccaatctcttaaataaacaacagaaaataacaggtgttggcaaggatgtggagaaagtgattggaacccttgtgcaatgttggtgggaatgtaaaatgctgcagctactgtggaaaacggtatagcagtttctcaaaagcttcaaaatagatttaccataagatctagcaattccacttctgagtgtatacctaaaataactgaaatcagggactcaaagagatatttgtacatctatgttcatagcaggattaatcataatagccaaaaggtaggcgagtggaaaaacgaaatgtgctgtatacgtactacacaatagcatttgctttttctaagaatgaaggaaattctgacatgctacaatgtggatgcaccttgaggacatgatgttaagtgaaataagccagtctcaaaaagacaaatactacataattccacttatgtgaggtatcttcagtagtcaaagtcaaagagatagaaaataggttgaaggttgccaggggctggggtaaggagaaatgaggagttattgtttaatgggtagagagtgtcagttttgcaagaattctgtggagggacggtggtaatggttgcacaataacatgaatgtacttaatgccacagaaccgtacacttgaagtggttaagatggtaaattttatgttatgtgtattttaccacaattaaaaattaaaaataatttaaaagtgttgttccttctctcatttctgggacaaaagatgttgtccaaagtccaggaatatgtaagttgaaagctatgtgtgcagcagaaccttatttctgagttacgcagtttagtgaccttctaatggaaaaaaacttcacggagtgtgttttccactgccttctgctcaccacactgaggattacaagaggaaaacagctacaccagagtcaaaagtgatcagacctctgatttcccaactctggcagagaagctgcaagcgcgcgcgcatacacacacgcacacatacacacacacttacacactttccagccagctcagccgacttcctctgagagatgacaccactttgcagcctccctgtgggacagagtggaacttgtaactcactttcttgtgcctcccaggactttggctgcctagaaggaagagaagggagtgctaggcttctctgagaaactcagagcttcctctgcagccctgctcctggccagcatgagaggagggagcttgaaccaagagtcctctcctggaggggaaacctatctaagaaatattttctatcaatcagtaaggctctcaaaagccattactgccaacatcatttcttatttgccatctcttctcccccctttaaaaatgtccttactttttccctttttttcccgtcttttctttcttgtccattccctttcttttttctgacggttttgtaaaggggaggtaccctgcacacactctcttttttgtttttgtttttttaattttactttaagttctgggatacatgtgcagaacgtgcaggtttgttacataggtatacgtgtgcgatggtggtttgctgcgtccattctttttttttttattttttaaaatcctcttccttcatttctccccttctgcctccttctatccccctgtcctcaatctttctgtttttcttgctttctcctcatttttctctctttcttgactccccttcatagctaaagttaccgtccttggcacaggactcgggttctgaggagtgacacagcaggagttcatcctggggaccctctcgcaggcagcgctgcacatagggaacctgtcccggctgtgggaggccaggcagcctccccctccaaggcagagccagacgaggctgtccatcctccttgcatttctctgtcaccttgttcagacggcctttgacttggggggagccacgctgatttacagcaggcgcatcgcggccggattgcaggaagagccacctctctgcggtggggggatgtggattggcgcctgtaggatgaaatgtggcacattgggcctcgtcgctgccatcagtccaggggcattctcagatgcaagaacaaaaacaaagcacgattgtgttccagccctgtggtgcattccttccacagctcatcaccctgtcatcaagcctcgtgcctgccacacacaccgggggctgaaacaaaagccgtttcccttcacacagcactgagctatcttccatctgtcggggccgcttccccatcttgggacaactggcagcgggctctgacaccctgctagggagtaagaggcccaggagaaatgaaaggagacgtcctgctcaattgagacaggggacagctggtgtcctcgttttctgaagggctcagagaggcacagagcgcatcaaactgtccacttagcgaccgacctttttccccagtgctgagggaacttcccagactgggggccttcagggcctgggacttactggcactcaaggtaggaagaacagacaaacagctgcttatctctgcccaaatgactccatccagactcagggagagagttctattttttttttttttaatttgagacagggtctcactctgtcacccaggctggagtgcagtggtgtgatctcagctcactgcagcctctgcctcctgggttcaagtgattctcctgcctcagcctcccgagtagctggaagtacaggcacacaccaccacatccggctaattgttgtattttttggtagagatggggtttcactgtgttggccaggctggtctcaaatgcctgacctcaagtgatcctcccgccttggcctcccaaagtattgagattacaggcgtgagccactgcgactggccttaatgttttcaatcattaataaaagtcagtggtttgggggtagccactgtaccagctcttatgaaggatgcaaagataagtcagaaatgaatcctgcccccaaggattttacgatctcgcagggaaggtaagaggtcggtataagaaccccagtgctgagtaggaagtgaaatgagaaataagagaagtgtggacgaactcccctgaaaatcctcagagtgatggtattgggaggactcacaaggtggggcagtgaagtggagcctgagagcggtcaggactggatacgcgaggtcaggaagagggcacagcagtcagagaaggaggacgtggatccacgctgggggatctgctgaaggctgatgccaggggaactgacctaatcagaagtggctttaaggaggctggagaggccagcagggagacacgaaaggtatggcctaggtctgccaaatggcctgcaagttttaatgaccagcttcctgggcagtgcagtggccagggctggctgccatgaacagttcctggccgggctggggctgctcacagcatggtccgtggactggctgtggctggcccatgaagaaataagtacagaaattgtaatttgatggagtaattttatgtccgtccaatctaataatacaaattttcagcttgtattttgagtgctttgtttttattcaatttttcctaataactcatttgtactgcattttacaaaatatagatctgtgacagattggacagaaaaaacaacaactggtctttcctgacagcctttctcaaaccatggctggtttgagaagatattcttcctggaagaggctccgttttcctagggtgacgcgtgctctagcctcatatggtttgctgagggctgctgactgatgcctgatctatttcctctctccagctggagtgcaggtggcctgtcacatctacatacctgtgctggggtcccacatggttaggcagggacacaggtcttcaggtgtgtgtgggagctagggccggtgtttctggctccaccctgagagtaaccttgggtcgtggggaaggtctggagctgaggactgccaccagcctacaggcgaggccgtggggtgggggactcaggaaagacagaacagcctgcaggagaagccatggggtggggtaggggggtacccagggtggcctgcaggggaagccgcagggttgggggactcagcgtggcctgcaggggaagccgtggggtggcagggcaccgagggaagatagagcagctgcctgctctttgtctgggactctgggctcccatctcttttcctatgaagattttcatgcatctaatatttgtaactggtttactgaaggagctaggctggggctgaaataatgaaatcattttctattttccacctgactgcctttcccgcctgctccattggatccctgtcctgggggcgtcatttagattccattgctttctggtcctttgcaggtactaagacactgtctcatcttcctgtaccaaatagtccagactaatctaaaggagtttttaaaggtttttatcttattttattctagtttttgtttgagacagagtctcactctgttgcccaggctggagtacagaggcaccatctcggctcactgcaaccttctcctcctgggttcaagtgattctcctgcctcagcctcctgagcagctgggaccacaggcatgcaccaccatgcctggtttatttttgtatttttagtagagacagagtttcaccatgttggtcatggctggtcttgaactcctggcctaaagtgatctacgcgcctcagcctcccaaagtgctgggattccaggtgtgagccaccgcgcccggccttaacgttcttattgaagttaaactttccactctccctgccccacagcctcctaaacctgcagtagaggaaggggtgtatcttttccctctctgtgtgtcttcctcctctgtgataaaagaaaaaccttaaacaacattaaatttttttaaaaaaacattaaatttaacaggcttaattgaacaaagaatgatttgtacattgggcagagccgggagcagaataggctccgagaggctccaacatagccacatggtggaagaaggtttatggacaaaaaagggaaagtgaggaacagaacacagaagtgaggtgcagaagcagcagggtgattgcagctgggcacttgccttatgtgaacagagtttgaacagttggccgctttcgattgccagaaactcggtgattggcacaagagtaggctgcagtctgttcagtctccaggtagcttacagctcactatgcatggaaagaactttaggccaaacttaaaatagtcaaagaggcagcttcagatcagacttagttcaacggcccctgctggctctcctgcttgttgggaggtgggtgagagggaggtggggagccataaaggggtgaagcagtcatccctggctggcgataggaactgagtaggtaccttctaactgggccggttggtgcccaaggtgaggctttctctctggggacttttaggaattattggacaccctctcccttccccttggggacctcccatcttccatgtgacacagttccctcagttcctgctcctggaggcccagcttgcacctgtctgctggggctatcttgtcctggagggtgcgcttgtgaacatggcctttatttttcattttattttattttattttatttttgagacatggtctcactctgtcacccaggctagagtgcagtggtgagataattgttcactgcagccttgatctccttggttcaagtgatccttctgcctcagcctcctgagtagctgggaccagaggtgggcaccgttaggcccagctaatttatttttatattttgtagagacggagtcttgctatatggtccaggctggtctcaaactcctggcctcaactgatcctcctgacttggcctcccaaagtgctgggattgcaggcatgagccaccgtgcctggctagcatggcctagccagaggaagcacctggctccgtggccctgccagtccccgagaggcactccaggacaaccctctcattgctggcccttccacatagcaacccatgctctggccatctggctctcctgtaaaggtcggacacctgacctggggcctcttgactccagggaacaccgtgtgggctcccctgggaactcttcctgggcctcccctctagttataggcccccttttctttaggcagaaaaaggtgaccatccgtatcacctgtcaccatgccaccagccctccgctccatctctcgcttttactctgaaggaaggtgggcggtcctgatgggagatggaaacacatattactcccatggagagagcgcagtgtaaatccctgttagcaacacagctctctggttgtattggagaactgaaaaggctcaaccgactgctaaggtattacaaggcagggactatagcaagcagttactcctttcagggaatagagggccgagaagaagtatggaaacttcagctactcgggaggctgaggtaggggaatcgcttgaacccaggaggcagaggttgcagtgagccaagattgcaccattgcacactccagcctgggcaacaagagcaaaactctgtcgaaagaagaaagaaagaaaggaagaaagaaagaaagaaagaaagagaaaagaaaaaagagaaaggaaggaaggagaaggaaggaaggagaaggaaggaaggaaggagaaagaaagaaagaaagagagaaagaaaacttagaagcactcctgccttgagtggtaacagcatcggcagttgtctccctgtcacgcacagctgaaaaactggataagaaagacatgtgcaatgacaattgtcagacactgggtagtgggtagactgagactgtgattgctgggagaaggaaaatgaagcaagaaagccctacaatttccctggctctctgcttgcgggggatttctgaaccagggtgcaggaagagtgaaccccaacagaacccagtggtcctgttgaggcagagattggagttccggaggctgagggagctgggacttttaaggcagagaatagagatgaataaactactcagaaaatgactccagaaatgtgcagaggggttctcttgagtctggggctgagcaggatggcatccttgggattgggcaaagaacaaccactggggaaagaacaattgccgagaggctgctggccaagagatctccagagcttacacaggactgggacacattcaattccactaggtagcttggagaaacctagtttaatacttgaacagccgcagaaagtacacatcttggcagtggtacttaactaatctagaataacacttctctagatctcctgcctgataaaaaggttttctttttttttaaagcccaaactattcaactgatgtctgaataactcacctgaaagccagaataaagtgcaacactcttgaaagaaatgcaacaaaatctaacactcaagaatgtaacattcacaaaattactagatttgcaaagaagcaggaaaatgtaacccatagccaggagagaaaaaattactcaaaagaaataagcccagaaatgacagacatgtggaattagcagaaaagtaatttaattttccctatttccatctgcttgagtgtgactggacttagtgactcacttgcaaagaatagaggatggaaggggaaaaatggtaacttcacagccagagatctgacagatacgatcttcaccaattgatcaaggtttatatccctgctgatatatctggctaatatcatttatcccctatatgatgttatgagagggcacttcacctgtctggtatttaaaaaaaaaaaaaaaaagaacaaccccatatatctctagcctaatatgaggaaaaatatcaaagaaactctaactgggaaacacgtacaaaatgctgaccagtacttttaagatcatggaaaacaaagtttggaaagtgtcccagtccagaggagacaggagaaatgcagtgtctaaatgcaacactgtctcctggattggattccagaacagaaaaaggacattagggggaaaagtggtgaaagctgaacaaagtttggagtttggtgtatagtaatgtaccaatgttagtattttccttgtattagttttctaggaccgtgtaacaaagtatcacaaacagggtgccttaaaataatagaatttcatttctcacagttctggagccttgagtctgataggaagatgttggcagggaggtgctttttctgaagggctttagggagaaaccattcccgcctctctctgccttctggtggtcactggcaaaccctgggattccttggcttgtagatgcatcactccagtctccacctccttcataacacggccttctccttgtgtgtctcttcttataaggattcctgtcatactggagttagggtccactgtactctagtatgacctcatcttaacctaactacatctgcaaaaaccctatttgcaagtaaggtcacattcacaggtaccaggggttaggacttcaataccttttttggggagttcagtttaactcacaacacatactttttttttctttttctttttttttctagacagggtctcactctatcgcccaggctagagtgcagtggtgagtcactgcaacctctacctcctgggttcaagcgattctcccgcctcagcctcccaagtagctgggactacagatgtgtgccaccacgtccagctaatttttgtatttttaatagagatggggtttcacaatgttggccaggctgatctcgaactcctgacctcaagtgatctgcccgcctcggcctcccaaagtgctgggattacaggcgtgagccactgtgctcagccacaacacatacttttaacagatgtaccagagttatgcaagatattaacattaagggaatctaaggaagggtgtacagtaactttatactgcctttgcaactttcctacaaatctaaaattattctaaaataaaaatttatttaaaaaacatccattataaatatgctcaaaaatctagtggaaaatatgaagataatggagagagaaatggaagatataaaaaaaccaaacagaaattctagagtggaaaaatataatatctgaaatgaaaaatgcaactcctggctttctgtcctccatataaggaacttagaagttgccactgtgtcctaacaataagagctgaacaaactgaaaaatcaaccactcttcttagatgcataagagaaatgatgtcatagggcaaactactgccccctaaattaaacagacagacaagcaaatacagagaatcatagtacattagagcagcaacctctgcaggaaccactgctgcctgggagaaccggaactgtaactgacaagctgatggagtctaggcgtggacaaatctgagacttaaaagctctagggagacccagtcttaggaggcccccaacacttatgtgagttttgtcttcaggatatcaaccaggttctcacagtaaatactggagaaaaatctcctcatgctttcagcaggatgggagagagaaaggagccattttgaaatatgccagaacactctgtcttaacaaggtctgctgtcgggagaaattagttaactagagtctaacctgctggaattttatcagagcctaatgacctgggagggaaggaggaaatgcccaaatccagccagctctatccttctatgtaggagaggggaaataacccaagttcagctactctagccatcctgcccaacctaaggtggagaaaaattgagaagttcacagtccagaggcacagagtcactaagagacagaaacctcatcatagaaatatggaatgcttattccccccatacactttaccaccacattactaagggtctatttactgcatttcctttaacccactacatcatgtctagctgtgaagaaaaaattacaaggcatactaaagaacaaaagacacagtttgaagagacagagcaagcattagaaccagacatggcagggatattagaattaggacaggagatttaaaacaactcctattaatatgctaagggccataatggatagagtagacagcatgccagaacagataggtaatataagcagagagatggaaatcctaaggggaaaaccaaaaggaaatgctagagatcaataatactgtgagagaaaggaagaatggacaagtcctttgatagaattcttagtggactggacatggctgaggaaagaatctctgagcttgtgggtagatcaatagaaacctctaaaactgaaaagcaaagagaacagagactgaaaaaagaaacagaactgtgagacacttacaaaaggtgtaacatacatgtaacggaataccagaaggagaataaaaagagaaaggaaacagaagaaatgtttgaaataataatgaccaataattttccaaaattaatgtcaaacaccaaaccacagatccaggaagctcagagaatatcaagcaggataaatgccaaaacaactacacctagacatgtcattttcaaattacggaaaaccaaagataaagaaaaatatcctgaaagaagacagaaggaaaaaccagctaagctagagagatgcaaagctaagaattgcatccaacttctcctcagaaaccatgcaagcaagatgggaatgtagtgaaatagttaaaggtttgggagaaaaccccccgccagcctagaatgctgtaccctgtgaaattatccttcaaaagtgaagaaaaaaaaaaagacattctcaatcaaacaaaaactgagggaatttctttgccagtagatctgccttgtaagaaatgttaaaagaagttctttagagagagggaaaatagtacaggtcagaaatttagatctgcataaagaaaggaagaacatcaatataaaaatgtttattcttcttatcattaatttttttcttttttagattattattattctaaatatagaggtgggttctcattatgttgaccaggctggtctcaaactcctgggctcaagcaattctcctgcctcagcctcccaaagtattaggattacagatgtgagccaccatacctggcctatttttcttattcttagttgatctaacacataacagtttgttcaaaataataatagcaactgcaccttcaattatgtacataagatatatacataagatttataactgaatacatatataaatatatgcttgtgacaaatatacttatatattcacacttacatatgcttacatataaatgaaatgaatgacagcaatgacacaaggaataaaaagaggattttcggttattttgttattataatgtactcacactacccatgaggctgtatattgttatttgaaagtgggcttgggttagttctaaatgtatattgcaaattctaggtcaatgactgaaaaaaggtaggagaagtataactgatacgccaagaaaggaaagaagatagaatcatagaaatgctcaattaagataaaaaatttaccaggtgtggtggctcatgtttgtaatcccagcacttttggaggctgaggtgggcagatcacctgaggtcaggagttcgagaccagcctggccagcatggtgaaaccccttctctactaaatatacaaaaattagctaggcatggtggcaggtgcctgtaatactagctactagggaggctgaagcaggagaatcgcttgaacctgggaggtggaggttgcagtgagctgagactgcactactgcactccagcctgggcaacagagcaagacttcgtctcaaaaaaaaaaaaaatggtgaattgctaggaaaaaatgaacagagttttgtgacacattggacaatatcagttggtcaatatacaagtaattcgagtcccagaaaagggggcagaataaatatttgaagaaatgatggctaaagactgctcaaatttataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtgatgtgaagactttttagacaaacaaaagctgagagaatttttatccaagaggcctaccttactagaaatgctaaaagatgttcttaacacagaattaaggtgataccagatagagagacattagatacacaaaggaatgaaaagtgccagaaacagaaaatatttgattaaatataagagatactttccttcatttttgaatttctttaaaagattgttgactcttttataataatactttgtgagatttacaatatcatcacagaccaaataacatttcagtcagtgacagatcacatgtatgacagtggtcatgcttcactgaacaacaggttacattctgagaaatgtgtcattaggtgattttatcagtgtgcaaacatcatggagtgcacgtacgcaaacctagatggtacagcctactacacacttaggctatatggtagatcctattataacacagtagtttttgtatgtctatacatagaaaggataaagtaaaactacagtgcaaaagatcaaaagtggtagacctgtacaggacacttactgtgaacggagtttgtgagacggaaagttgctctggtgaatcagcgagtaagtggtgagtgaatgtgaaggtgacatggtttggatttgtgtctccacacaaatcttatgtccaattcccagtactggaagtggggcctggtgggaggtgattggaacatgggggaggtttctaatggtttagcaccatccgccggtgctgttctcatcatagtattcttaagaggtctggttgtttaaaagtgtgtggcacctgcccccacctctgttttcctcctgcctctgccatgtgaggtgggtgtttccccttctgccatgattgtaagtttcctgaggtctccccagaagcaaaagctgctatgcttcctctgcaggctgtggaactgtgagccaattcaacctcttttatttataaattatgaagtctcaggtatttctttacagcagtgtgagaatggactattcagaaggctgaggacattactgtacacttccatagattttataaatactgtaaacctaggctacactaaatttattaaaaaataaagtaattgcattacaatgttatgatggctacaacttcactaggtgatcagaattcttcagctccattttactcttatgggattatcattgcatatgcagtccattgttgactgaaactttatgtggtacatggctgtgccatatctttactgtatctaggacatcataaggatcctaaaggcattaataaaatactattttgaaaaaattatatgccaataaatttgataccctagatgaaaagaacaagtccactaaaatgacccatttatcaaaactgactcaggaagaagtgaaaatatggaattgactcgcatcaatgaaagagattgaattaataatctaaaaccttcccacaaagagtactgcaggcccaggtggcttcactaaagagtattaccagatgtttaaggaagaaattatgctgatcccatgagaatataggaaatagagatgggaggagagtttctcagttcatctttcaaggccgtatttactcaggctactctggtcactgtcccttacacgactggactttcgttcctctgctctcaagtgacctttgtgagcacaaatctcccaattactttacagcactcaaatgcttctttttcttttttttttctttgtttttgtgaggacagagtctcgctctgctgcccaggctagagtgcagtggtgtgatctcggctcactgccacctctgcctcccaggttcaagtaattctcctgccttagcctcctgagtagatgagattacaggggcatgcaaccacacccagctaatttttatatttttagtagagatggggtttcaccatgttggccaggctggtcttgaactcctgaccgcgtgatccacccaccttggcctccccaagtgctgagattacaggcatgagccaccgcgcccagctgaataccttcttttccgaactttgattgcactaaggagcccagttcctctccactgagcataaggatgccctctaatcattcacgtgaatcagtgtcccccaggatggattaaacgctctgtgtagatagatgcagggcttctccatgcatcctatagtcccacatacactgtgcatgtcccacccgggcttgcggccatactcacacatcaggaagcactactgcttgaaaatggtgacttttctccaactaaactccaggtgccacatgccagcaccagcctcttcgtgtcccttggcgcttccccaggcactgtctctcccctcactccgtccgttctcattttgagagatgatgtagttttcctctgggtcacaccatgaccccgtgggtggtggaagcagccctgggccctgcaaccaccctcgtgtttggccccggtagatcccccaggcccctgaggggaccagcatacctgctcacctgggccagtccccagtgacacctgtcatttgccacaattgttagtagttccccttttcattctcaaaatcccctgtttgaatgataaatgttacagtcaccctacagattcctgggaggaggaattaaaaggtcaggatggtcattatgggttaaattgtgcccccctacaaaatatgtgtgttgatctcctaacccacagtacctcagaatatgaccttatttggaaataggtgtaggtataatgagttaggattaggtcatactggagtaggtagggtgggccccgatccaatatggctgatatcctataagaagaacgccgggctgggtgtggtggctcactcctgtaatcccagcaatttcggaggttaaggcaagtgaatcacttaaggccagtagttggggactggcctgggcaacatgttgaaaccccatctctagtaaaaaaaccacaaaaattagctgggcatggtggtgcacacctgtggtcccagctactcaggaggctgagatgggagaatcgcttggacctgggaggtggaggttgcagtgagccgagatcaagctactgcatgcactccagcctgggtgacagagcaagactgtctcaaaaaaacccaaaaaagttagagacaccacccccgccttccacgcacatacaacacacatacatacagggagaacatgatgtggacatcaagacagaaatccgggtgatgtgtccctaagccaggaaacaccaaagtatgccagcaaaccaggagaagccaggacagaaacaagaaacagattctcccgcacaatcctgagaaggaattagctttgctgtcatctttctcttaggctattcacttccagagcgattacacaaaacgtatttcttgctctaagcaacccggctcatggtactttgttacagcagccctcaaaaacgaaacacaatcgttatagcaggagtggccccaagagatctaagtgtgccttcataccaatgaagaagcggaggcccagagaggggaagcggttgcacaaggtcccccagcttttagtgcagagctgagactgaaacccaggtctctgactcactgacagatgttttctgcttcgccagactgacattcagcccacaggagcggtcagctgcctcaggcggcctttctgaccctccttcccagagaaagtccttccataagcggagatttatctcccctgagtggatgttttgagtttggagagttatggctgtggtctgcgggtctggaggctgagccagtgagggaccaggacctgggaatgaacagtgtttaaggaggagaggagcaggttcttgaactgggtgagagacaagtgcacatcgtaactctctcactctccttcctgcctggagtcagggtacctctcacctttgcaccagacccccccaaaccacagccacattctgctgtggggccatagatcacattcttgctaggttgctaggatgacagttacccagtacagatttccgcacacttattcagaaagtatttgctgaatgaactgctgaatgaatggttgtcagaaataatttgagctgcttcggggcagggaacatgacatccacctccgcagtgcttgggccctgctgcagggctgggcacataacaagtgctcattctgtctcacttccatgttcctggtttcacccagggacacccattttttcaggccaccgagatgccaaacctcattttcatacctgatgcagtgccttgcatatttgagcaggctgtgccttctacctgggtagtctatcctcctcatttccaatcctgaggttctaggccctcactagatgcagctgtgaaacaggctttattgccttagggctagaaagcagaaagaatgcaaccgagggcaggggtttctatccattcacaagtgcctgtaacaagtgtttgacacatcatggatttttctgtttctttcttttttttttgagatggtgtctcactctgtcgcccaggctggagtgcagtatgcagtggcgtgatcatcgttcactgcagccttgaactcttcggctcaagcaatcctctttcagcttcctgagtggctaggaccacaggtacatgctagcatgcctggctaattttttaatgtttttatagagatggagtctcaccatttgtccaggctggtctcaatctcctggctcaattgatcctcctgccttagcctcccaaagcattgggattacaggtgtgagtcactgcaactggctgataatggactcttgataaatattgaatgaatcaacttttcctccatttctcttgtaagatttaccttcctaaactgcaactctgatcaagtcagttgtggctccaaaactttcagttattcttcacaaataatttatctacataatttggtcccaacttagataaccttcctcctgaatttggtgtttatcactctcacgctattttatatacgtttttgtactatttctacatagtatgtattcataactaggtatcatagtaataatagcaacattttgcatttttcaaattttatttaaatggtatcacatatatgtatgcatgaatcactctccagattttaagaactgaactttgcatgatttatgcatgttgataagtgcacggatagagtccatggataagtgtgtgttagattttgcattttcactatatactctattatatgcatagccataattataaatgataagtactcctgttggtggattaatagtttgcttctattttccaaagaaatctaaaaagcatctctgagctctgttcttcttttcaacccttttctgatcttttcaataaaagcccagaaactgaactatgagagaaggcagaaatctcctctgagggtgagaggagaagataggcattgaatgcttatacataaatgtatttttgccttatccatcgacaatgcttactgaaggcctgactaatgatgtgcctgggccccatgcatgaagttttcttagactctgcccttatggagcttctcatccagtgggaaagattggcatggaggaagggcagaagtaggtgatattctagaaggaattaggaagtactgtcaaccctccatattcatggcttttgcatccatggattccaccaaccgaggactgaaatatttgggaaagaacatttcacagttgcaaaaggcaaaacttgaatttttgttgcatgctgagaagtatgtggatttcatgcacactaaatgatgtgtaggctttgtattaggtatttttacagtttacaggaggatgtgcctaggttgcaggccatttgatatccaaaacttgaggcttgagcatccatggatttgggtaatcttggggttcttgaaccaatcccccatggattctgagggacaactgcactcaggtttggaaaggtgctctgccatccagtcctagcagtactacaccagggtgcaaatgcgttccctccgaagacctgcctgcagacggactgcaagctgggacatcagggattaaccacagccaatggagtcttgtgcaatttggttagcccctaaggaggagaggtagagcagcatgtgggatcctgctcaggtgttaaggagtatttaaaagcagtgagtcctcagggactggctggggccaccttctgatcaagagagctgtgtatgctgaaccccacaaggacaagaacaagacctggagaatgagcactgcagaggcagcaggggcacttgaggcagcacactggagcactgggacagttatggcaggcccagctgactttgtgggaagggatagcattctgctgcaagcagtcttaaagggtggcccctccatcacagggaggcctttcctggttactttcaagagaaccattctctcagtccagtatctgacaaactaaatgtagagacattcttcataataataaaccaaccacttgcaagatctcattctgagggctttatttgtattaactcttttagttttcacaacaacccctgggaggtggagtgggacggtggtgccgatgagaactgagaggttaaggaacttgccaaagtgttcacagcaaggacagggaatagctgggatttaaacttgatctctcagtgcttgggtctgtgagggacagtgtgtccagtggcttagggcatggtctctagggtcagatagtaaaccttagccctactttgttataaagttaaacatgcatccattcagtgccccagcaatttcactcccgagtgaaatgaaataacatgtccaaaaaatacttattcatataagcctttttcataatagccccaaattggaaacaaccaagtgttcctaaacagggggatggataaacatattatattatatttgtatatatagtacattcatagtatagtagattcatacaaatcctacgcaggaataaaaaacgaattagctgctgatagacacaacagcatggttgaatctcaaacatattatgctaagtgaatgaagacattcactaaaaagtactttatgattccgtttttataaaatccaaatctagacaaaataccctatagtgaaagatctcagatagtggttgctgatggtggtggaaatattctgtatcttgatttgggtggtgattacaagagcgtcagcaattatcaaaacccatcgaactgatgacttgagacggtgtgcatcttattgtgtgctaattatacctcaatcgaaaggaaaatcttggcttttccacttaatggctgcgtgatctggtttttgagttactttaccccttaagcctaagtttcttcatctgtgaaatgaaggacttcgccaactcttccaatactaatgtgttgtgatttcatatcttttcttaattatctagaagaaaataagagcatgtgtaactgatcttgggatggagagaactttataagcatgagatcatgggaggaatcacaaaggtaactcttgttagatttaaccatgtaaaacaaagaaaagtccccaaaccagctatatttacaaaatccctgtataatacaagttaaaagcaaaatgacacccactgctaaatttgactggcctttaaaaataaaaaattgtaaaaaattgtaaaaagtaaaatgaaaacaggcaaaaatatttgcaatgagcatgacaaataagcagctcctaattatatccagtcaataaaaaatactaacataccaacttaaaaattatcaaagaaaatgaacaagcagttcttaaaagaagaaatccaaacggtcaacaaattaagaattggtcaatagaaccattaatcaaagaaataggagtcaaaaaaaatgaaataccatttcctcctgctactctgaaaagcatttaaaatactgacttgtttttgcaatgtgtctgcactgacagatgcagatagaactgtaaattggtcaatttctggaaactatttggcaataaaaattttcattaaaatatttatatcatttgtcccagtaattctacttttaagtgtcttctaaaggaagtaatcagaaatgtgatcaaagacttctgtttaaggctcttcatcccagcaccatatatcagagtgaaaaattataaacagcccgaatatccaaaaaatattgttcagctataaataatgtgttttggaagcattcttaatggcaataaaatatttatcataaaatgttaagagaacaaagcagagtaataaaacacttgtatcatcaactccattttatttaaaaatgcagtttatatttatatgtctacaaagaaaggcctggaaaggaatacaccaaaatgttagtgtggttatcttggggagaagagagattttaggtgataatagttctcttcttcaaacttttttttaaaaactattttaaccattttaattgtacaattcggtggcagtaaatacattcacagtgttgtataaccatgccattatctgtttccagaaacttttcatgattctaaacaaaagctttgtgctcattagacaataattttccacctgcctttcttcctagcctgtcatattatcttttttttctaatttctttttttatacttcaagttctagggtacatgtgcacaacgtgcaggtttgatacatagatatacatgtgccatgttggtttgctgcacccatcaactcatcatttccattaggtatttctcctaatgttatccctcccccagccccccaccccccgacaggccctggtgtgtgatgttctccgccctgtgtccaagtgatctcattgttcaattcccacctatgagtgagaacatgcggtgtttggttttctgtccttgtgatagtttgctgagaatgatggtttccagcttcatccatgtccctgcaaaggacaggaactcatccttttttatggctgcatagtattctgtggtgtatatgtgccacattttcttaatccattctatcactgatggacatttgggttggttccaagtctttgctattatgaatagtgccgcaatagacatatgtgtgcatctgtctttatagtagcatgatttataatcctttgggtatatatgcggtaatgggattggaggggcaaatagtaattctagttctagatccttgaggaattgctacactgtcttccacaatgattgaactagtttacactcccaccaacagtgtaaaagtgttcccatttctccacatcctctccagcatctgttgtttcctgactttttagtgattgccattccaactggtgtgagatggtatctcattgtggttttgatttgcatttctctgatgaccattaatgatgagcattttgtcatttgtctgttggctgcatagatgtcttcttttgagaagtgtctgttcatatgctttgcccactttttgatggggttgtttgtttttttcttgtaaatttgtttgagttctttgtagattctggatattagccctttgtcagatgggtagattgcaaaaattttttcccattctgtgggttgcctgttcactctgatggtagtttcttttgctgtgcagaagctctttagtttaattagatcccatttgtcaattttggctttgtagccattgcttttggtgttttagacatgaagtccttgcccatgcctatgtccagaatggtattgcctaggttttcttctagggtttttatggttttaggtctaacatttaagtctttaatctatcttgaattaatttttgaataaggtgtaaggaagggatccagtttcagctttctacatatggctagccagttttcccagcaccattgattaaatagggaatcctttccccatttcttgtttttgtcaggtttgtcaaagatcggatggttgtaaatgtgtggtgttatttctgagggctctgttctgttccattggtctatatatctgttttggtaccagtaccatgctgttttggttactgtagccttgtagtatagtttgaagtcaggtagcatgatgcctccagcttttttcttttttcttagaattgtcttggcaatacgggctcttttttggttccatatgaactttaaagtagttttttccagttctgtgaagaaagtcattggtagcttgatggggatggcattgaatctataaattattttgggcagtatggccattttcatattgattcttcctatccatgagcatggaatgttcttccctttgtttgtgtcctgttttatttcattgagcagtggtttgtagctctccttgaagaggtccttcacatcccttgtaagttggattcctaggtattttattctctttgcagctattgtgaatgtgagttcactcatgatttggctctctgtttgtctgttattggtgtataggaatgcttgtgatttttgcacattgattttgtatcctgagactttgctgaagttgcttatcagcttaaggagattttgggctgagatgatggagttttgtaaatatacaatcctgtcatctgcaaacagagacaatttgacttcctcatttcctaattgaataccctttatttctttctcttgcctgattgccctggccagaacttccaacactatgttgaataggagtggtgagagagggcatccttgtcttgtgcctgttttcaaatggaaggcttccagtttttgccctttcattataatattcgctgtgggtttgtcataaatagctcttattattttgagatacgttccatcaatacctagtttattgagagtttttagcatgtagggctgttgaattttgtcaaaggccttttctgtatctattgagataatcatgtggtttttgtcattggttctgtttatgtgatggattatgtttattgatttgcatatgttgaaccagccttgcatcccagggatgaagctgacttgatcgtggtggataagctcttttatgtgctgctgaattcagtttgccagtattttactgaggattttctcagcaatgttcatcaggaatattggtctaaaattctctttttttgttgtgtctctgccaggctttggtatcaggatgatgttggcctcataaaatgagttagggaggattccctctttttctactgattggaatagtttcagaaggaatggtgccagctcccctctgtacctctggtagaattctgctgtgaatccacctggtcctggactgtttttggttggtagactattaattattgcctcaatttcagaacctgctattggtctattcagagattcagcttcttcctggtttagtcttgggagggtgtatgtgtccaggaatttatccatttcttctagattttctagtttatttacatagaggtgtttatagtattctctgatggtagtttgtatttctgtgggatcattttttattgagtgtatttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggtggctatatgagagattcagtttctctgcatcctctccaacacttagtatatatttctaaattttaaccattccagtagttctctctctcttggtgctacctcttcatggctttagtttgcactttttttctttaaaagttcccgggatacatgtgcagaatgtgcaggtttgttacatagttatacatgtgccatggtggtttgctgcacccatcaacctgtcatctaggttttaagccccacatgcactaggtatttctcctaatgctatccctccccttgccccccatcccccgacaggcccgggggggtgatgttcccctccctgtgtccatgtgttttcattgttcaactcccacttatgagtgagaacatgcagtgtgtggttttctgctcctgtgttagcttgctgagaatgatggcttccagcttcatccatgtccctgcaaaggacatgaactcattcttttttatggctgcatagtattccatggtgtatatgtaccacattttctttatccagtttattattgatgggcatttgggttggttccatgtgtttgctattgtaaatagtgctgcaataaacataagtgtgcatgtgtctttataatagaatgatttatattcatttggacatatacccagtaatgggattgcagggtcaaatggtatttctggttctagatcattgaggaatcactacactgtctgtcacaatggttgaactaatttacattcctaccaacagtgtaaaagtgtccctatttctccacagcctcaccagcatcttgactggtgacagcctcaccagtttcttgactttttaatgatgtgagatggtatctcattgtggttttgatttgcatttctgtaatgaccagtgatgagctttttttcatatgtttgtgggccgcataaatgtcttcctttgagaagtgtcttttcatatgttttgcccagtttttgatggggttttttttcttgtaaatttgtttaagttccttgtagattctggatattagacctttgtcaggtgggtagattgcaaaaatttcctcccattctgtaggttatctgtttactctgatgctagtttcttttgctgtgcagaagatctttagtttaatcagatcccatttgtcaattttggcttttattgcaattgcttttggtgttttcatcatgaagtctttgccctatgtcctgaatggcattgcctaggtttaatttgcactttcctaatggctgatgaagttccgtctcttttcatgtgcctattgtcatccatgtatccactttagtgacatgtctgtccaaggcttttgcacagtttctaatgccttcttaggtagttattcatatattaaaattcagatagttatttacatattttggaattcagatagttatttacacattctggatacgcaccttttttcaggtatgcgatttgcaaatattttgtactagtttgtggcttgtctatttattttcttgacttctaaggtttttgatacaattatctacaatatgccgaagaatctggcattttaaccacgttgtgtaggccaactctttgtcatggtttctgtcaaccaaccaagtaaactgttagtgccactaccagccccttgagataactcactgattccagcatctctgcctagtaggcccatatcaatacatttggcttgctgcaactttattttcctcccagtggtcccacaccagtaggagccattccacacatgttctccatgttcgtgttcacataaattggtaaaattatgcaattattttggtgtgtattattatacttcctcctggattgcactttatactttgtcctctggggcctgttggactggagtctggctgtagttcttgtagcaaagagaggtgacaaaagtagggctgaagaggcacaatcccttccttgcaaagactccacattggggcaaggcatcatagattcttcagccaagaggacactaaccgcctctttccgggcactggcagggagattggcaaaattcacaggttggaatctatccctgtgtctctttcccaattttcagggtcccactccttcagaatctgtgccgtaactacattagagaccctgtaaagttgagaattcactttgtcttacaattcagctaccctagaactagactttaggttaagttctggttttcagaaatcccaacctggtgactacaggagaaaggtttattttagggccagaatagaagctttcaagttccttttaggaagcttggggattttaagccctggtctcattattttgtttctccaggttctccagtacatttagaaacaatcaatcagccctgctataattttaatttttaccaaaatgttaatggtggctggatgtggcttcccaaagtgctgtaattgcagcacttggagttacaagggaagccaaggcaggaggattgcttgaggccaggagttcaagaccagactaggcaacatagcgagacctcgtctctcaaaaataaaaatagccagtcgtggtggtgcacacctgtagtcccacccactggggaggctgaggtgggaagattgcttgagcctaggtgtttgaggtcacagtgagctatgatcgcttcactgtactccagcctgggctgcactccagcctggactaagcctctataaataaataaataaacaaataaataaataaaataaacatacctggcctaggagttgaatatgctgaaggggaggatctggcaggatctggggttgctgagggcctggttgtgtccccaccccagcaaggtgaggcacaggtaagtggtgctgtgcatgagatgttacagcatgtggtacattggcctgacctcctgagggtccaaagaatctgacttctgattcaaaatatgatgtacgatgcttctggtcagccacactaacctgggacgatgcaaggggatttgagaaaccaagttcactttagcgaagttgatgccacaaaattccacttatcacaaatcttgggaaaacattcttctcaaggctccatggttcttttacaaactgacaccatggccaggcacagtggctcacgcctgtaatcccagccctttgggaggccgaggcagatgcatcacctgaggtcaggagttcaagaccagcctggccaacatgatgaaaccctgtctctactaaaaacacaaaaaaattagctgggtgtggtggcgggcacctgtaatcccagctactcaggaggctgaggcaggagaatcacttgaacctgggagacagaggttgcagtgagctgagatcacgccattgcactccagcctgggtgacaagagtgaaactctgtcaaacaaacaaacaaacaaacctgcatgagacacagaggatcccaagaaacatcaccactgtgtctctgagactaaaaccatgttgttttgccctgccctgatgctgacatttgggtatcaagcaataagatgtcactcctgttggagagagagctgtgggtccagggcttgaaatggtcacaggcctgttctcttatatgtttttccacttctacgtccttgtagtacttcattctatgattcttattgcccatgcaagaatccctgatattgtttaaacttttaaaagtgttttaacacatattttctcattaagttcttacagaaatgcaagccaagagagatttgactcatctaagtcatctccaaaataggtgaggtagcatgagagtctcaagtcagggattcaggatcacttttacctccttagccctgacaagaaagttggcttgcatagaaagttcttgtc

SEQ ID NO: 12171 - DNA, 85369 bp, Human
  misc_feature (1)...(85369): n = A,T,C or G
gttcatagatgtccttggcacaatgcctggcacatggtaagtgatacataaatagttgctccccatattaattaatgttcattattcattgacatctataaagatgacaccctaattatgacattagcttaaatactatactcaatgatcataaatgccaaaaccaggggctagtgcttgggtcttctgacctcagacccagctcatctgccaaacgccccactgttccccagccacagccccatcctcccccttctcacccagtggaccccgcagcggggtgaaaggggccccagcagtggttctgtgcctccttgctgtgtgcctgtggggcccagccctgcccccctccattccccagcacctccatggcactctgtggaacctccactggcaggtcaggaccctgcactgctggctagctccggggagcctgttcatgggcccctccctaaggcctgggcagctttcaagaacatttctctgggttgggtcagctcctccctcgggctcctggcacacattctgaggaatagctggagacaaaaatcgaacagtgcatgcaagcctacatctgcatctatgtctgaactggggcaggtggcagacaggtggctctctctgagctcctagacctacactgggcacagctgaggcagctggggactcagatgtccaccccgagtggagcccagctggactctgcttgctgcatggctgctactggtccactcgccactgtgtcccaccccatcttcctccaaggacactcacagccctcagcctccctgttggtccagccttggtaagccttctgaagctttctgcacaggagctgtgtggcccagattctccatcacctccatcccctgcactccccacacatcccagcccctctgggcagaacaacaaatgccaaggctgccacttccctcccggggaacccctctctgcatcataggttggtggagagcttgcactttgaggtaggcagggccttgcccacgttggctgactgtggaacctggggcaaactgcttaaatcctctaagccgcatcatatgcaccagaatctccagggccaggaacaaagagagcagagttccacccagaatagcaacaactaccacttatttatatgaactatcattatctccattttgcagatgagggaacaaacaagagagaaaggttaagtaacttgcccaaagtcacacaattaaataagtgtcagaaccaactttgaatctaggcagcaaagctcttgcgagtcgcacatcctcccctctggctccatgagaactcactggggtgagcacagtgtgatccaactaattgcctcccacatcccagcagggaccagaaactgagagcccgcaggagaggaggcagagcccctgggcaccggctcagtcccaaggcctcctggtcccggggttctttgatcagccctgccagatgtagcatctgctgctccaaaggtcaggcaggccccgcttatgaggtcccgccgatggacgtgggagccactaataagggcatcatgacagatgaaggccagcgtgccagcttctcaggagatgatgctcacaccagcagcacagtgaaggcctgtggagggacagcgggcccctgctgggactaggtgttctgggtggttcctgtctccacccctcccactccttagaaagttctgtcctggccccttccttcctttcccctctgtcctttctccctgtctgaccactgaccttggagaccaatgaccctgactctagctgcatgattcctttctccctctaaagcccaggagaactaaagaagcagatttgcattcccctcctgtctccttcctttgcccatttggcagatgaagttactgagacccaaacatcatagaaccacaggctcccacagaatgccactgttagggggaaatctagaaccacgatgttgtccaggggttcacaacaggcagcagcactgtcccctagaagcaggtagcaaagaccagggctgttgtggtggtaacggagcctaggtatgctactgacatttaacacacacggcctgggagtgctaaatgtccgacatggcagaggacagttctgcacagtgaagaattgtgccacccaacacagaaggcactgccaacagtgccttctccccaattatagatgaagaactgaaatccaatgacgaaaagtgatccggtcaaagttacggtggcagaaacttccagttgccttccaaattccctttttcttgtcttccttagaaaaagaaccccgcaaccagcccagtgctacccagctcagaggttccatttcccaacttccctggcagctccatgtgagtggtatgcaaggtccagtccatgagattaaggaggtttattctgcaggactgccaagaagcctccttaaatgtgaaggtatgcctttctccagcctttctcctcccacacctaaaatgcaggtgcagcttgagtagcgtcttgggccataaggccctgcactaaggatgaaggagcagcaaggtggctggtgtcagcacaaagtttatctccaccccaagagataaacccagctacaaagctgcttaagctcagctacaaagctgctttgtggactttctctaccagggctatgaccagtgttctacttacttaagggcaaaaacacctcattatcatcaaagaacccataggatgagtcacttaaggaatgctctgccacatgctttttcttctctcctgagacttcttttaaaagtatgataagtcttctcactctatcttctatgtctcttacatttgcatctatatttttcatctttaatctctctgtgctgcattccagatagtttcttaagacctaacttctagttcactaattctcttttcagctgtatctaaactgctgttaaccccattctttgagattctaatttttttttcagagctacagttgatcacagcctggtcacagcctgggtagcactgagctggaggtagagttatttttctaagaataaaagaaacaatggacaacagaaataggtcccaaagtacataaaatatgggtattatcaggtagaaactaaaaccaactaggcttaatgtatttaaagaaataaaagtcttctcacacatgtctgggttttttttaagtctaagttttaaaattttggcagggaataagtaactataaaaagtgacatagcaagtctgaaaaagaaccaaatagaaattctagctctgaaaaaaaaaaagttaggatctcaaagaatagggttaacagcagtttatatacagctgaaaagagaattagtgaactagaaattaggtcttaagaaattatctagaatgcagcacagagagattaagaatgaaaaatatagatgcaattataagagacctagaagacagagttagaagacttagcacacttttaagagaagtctcaggagagaagaaaaaacatgcagcagagcattccttactctatcctatgggttccttgatgatagtgaggtgtttttttccttaagtaagtagaacactggtcacagccctggtagagaaagcctaaacttttccttctttgtcaaatccctctcctaattttcaacctgcaaaagtctgggcagaggaagacctcattagcctctggctgaagcctgagatggcagagttttgtaagacacaggaaggggcatgggggttggtactctgttaccttgggcagtagagaggagtatatgcaaggaccgggataggaaaccagatgggaaaggtgcaaagaggtatctatgggaggggtctgaggaagcctgggagaacagaattcagatctaagagagatcctaagagcctctgaaggtttcaagtgcacttaactgtttctccccagagtgtctgatttcctgtggcccagtcaccctgaccctcagttggaatcccaccacccttccaggtggttccagtggaatgaaactaaagcagctctagactgcatctccctcactcatggcctcatctggtccacagagaacatgcacacctcctttgcttcaccatccatagaagaggagctggctcccaacacaggttttttttcacttgctgtctttgctacaccttttcaggctgaaagccaaagcccttcccattagactccttgggttcatgtcatgatccttgagcctcccaaactccaagagacacaccctaggctcctccaaggggtttccttgtagcccatcttatcaggcttgaggggaggggtaacctccctccctcacaggttggcactaaggggttgggactcacagcatagccttctacaaagaaattctctcaaatttctcccaaatctccagatcctgaccccgttttgccatctccccagttctcaaccacagtgtgctgcccacagctccttctgcatgtggcacctttgtcttcgtgcctcagtcaatactggaagagaaagagtcctgacttaatatctcattctatgtgtcactgcaagtaaatagagaaaaaaatcaagaaagagatggatactgcacagtgctaacaataataatcaccagaagttgagattattggtgagttttattttactttatgtagttttcagattttctaaaatgcattttataagcagaaaaattaaattttatctttaaaaaagatgtaggctgagcatagcactttgggatgccaaggcaggaggatcgcttgaggccaggagtttaagaccagcctggacaacacaatgagacccccgtctccacaaaagtaaataaataaattatctgggcatgatggtgtgtgcctgtagtcccagctatttgggaggctgaggtagggggatcacttgagcccaggagttcaaggttgcagtgagctacatcacaccactgcactccagcctgggcaacagaataagatcctgtctcaaaaaaaaaaaaaaatgtggttgccgaagcaaacattattggttacccacccaacagccatttcctgactccatcctcactaaatagcccttgcaagaatttttttcatgtattaggttgtcagaacttcagagaaggctggactctccttgtcccaggactgatacttggtcactcatggtaacgtctttccccttgccagcaactggcttaggaaggagcatgtgacttgattctgtccgatgagacatgacaggaagtcagctggggagacttctaggaaatgctttcttgctcttaaaaaaagacacagaggataggtaaactgtggccaatcaatgcaatcttgttattcaacaagaaaaaaaaaacgagctaccaagtcatgaaaagacatagaggaagcttaaatgtgtattactaagtaaaataagccagtctgaaaaggctatgtactatatgacattctggaaaaggaaaaatggtgaagacagtaaaaagatcagtgttgtcaggggttagtggagagagaggggtgaataggtggagcacagaggatttttaagacaatgaaactattctgtatgatactataatggtggatgcgtgtcattagacatttatccaaacccatagaatgtacaacaccaagagcaaaccgtaatgaaaaccatggactttgggagatgatggtgtgcccatgtaagctcatcagttgtaacacacgtaccactctggtgagcggtatggataatgggggaggctgtgcatgttgggagggcagcgggtatatggggaatctctctaccttcctctcaatgttgctgtgaaccgaaaactgctctaaaaaaattaagcctattaaaaataaaaagttaaaaagggacatgagaaaagaaacagttctcttctgcccattaacaaggtcctgtgagatgggatgcagcatccagggacgcactgagtatggaaagaacacctggattgctggcagggggcgctgagagcagggcgctgggagtgggccctcccaggtgcaggcaatatgggagtgtgctggtagacaattggaaacatcagtaaaacaaaccaaggggccatctacatgctattctcaccaagcaattcctttaaggtatatcagtgataaaatacccttccctaaaaaatccttcattggtctaagttctaaacaagtgacgtggttatactgctgggctttcatacaagttaacttccaattagcacactttcgtgatttattctttcataagcatcatattctacatgacagttaatttagaaagctctcggttattcgggcagccttagacacacgctgacttagctatgcttgtgatatatttttaattagtaaacttcatttttagagcagttttagatttatagaaaaattgagtgcgggtagtttcccttaatattaacatcttacactacagtggtacatttgttacaattggtgaaccaatactgatacactgttgttaatgaaaatccatagtttacattagagttcactaatgaccagcaaaagctttgtacattctatgggttttgaccatgtaatgatattactcgtcattatagtatcacacagaatagtttcactgtcttaaaaatcgtctgccatccacctattcatccctccctcccccagctcctggcaaccactgatctttttgctgtctccatagctttgccttttccagaatgtcatgcactgtagttggaaccacacagcatacggccttttcagatgggcttttccccttagtaccatgcatctgaggttcgtcagtatcttttcatagtttgacagtgtatcttatctcttttgctcactgaataacactccattgcatggatgtaccacaatttaccatttacttattgaagggcaccttgcttgtttcccacctgtgtatttctagggtaagttcctaacagttgagaatcattcaagctgggccgggcatggtggctcacgcctgtaatctgagcactatgggaggctgaggtgagtggatcacctgaagtcaagagttcgagaccagcctggccaacatggtgaaaccccatctctactaaaaataccaaaaaaattagccaggcatggtctacagactacagactacacctgtagtcccagctactcagggagggtgaggcaggagaatcgcttgaacctgggaggcggaggttgcattgagcggagatcgcaccactgcactccagcctaggtgacggagggagactccatctcaaaaaaaaaaaaaagaatcattccagctggcttcaagtgcagtttgtgtccccaaatcatacagtactacacattcctgcatttaaagggtattttatttatttagttcattttttattatttttattttattttattttattcaaaataaaaaattatagtctattgagtatgaaaaaaaacagaatttgagtttcttcaattctgtcattctatggcaccactctatggaggtttgttttgtgtttaaaatggataaccatgatgttaagtatgaatgcttttgtctggtaaatacaacatttgtttatacacaaaacattttactgaatttgaacagtatgtttaaagttgacattttctttgtgtttatttgtttcaaaacgaaagaacaagttgtttaaaaataattattactgattattacatggttattagtgaaaataatttttgtcatactgataattctaaaatagcctccaggattcctaccctgactatgcatggcctgtatgatctcttcttccttagtctgggtgggaccagcaaatatggaatgttataatcagttgactttaagttaatagaaagtgagatgatcctgggtaggcctgacctaatcaggtgagcctttttaaagatggtgacacctcagagagagctctccagctggctttgaagacacagtcttcaagaagaagatgcaggccttggtgcagtggctcacgcctgtgatcccagcactgtgggaggccaaggtgggaggatcacttgagcccaggagttcgagaacagcctgggcaacatagcaagacctcatctcttaaaaaaaaaaaaaagaagaagaagaagaagaggaagaagaaataaagaaaaagagagaggaaggaaggaaagaaggaaggaaggaaggaaaggaagagaggaaggaaggatcttaaagaggttgggctgggcgtggtggctcacacctataatcccagcactttgggaggccaaggcaggaggattgcttgagctcaggatttcgagacttcatctttatatgaaataaaagaaagggaaggaaggatgggaggaagaaagggaagaaggaagagaggaagaaaggggaagaaggaagggagggagggaggaagggaggcaagaagcagttctacatctgcaaggaaattaattctgccaaaacctaggaagtttggaagaagctcccaagtctcagatgaccctaccctggctgacatgttgggttttgtttcgtttgagatggaatctcactctgttacccaggttggagtgcagtggtgcgatttcatctcactgcaacctctgcctcctgggtttaagcaattctcctgcctgtctcccaagtagctgggactaaaggtgcatgccaccacacctggctaacttttgtatttttagtacagatgaggtttcaccatgttggccaggctggtctcaaactcctgacctcaagtgatccacccaccttggccttccaaactgttgggattacaggcgtgagccaccgtgcctggacctggctgacactttgactgcagctttgtgagaccctgagcaaaggacccaggtaacccaggcctggactcccaacccacagagactgtgcgctaataaatgtgcgttgctttaaatgctaaagtaacacacatttgtaatttgtttcagcagcaataaaaaacaaatgtatgtgagcgcaacacgtcagctggcaagaggtagcgctgcaagaggatgaacacaccacagtcctcgcactatgtaggaatctttattactgctttgcagatgacaaaacagagaatttaagcatcttagccaaggtcacacaggtgataagtgactgagccaggccacaagccaggcctgtgtgactccaggtgctccagtgaattagttccatggataatcctgcaggtgactagtggactaaacgtcctccctgctgtcatggccaggtccttatgatgacctgtggtgatttctggtgacaataggagcccatggctgagaggggcatagtggaggaggcagttcccacccacagactcacggacttgctccacctcaattccacctggccatctgggtgagcagtgtagacatgggtccccagctgctgcctctcccagcctcctgtttatttcctttaccgcatgtttgccattactccattcatacatcttgtctttgcccagcttccctttagaatgtcagccctgtgaaaggccacatctgccgtgcactcccagggctaccacagtgcctggcatagagttggcactgtatgaaattagctggacagactatggagtgcagcaatgacttctttgcctccctggattgcaagggaggcgggggccgagatctgagatctcaggcccaggaaaccccatcccttcccttccttgaacatggccccatctcctgggctctagagagctgagactggtcttttcggaggagctctaggatgcagcccccacccttgccagctctgctccaaatcaccaagtcacccactgggctaaggggcttccaggacaagaggaccccctgccaggcagccacctcacctggagcctccctggttcccagacacagcacctgctccctctgctggcggaagcagacaagtgcatgcagatccctccttgccggagacatgggagacactgggaaggcaggaggggagggctccggggagctcccagcctggaccccctgagcctaggaagagtcagggcggggaggttagggaaagtccgtagcctggccgagtctggccctcaggcgtgggggcctggcctcagccctacctacagggctggcaaagcagcaccatcacttggattccctgtctttgctgaacacaacccggatgggagtcctcagaccaggaaggggggacattgcttccaccatgagaacacactactcccagggagggcagccttctctcggcccagcctcagggctacctagccccatcccatgataataacagccagtgctgcatacctgctgcgtacacacctcatctaatccttgtagttgtcctgccccatggacatgattgctcctaccatacagatgagaaaactgaggcacgaagcaaagtcagaacccaaacccaggtcagtgtggctctgaaagtccctacctttctcatgccctgtgcctcatacattacttttaatcctacaaccaaggaggtctccttaccgtagccagtcctgtgtggcttcaaagccaaggctggattgggtgtggctgaaactgggttgtatctggggtggggaatggcctggtgtggtgggaaaggccaggctctgggaccagacagcactgtggacaccccctggctggtggccttgggcaagatgcttcatccctttgaatcactatattctcacccatagaagaaacttcattcctaacttagaaagcttttgtgggaattagagataatgtgtgtccagttcccaccacagagcatctgggcatagaatagctgttaatgtttgtggtggctttaaaagaggtccacaaattctgatactcctcccttcccttgggtgtgaggtggaggtagtgacttgtctccaatgaacacagtaagcagaattcatggcgggcaatttcagagaccaagtaatgagaggcactgtgcttccccccgcctggcttccttaggtcacttgccctggggaagccagctcccatgtcgtgaggacactcaagctgcccatatggcctccagccaacagtcacacaagtggacttggggtcagatcctccagcccctcccaagtctcctggtggctgcagccctggccaatttttttttttttttttttttttttttttgcagaggcaggggagacagtctcactctgtcacccaggctgaagtgcagtggtgtaatcatggctcactgcagcctcgaactcccgggctcaagtgatcctcttgcctcagcctcctgagtagctaggatcccacacatgccatcatgcccagctaatttttttgttaattttttataaggacagagtttccctgtttacccaggctggtctcaaactcctgggttcaggagaccctcccagctcagcctcccaaagtgctgggatgacaggtgtaagccactgtgtctggcccctagacaatatcttgatggcaatctcgtgagagagaccctgagtcagaaccacccagctcagatgctcctgaattcctgagccactgaattatttattataattatttgttgcattgtgagataataaatgttgatcattttaagtacactttataatcagcatccttgggccagcagttgctttgaggctgaactgccccatctcctccacagctgtggtcacacagaatctgctctaacaagggtccaggccctatggacctggccgggaaagaagtaagaactcacatttactgagcacttgccatctgccaggaatcgagctaagcactttacatttatctttctagcaaaacttcccaaaaatgacaaggtaaacactattatcatgcccattgtacagatagagaaactgaggtgccagaggttgagggactcacccaagattacacaggggagaagcagacctgggatttgaatcaaatgccactactccagcacctgggtgcttaaccagcgtactgcatggccctccaaggtgcacagtggctcaagggccctgttacccctcctgtaccccagcagcacccccaccaccaccacccacttgctgtcctgggtgactaagacaggtgcagggacaaatcccgtccagcccactgtcccttagccaaggtggtgcctctgcccacacaccctctgcccctctccctgcccacaggtcagtccatgcctcacctacccagggccaggcattgagcacctttaaagtgtaggggcccttcgtgtcatctagtccaatcccccaaccccccattttttcagatgtagaaacagcagcccaaagaggtgcagtgacttatctaaggacacagagggggccggacgcggtggctcacacctgtaatcccagcactttaggaggccgaggagggtggatcatttgaaatcaggagttcaagaccagcctagccaacatggtgaaaccccatctctacaaaaaatacaaaaattagtctggcgtggtggtgggtgcctggaatcccagctactcaggaagttgaggcaggacaatcacttgaacccaggaggcagaggttgcagtgaactgagatcatgccacagcactccagcctgggcaacagagtgagattccatctaaaaaataaaataaataaaggcacagagggagctgagggagccctttagccagaacccaggtctcccgtctcgtctcaatccagcctgccccccctgcccttcccagcgcagtgaccgccccggtagccactgtgggctccaccctccctacccagacacttgggattggaacctgggccaaacttcccagcaatctccactggcccagcccctgagggagcctggaggaaggggcttatctccaactgtgttgtggtgttgtctcaccccacccccaccccaccctgccaggcagccttgattaatgggctggtgctatcttatctcccagctgcattggttagaaattaacgggggtggcagggcttaggaagaacacattctgccccctagatcaacccgagaactctgcaggagggtgggagcaggaggagagctccaagcggactgttcactcgctgccgtcctgctctcccatctgaaccggctgagccactgcaaaataggtaaagcacccaggacggtgcccgggacttaacaggggctcagtgcatggtagcgttgtttctgttgctgttgttagttccgggagtcctaggccagcacctgctgccccacaagattcctgaacagcccgtgcagcaatgaggaagtcaccaccccactccagcctcaggctccatctggaacgtaggcacgggcttggggcttagaaacgggactgtagatcttactttttttttttttttcattgaggcagagtctcactctgccacccaggctggagtgctgtggtgcaaccttggctcactgccacctccacctccccggtttaagtaattctcctgcctcagcctcctgattagctgggactacaggcgtgcgccaccacgcccggctaatttttgtgtttttagtagagacggggtttcgccatgttggccaggctggtcttgaactcctgacttcaagtgatccacccgccttggcctcccaaagtgctgggactacaggcatgagccactgttcctggcctgattttttttaatgtgattttactgagtagcctaagtgtgggcttagaggtctatccagctggtctatccaggcttcagcaaatccttcacacttggagcctcagcttctccatgtgtaaaagggacaaactaacctcacactgtcctccacacaggactgttaggatgcgataacttctggaaagccctttagggactattccacgtcacacgggaccgtgggctttgggatcccagaaggagtcagacaccaaactctcaccaagcggttgacgctgacgtgggtttctacacacaggaccaaccccaaaatccagctcagctctgggagagaaaggatgctaagtcacaggccctctcaaggctggggctgaaggaggaggaacaaatgtccctctctgcccaggacaaatgtccctctttgcccaggacagtcccaggctactccccttgcctgggtgtggtaactcctattgtcaagagaaccctttccactctccaaagcgtccccatttggacaaaaactgacatggtccctatgttgaaggaacaagttttctccttccagggacaatgaggctccatctaacctgagtgagtggcctgcatgtctgaagccaggcaattaactctgccagggctacgtgggggcccagactcagaaccccatggctgggcttggcccccacgggaagagcccacaggactcccacccacctcttccctggctttctcaagaagcctgtgcttgctgcatgagggaaaggaagataaaaaaaaaatgtgtgttgggggagaggggcaaaaaggatggagggaacaaggtgggggatgaactttcagacagatgagcagaataagggaagaatgggctgggcgtggtggctcacgcctgtaatcccagcactttaggacatggaggtgggggtatcccttgagcccaagagttcaagaccagcccgagcaacgtgatgaaaccctgtctctacaaaaactaaaaaaaattagccaggcgtagccgtgcacacctgtagtcccagctactcaggaggctgaggtgggaggatcacttgagcccaggacatagaggctgcagcgagccatgattgcaccactgcactccagcctgggtgaattaaatgaggggaggggacaaatggatgaaaggggagaatgagtgagtggaagaaagaaaggagggaaggatgtcaaaagggagggatgaagagatggacagatggacaaagggggcatgaagagagatacgtgagagtcttgccggccccagctcccatccctttcgcaaggcacaataaagcctggcagaggacttaatttccagaaggacagacagattgagtctttgggaccccaagaagccagtcttccctccctcattccaaagacattccaagaacggcccttccccttcgctctcttttgccccttcccaaagggcaaagggcagcacagccaaggaaaactctctgctgtcagcctcggttatcccagccctgtttactttgggtgggcaattaaccaagtctccttcccagatcaatgaatagtggggggcctatagcaggcaccaggagccccgaacggccaggttactcattgattaaacaatagggaattgatggaggctactccctcgtcctgctccaaggtgtcccatcggccaccccttcctgacccaaagaggcccccgtgtcccaggcagtccaagctcagaaaggccagcatgagatggagtagacagccgtgcctcgaggtgtgcaatgtgtgtgtatgtagctagggtccttgattggcctttactgggcagccccagaatcaggctgaatagactatgtagcctagcagtgaaggtcatggactcgtgaagggaccacaggttcctagagccgtctctttccaataaccagctatgtgacccggacggagcaagctattatacttcatcactcagtcccgctgtgtcacacagggatgatggtaggacagacctacaccaaagggctgctgtgaggacacagtgagttgacatccgcaacacacacagcccagtgcccagcctcatgaggccccagaacatgccagatgcatgtcggtcagtggccaagctttgggctcctttggggaacctgggatgcccatctcagtcttttcattctccggctccttctcctctcccatggggttctctctcaggtgccagcaggtacgtgggggccctgctccctcacttgcccagaaggataccaaaggttcctggttgtccaatacagtaggcagcagctgcttgtgattatttaaatttaaatgaattaaaattaactaaaatgaatattattccatcatcaaaaaggaatgtggtaatgacacatgccacaacacggatgaggctcggaaacataagtgaaagaagccaggtacagaaagtcccgtactgtaggcttccgcaggtatgaaatgtcagaacaggcagatgcctagaaggtatcacggtggctgccagcggctggggggaagggggaatagggaacgactgtttaatgtgcacagagcttctttcaagggtgacaagaaatattttagaactagatacaagtgacggttgcataacattatgaatgtactaaatgccaccggatgtttcactttatttaattatttttatgttgtgtgaatttcacctcactaaaacaaaattaaatttaaaattcagagggccaggcgagatagcttacacctgtaatcccagcacttcagaaagccaaggcaggcagatgccttgaggccaggagttggagactagcctgggcaatatagggaaaccccatctctacgaaaaataataataataataattacctgggcatgatggtgcgtacctgcagtcccagcaactgggaaggctaaggcaggaggattgcttgagcccaggagttcaaggttacagtgagccatgattgcaccactgcattccatcctaggcaacagaacaagaccttgtccctaaaaaaacctgtttttaattgaaaagtttaaaattcagtttctcagtagcactagccacatttcaagtgctcagcagccatgcgtggctaccgaactggagagcacggaggtagaagccctctgtcattgcagagatcctgctaaacaacactgctaggcaaacttgacctccacgtaaccaaataattacaagggtacagcctcttcacatgtattttatcacctgatcctctcaccaggagggtattcttttctttttttttttttttttgagatggagtttcactctttcgcccaggctggactgaagtggcgtgatctcggctcactgcaatctcctccccctgctccgccgggttcaagggattctcctgcctcagtctcccaagtagctgggattacaggcgcccaccaccacgcccggctaattttttgtatttttagtagagacagggtttcaccatgttgaccaggctggtcttgaactctggacctcaggtgatccacctgcttcggcctcccaaagtgctaggattacaggtgtgagccaccatgcccggcctattttcctttaagagggaaattgggacccagggaggggaagtgcagccccgaggaggacagggaatggcaggccagggactcacactgggtctttaggcatcaagtccacggtcccttctgcctcctgcgacatgggcctgggcccaggatgttgtcaccaaactcctctcaggccttctggttcctctgccacacctcgcctcttggtttcttatccagagctcctttctcctaacagggccctggcaccagtttaaaggagaaaagggtgtgaaagtgtgtgttcttctagttgaagggtgctcggttcctgtttgcaaaaaccgtggggaagagaacttattaccaagtgatttggaatattaacaaaaattccaggaagccagaagctgggtaatacaagttgaagggaaagaatgcacctttccctgaccccgagttgcctcgccacataactaggtcaacagggcatggacctctttgtctccagcagaccttgagctggcttcagagccctccagggtgggttggtaggggacaaatctcaggccttttccatttctctgattttggcccaatcttaattcatggggcaataagaaaagcatggcatctccgcagagtcaggactttgttcaacttgggctccatcacttactggcagagagaccttgagtaagtgaacttaacctctctgagcctcagtttcctcatctgtaaaataaggactgtccatgcatgcctccctaagttgtcataaggaagaaacaaggtcacagatgtgactcccaaacacaccgtaatgagccttcctccccaggaccccagcaattctcagccgctgttcccatgggatctttccttaagcaccaacctctgggaagtcttaagactcaagtcctcattaataataatactaacaggctgggcgtggtggctcacacctgtaatcctagcactttgggaggccaaggcgggtggatcatctgaggtcaggaatttgagaccagcgtggccaacatggtgaaaccccgtctcaactaaaactataaaaattagccgggtgtggtggctcacgcctgtagtcccagctactcaggaggctgaggcacaagaatcgcttgaacccaggaggcggaagttgcagtgagccaagatcatgccactgcactccagcctaggcaacagagtgagacttggtctcaataataataataataataataataataataataataataataacaataataacagcccggcatggtgaatcacacccgtaatcccagcaccttggaaggctgaggtgggaggatcccttgagcccaggaattcgagaccagcctaggcaacatggggagaccagtctctatttaaaaaaaaaaaaaaaacctcaagtcctcattaataataatactaatggccaggcacagtggcttacgcctgaaatccccatgctttggggggtcaaggcaggaggattacttgagcccaggaactggagaccaacctggacaacatagtgagacctcgtctctacaaaaaataggaaaacttagcagggcatggtggcgtgtgcttgttgtgccagctacttggaaggctgaggcaggaggatcacttgaaccccggagctcaaagctatagtgagctgtgatcgtgctgctgcactccagcctgggcgacagagtgagaccttgactcaaaatagtaataatagtaccatgccagactcattgaagggtgattatgaaaacccagacagaggccagggctggctgccctcccagtacccagcatgtgtgaagtcgagtcagatctacctgggagactccccattctgtgaccttgggcaagttactcaatcacctctgagttctcatctgtaaatggagtgggggagggtgataataataacacccgtctctcgtagcattgtcaagaggtttaaatgagatgataaggcacttagcctagggcctgggcacactaatgtctgccgacaccatcattaatcatagccctgagctgggcgctggagcagataaggtggctgtgaacccaactacttaccccacacagagggggacagggaaaaggactgtggaggggatgccaggttgtgtgcagcttccagaaggaaagagttctcatttcagcctgaaggaggcccactagcagggccctggagggaggctgtggccggctggggcagggggaggcagcggtggaacaaggagcaggcacagccccctgggaggctagcacttcccatcctggtctgcagcccactgcctcaaaattgcctgggagtcacaggtgttgaactggaatatgtgcagtggccccgcaatctaaatatatactttaatcagcttctatagtgattgctttgcaatataaagtttgggaacccctctcctctcctggctggggggtgtgcccatgtcagcagcctggtctcagccagcctggtcaagccttggcccaggagaccaaggacaattcacagccacaggaagttaatctccaaaccctgtctgcccatcctatctcttagattaaacaaaaagacaaaaccctgcggcatgtgccagggtaaggagtaacaaccggtacagcacggacattgccagtttcagcagatgccccatcaatcagaacagaacacccagaaccgcgcacacagggcacagccagctgcagagaggcccggctgagggcctagggagggttcccactgggccccccaccagccctaaccatacttgcccctttcatctgttttatctgtcgagttcccacaagccacatcgtttgaaaacaggatggcgctaccctaaaaacaacaagagtgaaaagcatcgatctagcagtgcatctcaacaggggctctatcggctcttggggcatggcagttcttgatcctgtagggctgtgctgaacccagcaggaagttagcagccctggcccttcccctgagtgccagccccaggggtcctgaggactgagcccatgccccaccccaggccggacaggctatccactgggggagaggcactgctgttcatagctcaactctctcactttacaggtaaagcagctgagacccaaaagccaagccagccggccacagggcagcagggtagagctggaaacagacagctccaggaagtgggctgagccctggcctcagcgaccagcctaaacagggctcaggtttcccagaagtgggcagaagggaagtgggggcccctcttcagagagccttgggtgggcatccataccccaaactgccaactggaagaagtaggactgggtaacccctactggggcctgaaggatcagcagcctgcacagaggagctattctgggaccaggcaaggaggccaggaccacctcggtggccctaagggcaggcatccagctgttcccaggcccaggcccagctccctcccagcagaggacaattgctccattggccggggttagggggaagagcctcagtccgctacttcctcaccctcactagctgtggccatgccgcttctccacaccctcaccctctccttaaggaggccattgtctgcccaggattccctgtcactcctgcccccacccctaacactcctgccctggatttcccctccacaatcctgcccccagggtcctccctgggggttcctcacttcctcccctggcgcccagcacaaagtagcctgaagcctctctgacctattgtcccgtgccagcaagtcagttccccctcccagcctctgttttttatattaatcagagatgcagggactgccagccgacttctgttcagcatgagaggagttccatcctgagagctgtaattcagccaaaagcaaagaagtctgctgttttgtttacagcaaatgaacccttctgtgttgatttggggaaacatggagaatcatttatgaacctttagtaccgccttcacagcccctgggtggtcaggagaatataggagagctttcagctgcaacattttataaatctggggtcccaagggccccacatagccatagccaaggcaaagcggtgggggggccatgccgcccacctcttgtgattgtacaaaaccctttgaatacttaacactagcagttttaagcactttcaagtacctctcatttaatcttccaaaaaaatctacaaagaagttcttcctgtccctgttttgcagatgaggaaactgaggcacagggattcatgtgcctgagttcccacagcccagaagtggtagaggcaaagcctaataggcataggcagctctcactctgcatctggtgctctttccagctcccacaaagagcaggccctggggcgcctctccacccatctcccaggaagtcaccctagttgcaatgataagctatttgcgtatttgtatatcagctggctccccctctacctctagactgtgagctccctaaaggcaacaacccagccaactgggtcaaacctgctgcaacctcggtgacttgattatcatggaagggtctgctcccctagggctgccttccccagcatgccagtttgggtcagtgttcaacagagtggcattacccccagtcacttctcatatccacaggaggaagtcctgggttcaagtcctgactctgctgcttcttggctgtgtgactctgggcaagttgctgaccctctctgaacctcaattttctcatataacatggggataataatgcctccctcacagtactatccggatgatgaaatgaaataatatacgggagagcagggaacataataccaagcacctaggaggccctaaacaagtattcatgaaaggaaggagaaagagaggtcgacccacacttagggagcatgtccatcactccccagtcggcagcaagcaccgcaactgacgtatcactccactccactcggtcctcaccagctccctgctagaattttcctgatcttccttgggcctctcaagaactccaacaggtcctgaaaaaggttctgggctcccgcctgagcccatctggctccaaagattccttccttctactacttcctcccaccaactattcatccatccgttcagtcattcattcaccacacatttatggagcacccattatgtgattgacaggggtctgggagcaactgagatgaacaagatgagggcatacccttgtggatctctcagtccagtgagaagccaggacgttgataaaataaacacagttatataatgaccagtgtcattatatatgcaaagggagcttcacgcttccagacagtgcccagcaaggggacctggccttgggtaagagctttacccagagcctgggtaagaactttacccgaagaacagtaagagccactgaggggcttgagctgaagggtgagaccatcaggtttgcagtttgaaatgatcttgttggctcttgcagagtggaaaactgagactgcagagggagcagggaggatgtgcggagagcaaaaggagggagaatgctgggggatatcagagaaactgggagtgaagagctacaggatttggcgatggtctctaaagaccactgtcatgcccacattcaataatattaactaacaattatacagtgcttactgttcactgtcctaaacaatttttaaaattaactctaacctcaacaattctctaagaaattattgttattaatatccccattttacagatgaggaaactggagcacaaagaggttaaataacttgcccaaggtcatgtggcattgctaaaatcagaacccagtctggccccagagttcacgctcttaaccaaaacattagacagcctctccaatgtgcttctaaccagtgttgccaactggccacagcccagggactccaggtgcgctgggaacccaggcagaagaggagagcagtattcagccttctctccatccatagccccaactagagaatgccagcagtgctcatcccatcccacctgccttcatgcttcagacgggcacactttgagctggactcagcccccaggcccaagagaagcctcgcctctgcttttgttcctcaagccatgtgagatcaggacaagtcggagagcctctcagtggctaggctcatggaagggaggaccgaggctggcccccctcgtcagttgattcagttgccagtaagtctcgctcaagcccctctgtaaccagcctacccagcgatgctgagcaggcctgcctgaactgccaaccagagcacaggctgctcagcagggaggccctgcacagctgggggcctctgggacagactttgcaaccgacaaaagctaaaatgcaggaaagtaaaacaactggaggtatggtaggaagagctctagactgcgggctcaggaaggccaatttttagtttccttttatagaaaatggtgggggaccaggagggtgatgcctggggacagtaggtgcctgccagcactgatagtttcattaattagaccactcaccccagttttttaatgggcacttaatggcagctgctatgaagacaccaccctagcagaggagcactgggattgtaaaaggcagacaactggccgggcgcggtggctcacacctgtaatcccagcacttcgggaggccgaggtgggcggatcatgaggtcaagagatcaagaccatcctggccaacatggtgaaaccccgtctctactaaaaatacaaaaattagttgggcgtggtggcacgcgcctgtagtcccagctactcaggaggctgaggcaggaggatcgcttgaacccaggaggcagaggttgcggtgagccgagatcgagtcactgcactccagtctggtaacatagcgaaactccatctcaaaaaggaaaaaaaaaaaaaaggcagacaattccaggagtctgaaataatgacaagaccctgtcttaccacttcagtcatcccagccctcctgggggcccaagcaagcctgtcctggcaaggcctcctcctagcccgggacaggggaggcaacagcgaacctgggggcctccttccattcctcagccccacctccatcatcatcccaagccccttccattatctcattggatcctcaagataaacccacagagaatgcagggcaatgtggtccccgccaccgcacagatgaggcaactgagactcagggtctcagtaaattaaaaggtaattaaattacttttgctagtaaattaaaaaggtgtaactcaggatcttttgaatcccagcttggtgtactccccactgccccacactgcctctcctgggggccttgtcaggaggcataaacagggcagatctcctggctggcggatctgctgcagcactgaccacagagctactacacagggcactctgcagggtgctgctgtcactcattatctcaggaagccttcagcaaccagcactaccagtacatagatgctattaactctattttacagataaagaaactgaggttcaaggtccaacatacacaggcccaaggacacaccactaggaagtgctcagaattcagcacaggtcagtctgactccaaagcctagactatgcctgccgcaccacatacgctgccttcccgtgcctgtgtactccacaccaacaaggaccaagtctctttcacatccatacctggcccatagcaggttctatttaagtgttggttcatgaaatcattattcttaaggcctaaggcattaaaagaaacaaaaaaggatatttcatacagatagaagttacaattcaaccagaagctataataatcatgaagcttttatacacctgacaacatagcattaaggtatataaagcaaaaattgattttaaaaaaaggaaaaattgccaaacccatatgcacaatagatttcatacacctctatcagaaatgcacagattaagtagcccagcagttctcaaacattttggtctcagaacctccttgcactcttaaaaattgagaccccaggctgggcacggtggctcacacctgtaatcccagcagtttgggaggctgaggtgggtggatcacctgaggtcaggagtttgagaccagcctggccaaccaacatggtgaaatcccgtctctactaaaaatacaaaaattagccggacatggtggcatgcacctgtaatcccagctactcgggaggctgaagtgggagaatcacttgaacccaggaggcagaggttgcagtgagctgagactgcgccactacactccagcctgggtgacagagcgagactccttctcaaaaaagaaaaaaattgagaatcccaaagagattttgtttacgtgggtttatacctatcattattcaccatatttggaattaataatgaggaaaaagttaaatgcattaatgctttaaaataataaatgtttatatgttaatataaatttttatgaaaaataattgtatttttcaaaacaaaaaataattttagtgagaagagtgacattgttttacatttttgcaaatctctttaatgtctggcttaacagaagccagcagattctcatatatgcttccgcattcagtctgttgccatatgttgttttggttgaagtatatgaagaaaatttggcctcacacataaatgtagttggaaaagggaggagtattttgatggccttttcagttaattgtgagtatgcttctttgatactaccccaaagactgacatgtgtagtttctttctttttttttttcttgagacagggtgtcgctctgtcacccaggctggagtgcagtggcgtgatcttggctcactgcaacctccactgcctcccctcaacaaaccccactccccaacccccactcaagtgtcgatcctcccacctcaggctcctgaatagctgggaccacaggcacacaccaccatgcctggatatttttttgtatttttagtagaaacagagtctcaccatgttgcccaggctggtctcaaaactcctgggctcaagcaacccacccacctcggtctcccaaagtgctgggaatacaggcatgagccaccgcgcctggcctgacatgtgtagtttcttaaatgtaatgcagaatctgaaaccatatcaataagcttctcttacccaattaccttaaaatccattggactatcttgtaccttgaatgggcatttgaattatgtacagttttgaccctgtatacccctccggaaagagtctcggggtccccctggggaacactgaccatactttgagaaccattgaaatagacaataaaagagtgaaaaaatgtagaatttgataacataattagcaagtttgatctaagaggtatttatatagaactttgctcacaacaaactacgaatacacatttttttgaacaaatggtcccctttatcagctgggggaaaggtctggacaggctgtggatgctccaagatggacagatgcccggcacagtgcccaggtgttccacctgctgcttaggccctggttcggcctcagcaagaaggggcactacatcagagagcagccttctcctgcccaggctgcagaaccaggtcaaatggccacagagagagagctcccctgacaacagccccatggtgcagccctcacctcggcttggttcctgtcaagtttccctccttgcattcaccctgtcccgtgtcaggggcccccgggggtccccacgacagagctgccaggtaaagagtgtccatgctcctcttccaggaggctttcagccagtcccctctgcccgttacagccctcggagctgtcaggtgtggactcacagctctctgatcatgcgcagttcttacataaccaccagtagaaacaaagccctgctctgtccaggccaggtactgggacgccaagaacagcacagccgaccagctgcccaaggaggcagcactttgcacaaccacctgggaggctctaacacaccgtcagtgcccaaggccataccttccctggagggcaggagcctgccaagcctggaggggtgggagagtcagggtgcaggggcagaactgctgttcagagccccaaaccagagccagaaccaaggcatccaagggctttcagaacacacaccactttctttctttttttttttttttttttgagacggagtcttgctctgtctcccaggctggagtgcagtggcatgatctcagctcactgcaacctcctcctcctgggttcaagcaattttcctgcctcagcctcctgagtagctgggattacaggcacgcaccaccacgcccggctaagttttgtatttttagtagagacaggatttcaccatgttggccaggctggtctcaaactcctgacctcaggtgatctgcccacctcggcctcccaaagtgctgggattacaggcatgagccaccatgcccagccaccactttctttttttaagagacagggtcttgctctgttgcccaggctggagtgcaatggtgcaatcacagctcactgtaacctcgaactcctgaactcaagcagttctcccacctcagcctccagagtagctgggattgcaggcgcatgccaccatacccagttaacttttctaatttttgtagagatggagtcttgctgtgttgcccaggctggtctcaaactccagggctcaagcgatcctctcacctcagcctcccaaagtgctgggatttacgggcgagaacaactgcacccagcccatacagcacatttttacctcaaagtcacacgtcccttggggatctaacattcctaggtgttcattctgtgtgttggcactgtgcagggggctttctttccattcaccttatttgcttctcacagtaactgctgaagaaattccattttacaaagaaggaaatgaggttaagtacttgcccaaggtcatacagctaatatgtggccaggatctgaacctggctccatcgtctgcagagcccaggctctcgcaccattgctacactgcactgcctggccctgcagagaccagtccttcaccttctgagtggccatctgcataacctcttcatgctgggggctgggagagggagaggggaaaagaaggccaaagtttactctacctggaccccactaggtcatcctggacatcaaacacggcttgtcccacccttggggctcagtgagatgaggcttctcctgcctcctctgcctgccttgtatctttttcttacaactagatcagaaggaacagagccatgtcttttgcacctctgtgtccccatgcataccctaccccatgccttgcagatagtaggtactctatgcattttctgtgaatattaaggagtggcccctcacccctctccactaccactgcaaggacagacccagaggaagacaggagccctggaaacatccattagtgggactaaggggaggagcagagggggaaagtgcccagtactcctgccttccagcagagccagcccccagctccccacgccctcctaggagacacctccccaaggtaccctccccaccaaagactgggaggtcaggtgtcaggctaggctctcaggaaggaattcccctcccttcaagcctccagtccaaattcctctcaagggagagccaatgaaaggcaggactcagacaggagagaaagacaccaagcatggggctcctgaaggtcccctcccctctgatgcttgcctgggtgccctgctcagacacaccatcaattccccctcctcccactgtgttccctaccatgggttggaagttatcttaccacagagtggttaagccctggcctttgtagcccaacatctggattcaaatcctagctccttcacatatgagctgtgtggccaagggccagttactccacttctctgaactccctatccccttggtcattaggcctacagactcagaatccaggcctcctggttgtttctgggctctgactctcgaaaaagactatctgggttcaaatcccagctctaatctgtgcttaacctctctgccgcaggatctttatctgtaaggtggggacaataatagtacctacccaccatctagccttattgtgagaattagctgagggagtttatgcaatgtgctcagatcagacttggcacacaattagcacccactaagtattggctatcattagcaatagctgataagcttggaacgtaccttgcaccgcaccttgcaccgcaccttgcaccttgcaccgtccctggcaggtagtaagagctcactaaatagaagctatgattaccttcacccccactagactatcctggccctggaggtgggttctgggtcatatccatctttgattccccagcagccagcatggggcctggcaccaagctcaatgaagacctgccaggaggaccagaagatccagggtgtggggtggcacgagcctcccaccagggagaagaggaaccgaggtgtcggggaagagaaaacagagcagagggagaaaagccaaggcagagagataagcaagtgaagtgagtgagaaaaggaacaggagaggctgtggcggagagagataaggaggaaggatggagaaggcgagggtccgagccaaatgcccagggaggcagggagccctggggagaaacgctgggcgaggccagggctgcggcaggggagccgagccgggagaggggcgcaagacctggcgctgggcgggacgctcgggcagggtgcgggaggggctgagggccgcccccactgcctccccgcttggagcggggccaggcggccggagattggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagccatgcgggcggcggcggcggcggggggcgtgcggtaggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccaggtagcgccgccgccgccgtccccgcgcgctccgacggccctgcagctcccctagcacagctctgcgaaccccccaagaggtgcagctccccccctccgcccacacacacacacacacgctgtcctagctcagcccagcgtccccggaattatcccccgcagccttcccgccttcccacctccccagggagtggcagcatagtgcctcccgtcggctccagaccttccctctggctctcgttccctggaaacccctggcacccctctcagtacccatccaaccaagctgctgagaatcccccaatgccgtccccccaatcctgggacgtcctgataaatgccttatgacccctctcagcccaagaatgcctggggtcgttaaacaatgcctttcacctggatcccgaggcaccaaagcaagcatcatccccactccgtgttgggaccttgggaagagaggagaggtgagggaagggatgtggagaaagactggggactaagaatgttctggactatgatctgcgtccccgttttctgtacctggaaccctaagatctccaccctcttccccagttcccctggctgggagtcattcgggtaaggctcagtgcggaaggaagagcagattaggctctgcccctgaagagaagcccttaggcaagttgcttgacttcactgagcctcagtttccccatccataaaataggaagccatcccaggctcatgaaacctatgaggtcctaagtccctcctcccacccacccctcagtcccctgaaccctaatttctccctggtctcagcctccccttttctgtgctggtccacatagctcttccaggctggctccatgccctctcccccttcctccccgtctgctgtcagacttgagtaggcgcttctgggcctcggttcccttttctccaaaataggagtaagggctgggcgcagtggttcacacttgtaatcccagcactttgggaggccaaggtgggtgaatcacttgaggtcaggagttctagaccagcctggccaacatggtgaaaccccgtctctactgaaaatacaaaaattagccgagcgtggtggcacacgcctgtaatctcagctactcgggaggctgagacagaagaatcgcttaaacctgggaggcagaggttgcagtaagctgagattagagagccactgcactccagcctgggtgacagagcgagactacatctcaaaaataaaataggaataagaatccctatttcataggctgaggatgagaggagataaaatttaaaagacaatgcacatcatggctgcagccgccagggtcatggggcagtcactgtgcccacctggcagttttgtcactgcacagcctgtctggtgattgtcaatcactctgtgagcaggtagtgatatgattgccatcatcccatctcctgataaggaagtagaggcttggcaaggggaagtggctggtcagtgaggaagcctgcaccccaagtggctcttggaactccaatcccctcaccaactgtcccccaaccccaccccactttctctcttcagtgaccaagatctgcgcccagtgtgagatggagcacagtgctgacggcctcatggagcagatgtgctccagtgactttggtgagtgtggggcccacgctgccactgccccgacatcacccccagcccctctttcttgacgcacacgggaacatacatgcccacatccatcacagtgaatcccaacagtttttgcatcatggctcccgtttagaagccaattataaccataaaccctttcccaagagaaatgcacctctttctgcatcatctcaggaccatcacaagtcccctaaggccatgggccttgggcctcagaaaccaccccggccagggctcccacagccctcccttggtgtcattttcagagggccctccatgactggatcatctctgtggatagtgcaggcttagcccagagatggatggagccaggtggggagtgatggctctaggatggaagtggagcacccttgtccatgggtacctccacctgggactcagcacacctcctgccagcggagctgtggtcacctgtccccacagcttcatcccagagccttcccattttctgggacaatccagccaagtccggtcaggacctggctcacacatgggccacgcagtccagtgtgtgatctttgccaagtcagttccctgttttgtgtcttagcctccctgtctataaaaaaagaaaaaaggagatgataatgaagtcctttcttcagaggagtcttttatgttggtagcctgtttggaaagagaatactgctattgcaaggggtgtatgtgtgtgtcagagagagaaagagagggggaaggggacataaagagaaggaacaagattttatgacaatttcctgccaagagtgggcagttattctctgacttctccctggccccacagagatgggggcccagaagcctgaagaagggagagaccagcccgagggactccccaccccaccctgaggcccaggactccttaggctctctacgtccactgtagggtgacctgcaccatggctctctgggcacagaccctgccttcatcctagccccccaaaggaaaggagttagggtctcagtgcctccagccacaccccctgccccactcctaaacatagcacaaacacactcccacccaccgtacaatctctctctcacacacatacacattactgtacagtggtgtgttcacaccagcaacagctgaactgtgtgtatctattcccagctccacacccagtcatgcggtcagttatggtgggagtatttaccccatggatgtcaatgaatgcaaagcagggctccctgtccacagagccggctgttaaatatttgccagcccaccactgttccaaccacactcaccgtgtgtgcatgcacacacatatacacaccccatatatactccataccatacactcacacacagccagaaatcccagtgggaatcatccccagagatcaggaagtccagcttccctccatcacaaggatccccttccaagcagtcggccccagtcccatccactccttatcccctccctggggagccccacatgctgctccatcaagagctctccaccctgcctttggtgtctcagaagggcttggactctcgattcacgcaggtcacaagctctctacccctcatttcccctcttctgtaccttgaggatgaaacgtgatgctgtccttgagagtgcagcatgataagtgcttcataaatatgaaaatgtgccctacgagctccacccttccaagccccgcagggcatcaggctcccccagcccgaaggtccagaacacaccaactctgtgcccaccagcatcccacacagatctgaccattcccaacttgcccctgtcctttcttcccacagtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactgaagggcactcctccttgccctgccagctgtgccttgcttgccctctggccccgccccaacttccaggctgacccggccctactggagggtgttttcacgaatgttgttactggcacaaggcctaagggatgggcacggagcccaggctgtcctttttgacccaggggtcctggggtccctgggatgttgggcttcctctctcaggagcagggcttcttcatctgggtgaagacctcagggtctcagaaagtaggcaggggaggagagggtaagggaaaggtggaggggctcagggcaccctgaggcggaggtttcagagtagaaggtgatgtcagctccagctcccctctgtcggtggtggggcctcaccttgaagagggaagtctcaatattaggctaagctatttgggaaagttctccccaccgcccctgtacgcgtcatcctagccccccttaggaaaggagttagggtctcagtgcctccagccacaccccctgccttccccagcttgcccatttccctgccccaaggcccagagctccccccagactggagagcaagcccagcccagcctcggcatagacccccttctggtccgcccgtggctcgattcccgggattcattcctcagcctctgcttctcccttttatcccaataagttattgctactgctgtgaggccataggtactagacaaccaatacatgcagggttgggttttctaatttttttaactttttaattaaatcaaagaaaacaataactggtttggaccaggtggtttctttgtcagctggttcccaagaggtggggggagagggaggtttagaatggagcttcaaaaagaagcccttatcttaacccatggcctggccacatagacctccttggaatgcctaagaaaagcaaggcctgtgtttttgtagtacatagcaagggtcaccctgtcattctgaccgctaagtgagggatggagatggccgttcttttgtccctgaggaggaatggaggtgccaagttcccagcttctcccacagtcagaagactcccatggtcctgcagcagctccccgaggaggtcagggcctgatcagaggagtccaagaaggtggggccacagggaactatcgtgaaaagcctgaggccgaagacgtgtcactcctccccttcggctttcacacaccgcgggcactgctccttacctgtccctggtccagcagcatgagcatcacctgggagctggttagaaagacagcatctggccgggggtgcggtcgctcatgcccataattccagcagcttgggaggctgaagcgggaggatcccttaagcccaggagttcaagaccagcctgggcaacacagtgagaccctaactcaacaacaacaacaaagaaatgcagacctgctgtatctgaatctgcatttgaacacataaacattagaatcatctagggagcttttatagaatcctgcaccctactctaatgcaattaaatcagaatctctatagggtgttcaggagttggtgtttttagatgctccctggggtgatgtgtagccaggattgagaactactatctagataaggtgacaactgagacagggagagggcaaggggctgagggggtgccccagtgggctcagagcagatgggggctgctgccttgaggtagatggacagggaggggagacagcttgggaggcgagaagccacccccactctaatgggcagactatggacagggcagtgccaggaaggagctccctgggggggtctgtcagcagatgccagatgtacctagagcagggggctaggggcaccccctgaggggctctccccaccggtgggggtaaagctgggatgctgtccagtcaaggcctggtgttcctccaagacaaaggagcctcattctctggaactgaggaaagccttggcttccgctcccagaggtgaacgtcacctcagggaaatgactccagaggggccaggggctgagttcttctgtgggccatgagcgcacattcgcctgaggtctggctagcaggtggtccgacagcgcgcccataaatcaccccgggcaggcaggtggcctcgccgcaggtcaacagctgcacaggccgccttgctcctccctcacccatccgcgcccaaaccctgcccagtgcacctggctccctgaatctgcgccttgtctcccagcctcctaccctgaccaaatgtttacggacacttctgtggtcaaccaggaccagggatgattttccatggcacacacaggactgggtctgccctggctgaagtactacactgacttctgccagatgctggcagctgtggggcagcagggcgaggggaggactcccttagcccatcccgtgaagcccaggaaggcactcctctacccccacaaggggtcagggcccagcttgaaacatctgctgtcccccaacatctgctgtcagactcgccaagaatctcttttctgggaccaagaagaatcttcccaaagaccagggaggtccttccaggcttgagccccacccttcattcccttcagtcacacaagactccctcccgctggctggagacccagcagctgtgctgccccaagagcacctgggtgcagtgaacgatgcggcccccaaccacacataacagaaaccccaggaaccgaaaccccagcttctccacacaagaggggtggaggtggacaggtgggaggtctatgtccaactgccttcctgctctgccatggggtgacgtttgctctcgtggttatagacaatgcctccttccaacttctccaccacattccagacagcaaggcggggaagggcgaggagcacagcttgtcagctgcctctggcccctttgatcaggaaaacagaaatttccccagcaatcccacctagtagatttccacttctagctcactggccaaaactaagtcacatggccacccctaggtgcaagacagcaaaggaagtcaagctttttcagctggggacaaaatcagagttctaataaagaacaggacagacaggggaggaggcagctgaacactccgtgttggggtgagaagaggcagatacagtccagtcctggcttctaatcctgtgacttagtgactgcgtgacatcgggaatagtgcccagctgtaaaatggagtaaaaatgtctatttcacagggttgctgagggttaagtgggaaaatgcatgaaaagtacaacgcacagcatgtagatgtccattaaatggtaatgactatttttattaaccaaaagccatgacctagcagtgcctgtccataataggtgctcagtaaaattcctaattgattgattaatcaactaagaaacaatatcggcaggaaggcagggaaaagacaagagtatcttatctaaaagccagaacgctactttcagaagagagctagaacctacatttggggttttgcttcagaaatacaggtggtggtgtaagccagtatcaagccaatatcaataaatatcaaggccatgatgggtggcaggcactactcaaaacttttgcatatgatcttttctcttttttcttttttttttttctttttttttttttttttgcctgggctaaacacagtattacaatcgtggctcactgcagtctcaacctgccaggctcaagcaatcccactgcctcagcctcccaagtagctgggaccacaggagcatgccactatgcccggctaatctcttatttttcttagagttgaagtctcattatgttgcccaggctgctctcaaactcctggacacaagcaatcctccctccttgtcctcccaaagtgctgggattacaggcatgagccactgtgcctcacccagcttttgcattctaatttaagcctcccaacagccatttgaggtagtggcatttcagtgatggtggctgaggctcaaagaggttaaggaacttgttggaggtcacacagcttgcacatggcagtgctagaatttgacttcatgctcttaaccactatactactatcggtaggggcaaagccaaggctcaggggtgcaggcagccatgcttctgccagcctgcctcacaggaagatttctgggagccctgttccaatcccactccaagggtcctgacagaggcagaggagccagtggcttttctcctaattcccaaagacagcccacccccaaccccttctcccctctcagccctgccagcatccagccttaggtctccacaaaggaagctcacatcccacaactgtttagtcgcctgtaatcctggctgaagttcactcctggggaaatgtaacatgggggggtggttgctgctggaatgtgtgtggctgggaccccatgtcccagcccagacagcaggctctgctggggctgtgaagaacacaggcagccaggggaatccggaatccccagcccccagctgtgccagagaatggaatgtgctgctctggggtgttgaaacatacccgaccaggccggaggtggggttgctgggagctgggggagctccggccacaaggctgcctctgttcttgtggctgagcccatttcgctagggctgggggtgggagggaggagaggagagaggccatgcttagtgggtaggccttcttgttagctcagtggctagctcctggagccagtgggggccaggcagaaagagggggagggtggcacccaggattgctctgttcctccaaaggttctcttatgaggcccctgcaagctcatgtggcataattcacatcccggctccacgacttactagctatgtgaccttgggcaggttccctaacctccccacacctccttttactcgtcagttaaacagagttaacaacagaacctacttttggagattgtcatgaggtctcgatgagatgatgcactcagcatggtgcctggcacaggtgctccatcaatgtaggtgttatcctgagggccaccagctgtaagacagatgctgggccagggcctctcttagggggtgcctcaaaggttccagggagacaaggggatgaagacagaacttcatatggcttcagccccgagggctgaaaatcctgaagatcccagaaaccactgccagctcaaggtcggccatggctcacgggaggctgctcaacacaaccaaccacaaaaaggattggcagagccctcagcccacgccaggctgtgggagctggagccccagacctgccccagcaggcacgagggctgcagcagagtctggttccccatcccctcctcaggggcctgagaacaaattggtttttttttcaaacatggacagtttgtcttgtaggccacccacgtgcaggtcctctccatgctgtggacgcagccagttgtgaagcacaatccctccgtgacttcgcttcccagcggtacctgcaatttaaagttatgtcccctgcctactctcaggggcacctcaaggggacaaggccctctagcatccccttctcggaggctgttacccaaggatggaaactcatgcttctcccatctctgtaatccatgcctgcaggcacagacttcaagttactgctgttatggttgagatttcaccaacatttggcattttcattttccaaaaataaaatgcattgactgcttttccaaactacacttgtgcctctctgatactcttctctgaagaatcatctaaaattacactctggtttaaaaaaaataaatcactgttctaagccacccaggacagagctgtttgtcctctgaaggtggccaggatgacaggagccagcgtgtccagcatgccaggcaccgggccccatgcctcccgtcgactctctcatttctctcacagcacccgcacaagctatgcatcaccatcaggtgcactttccagaggaggaaagcacagtgagcctgggggcagcacccctatgccaatgggccccagcaccgctccaacagatggtaaaggggtccaagcatggaggtgggccacagcaggcgccaggcaccaccctctactgctgcagggactctgctcctacttcaggggaacagtgcctacctcagagttgctgtgagcaataaatgagatactgcacgcaaagccctcaccagtgcccagcacccagccacccaccacccacctgccccagctcagggcatggcttgcacttcccatctcatgtccaatcctctttcctgctgctctcagcctccctgaaggctgaccctttctggctttctcagagggattagttaaaatctttccgttgtaaagcctgcattgtttggggtttaccaagttctagtcccaaccccaacccccagtgctgggccctcacaattgggtcacaagactgggcctcaagtcaatccgacaagcatttgctgagcctctcctgcgtgcaaggcacagctttcctcctcttggcccccagctcatacccagaccaggctgcagcccccacgcccctgccaccatggtgccccaaaggcccgcccctcagcctggtcctgcaggaattgcccaggcctgcaaaactccagcagtgccagagagatctggtcttccagcctcagggaaaatgccaacacaaagacatgacaaaaacaagaagcttgaggcctttttattgacaattctccatagacacagagatccttttagttcctctccagtgtaaagaaagcacggggtactgaactctcctctcttaaaaggacacagaggcgatacgataccaaagcctgtctggctccccagggctgtggcacctccactggcctgggtaagcccctggctgcacagccccagctaagctgcttggctcggcaagaaagcgggcctaggatgggtcccttgcctccccagcctgcctctctggacccctgctcctcgagtgtagaaacctctcagccccctcatgggtcctgggtcccaggcagcccatgactccagggaagagtcctaggtagaagacccccacccccaattcctcctcatcccattacttgtgccacatgttcccaggaaccatgcaataaataaataaatacttgagaaaggcagggcagctccagggaagggaagggatgcctgagccagctcatggctaagggagagatactgagcccgtaagagtccagtagtgaacatgaaactgttggaaagaaatggagacccccagggggccttatcccataactgagactgtcctccagggaatagccctggaatccaggacccagcccagcgagatcctacactacccaggcccccaggggtcaagggcttcaggacctctgctccactcacctggcctcccactccattggacaagaggcagggaaaggaaactggagtgctgggccagtggaggactgccctagactctggacagagggtgcagaagttgtgatccaagtgccctgcagctgctccagcggagctggggacactggggcattgtgtgggctgagagtctgtgaattgaggtgtcttcgaggggaggctgaggtctgtccagctattggggcttccccaagctttcctccacttaacgctgaaggactcagccaaaccctcctatacacattctcctctcagggaatctgggaacttcaaccctgtttctagaagcacccatggtcttgttaggcctggccacaccctctgatggggaaatgatgagatcctggtgcctggagggacattcaatcagcagagatggggtgtggcactcccaagcccttctgcaggctctctgaggctgagggcctggcccagtaccctgcaggagaaaaacctcttttcccaacctcaggtctggaattcccaggcatagccacactgaccctgatcttcagaccccagtcaggcctggcctagttcgctgctgccctctggtggctactgcctgcccagccctaagtccactcgctcagtcccaggcagagcagggcaaacatgccaggccctccaggggctcttctccctcaagggattgagagcagccattgccagccactctcatggatggagaacagctccagaatccagctggagagagtgaggaaggaaggggaagcctacctagcattcaggccacatttgcccagcacacaccacagtgggccaggggtggggagagtggggggtctactgctggccccaaggacgggtgcctggttggaccctggcctctcttctcacttgctcaaggtctggttacacgaggcacacacaaacacagtctccctctgggcttcaggggctgaaaaggaggaagaacttggtgagacatttccttgcgccctttggttcatggccccaactactagaagcaccctcccaaatgccccacagagaccccccacccagcccacaccctctctgcccagcttgctagcctgcccgcagagattcttctttccatgggaactggggatcctggggatgatgatgccaacagcaggccactcctgtgctatgaattagacattattgtggcaccaacagaacaccttcaaaaatttttaaataaaatattaaatacaaaaattagccaggcatggtgatgcacgcctgtaatcccagctactcaggaggctgaagcacaagaattgtttgaacccaagaggcggaggttgcagtgagccgagatggcgccactgcactccaggctgggcgacagagcgagactctgtctcaaaaaaatagaataagtaaaatatcacggtgaaatttcccaaaatgttttaacagtggttacctctgggtggtaaaattacagggttatttttctcttccttcgtcctctgtataataatttccaaattttctagttagtaagcatatgttacttgcatcggaagaaaaaagcacttgggctgggggcggtggctcacgcctgtaatcccagcactttgggaggccgaggcgggcagatcacctgaggtcaggagttcaaaaccagcctgaccaacatggagaaaccccgtctctactaaaatacaaaattagccgggtgtggtggcgcatgcctgtaatcccagctactcaggaggctgaggcaggagaattgcttgaacccaggaggcagaggttgtggtgagccaaggccgtaccactgcactccagcctgggcaacaagagtgaaactccgtctcaaaaaaaaaaaaaaaaaaacttggtttaacattatactacaaaacggtacatgaaatgtgaccacatttttcaggaatatgcatgcgcttttattctacatgcaagctaatgagcagcagggtccatgcccgattgttctctcaggaagaaatcaggaattttttttccttttgcttatctgtgttttttatttacaatatgtataggaaatattttatattttataaaaggaaaaaaaggaatttttagttttgttcaaagtgccaaggaaataagaaaaagattaaaattgcggctggtgattgactccaggaaggcaggagcagtgctgggagctgcgggggtgttgccagggctcttgtttttcaactttagtgaagcagccacaggtattcatcttgttattacccttcacaattcacaggtacatcatatctattcttcggcatgtaccaaatgtttcaggattttgctaaagggtatggaggaaacgttcccgtaggcctgactacaatcccaagttcccttgacctctgacacccttgcctctgtgccacagcgtgacatcccctgggcgggataccaaccaagccctcccaccacctgcaccactcacctgtggcccccatggaggacttgggcaccttgaaggagcagcatcgagagcagaagctgtttccacaattactgcagctccgctgcagacaagagccaaggtcagatgtgtccctcaccctcaggcacctggagttctcagcacctccctcctttccaccagctgatcccacccaaggaaactgggcctggggggtgcccaagtggagcaggaaagagagcaaatggaataccccctggggaggctggtaaaaggtggcacaggcgcaggggagggcacactcactccagaaagccactgccaggcccaatgtgacccgagccagactttctcaatgactcccctcaactcctccccacccgacagtcccaaggacactgtccccaacaaatgcaccctcacagacactcaccctcttcttcagcactgagaaggtggccgagcagcccgtgcagttccctgagaaacagaggcagcagctcaacccccgcccatcccaggactctcacgctcacctgctcctggtgcttctaaatgggacactcaggacaccagcccagcctccttggctggacacagtgagccagggagcaaggccagattcagagacagaaagaaggactcaaactaagaagactgatagcccctgaggactgatgtctccagccatacatagctaccagtccctgaacccttccagagctgagtggccctacctacaggttcaacagaaatcaaagagcacccagcagaatccactccaagaaagccagctaagctggcagggacctgaccacaggcatccccaaatgacacctgcctaacatgaccctttccggagcaatgccttacaaatactccacccacaggctaaagacagaaactcctaaaaacctaaactcctgctttctgtcccctgaagactgcaggagagaaactcagagccaggcacattccaagaagacatgaagggtagaatgctcaactgtaaagacacgaagggtagaatgctcaattgtggtgggcagtgagtggcatggggggacgcagagcagggagaggtcctgcctaaaccaccagagatgccaagatggccaagtgcccggcaacagtggaggggcaacggcagcttagaaaatggctagaagacaacaagggggtgtaaggggagaggagagacagagaatgaggtttctgggatgtggggcccataggcctgctatgacccagccggaccacctgtctgggcaagtacagagcaccaggcctcactttcacagaaaggccccaaagctttattgacggctacatgtggtcccttcctctgtccagccaaaatcacctgaagttcttgctaaaggagactccctaggttcagggaaaggaagacctctgctagagccaggggaaatctgaggccaaggtgcttcaggtaaatgcccaccctgtcagtcagccagggaaagagaagaacaagcctactgctggtgccaaaccaggaaactggctgctccaagattctgtccctacaccaagaatttggggaaggcagcctgccccagcctctccttagcaagggacacaaggggaatgggacaggcaaaaggagctactcaaagactgacactgacctgagcccaaggtctcctctaaactgaatggaatgtcagggccaagcaccccagggcagccaagtgggctggggagacagctgtgaacccactcacagaccggagccagggagggctctgggagctgagagcagctcagccaggtgacgttcccttccaacacctaccaactctttctgccccttctcagcaacagcctggactcacccatcctcactcaccacgtgacgatgccaccgaggccatgacagcaggggcactaaggcccagtggggcctgccagggcaacagtcatggagcctccaggacaaaggggggccctccccaccaagacctctcccatacggaggccacagagaagctcctttgcagtctgccctcattctccccatgcaccccctcatccactggcaggggtaaatagaatagcccccaccacagtcccctaacattcacatgtggaatcctaacacccaaagcagggcccctgggaggtgaccgggtcatgagggtggagccctcgtgaatgggattagtgcccttataaaagaggccccagagaactgccgtgcccctcccaccttctcatgaggacacagtgagaaggtgctgtctatgacgacggaaatggacctcaccagaacctgatcctgctgacaccctgatcttggacttccagcctccagaactgtgatgagagatttccattatttaaaagccccccagcttagtgtatttcgttatagtcgctgaaatggagaaagcccccaaagcagctcccctcgccctgctctcaggacccaggttcaggagcagaggccgcaggagctgagctgctacacctgccctcatggcaaagagcttgggaacatctcagaaaagggaaagtagcaagtggtcttgaaggatgaggaactaagaggagtttaggaaaagaagcactttctgcccttgccatccttgagggaggctgaaaaggcctctgcccatgctggtagagattatccaaaccaaaaatcaaatacaaaagcaggacaggcataaaacaagggacttcacaggcaagggcaaagggaaaacagagagggaggatgaagaggtagaaagaagacaagagccgaatcagacaacctgaatttgagtcacagctccaccatttccaggccaaagtctctgggcaaagcactctttttacctcaggttactcatctgtaaaatgggaacagctaagtacctttacttagaagttgtagaaatagacaaattatttgctggaccagagtaatacttcttgtgtgtagtgttaccgggcactgctggaatctggctgctctgaacccttaagaactgcctgctcctgtcacacctacggtaaggatgaaatgagatcacacatgtgcaagtatggagggtaaacagatcactgaacatacagaatgccctgcagaagtcagcaggcagcataaataaaacaaaggggccgggcgtggtggctcacacttgtaatcctaacactttggaagaccaaggtacaagaatcacttaaacccaagagttcaagaccagcctgaggaacaaagtaagaccctgtctctacaaaaaaaattcaaaaattagccaggcatggtgctacatgcctgtagtcccagctactcgggaggctgagctgtgaggatcacttgagcccaggaagtcgaggatgcagtgagctgtgatcatgccactgcactccagcctgggagacacagtgagaccttgtctcaaaaaaaaaaaaaaaaagggatcttgaataactgggggacattcacacagcagaaagaaagagcctgtccaggacatctaatcctgagaaaacaactgccctggctgctgcaggggtaggaaggcaggaccctgggggccctgagtcaaattcctcaagataaactccattgtcttcttccagggcacagaccctagaactcactcaacaccagaacacacagtactgcccccttaccctgctcccatctgacagcaggcaggagggcccttcctcaggagcacagcagctcccaggtcaacctagctactctaggtttccaccataattgtatgtggctcagctctcagcgctgctgatctgagccaggtctctaagctgtgctgtcaagtccacccttctccaaagctgccttccttgaccgctctcccccgaccctcagtaaaataaggactggctggggagaggtgaactcagggctctatcacgtccagagaaacaatgtttgcttcaacttgcttccagctggataagaaagaccaagacaggatcctaggaacccacagcgtgggtcagggcctcccacattaaccgcacccactacttactatgaaccaaccagcactgtgctagcccttcgtaagtactactgtctcatttgacatgagacctgtaacaaccctatgaggtaagaatgatgatcccccttttacagaaggggaaactgaggcacggggtgtgaaataatttgctcaaggacacctggctgagctgggatttgcagcaggcagtgagactctactctgttcctcaccatcatgctacactgccttctgaagttctgtcaggattatggttctctacagtcctgggatggcatttcccaaactgagttccttgtcttcccacaactgaatgtccaatcaggatggagggacaagaaggaacccacacccactccctcagcagtcctgccgggcatctgctagctccccggggtcccgcggacacaccttcactccctgctcttgtcacaagtcagtacccacagttctgagactctgcccctgtggctgggtgttccccactagagtcccagaagtccacccccactcccccaccagcccagccctgtcccctggccgcaccgaagttgttggtggggtagcgcttgcggagccgctccgtgagccgagacaccttgctgcgcagcacctcattcttgctcaggaacccgttgtcctgcagggccagctcatcctctgctgggcacggggcgccctcatcatcctcctgtgggaacagctccttccagtcctgcccacctcttgcaaggctgcaggacccgtgtgcagaggcatcctgcgcggcagcccccacgaggtgtggcagcagccggttcagccaccctccccagcccagcccctgcccacccaccaaggcttccacttaccagcaccaccaagtgggtctcctgcctcccaaggtgcggggaagaggagagaaaacagaaagaaaaagatagcaagaagaaagaagctacctggaggggcccccaagcagaaggaagcatggaagcgctgctctgagctctgcgcacttcccaaatggtgacattgacagacgccccccacaagaggatcccagcatcaaacagccttggagaaagctaggtactacagtttctcaaactgggtgaaaataatttagtaggtctttatttgaatagaacagaaaaggaaagaaaatatcccttacaacgtattttccggaaacttttgtttcacttaagttttacatattttatagacctaagtgtgacctgggtcaagatgcaaaatgtgttccttactatgggtcatgaacaaaaatgcttgaaaacccctgctctacatattccctccaccaagattcacggtctacaatcatatatcaaagttttggagcaatcttttagccatcagaaagtcaaatgcctgcatggcctgggctgatgtatgattgaggtgagttggggtaaatcacaggcctggtggaaatccacgaggtgtttttcttatatctcaatttcccactttacaaagagaaataaataaagagaaatgatatcctactctaagaaaaacaaaaacgcaaatgtgacaaatggcaactgccacttgacctcagtgacaaaatacagcagggggtgttgaggaccacctgtagccacagcatgtgacctgcgtaaaggggacagcagctccttagctacacctactgctgcagactcaggactaccagagaaactggaaacctgcagttctaataaaaatctctccatatttaaacattggctcaaaaaattattttgaaactttgcatgccaaataaaacacttctgcaaactaccaatttgaattaccatcctaaaatcaagaaagctgtttaacttcctctgacctagcacttggccatgcaactactttctccaacctcccctcccagccccgcaaagggacatcttacggaactcactctgcagaagagcggagacccagggcagtagcctcctcaaaagctgcctttcctatatcaaaggcaccaagcccacggtctccagcaaaggccagaaatcgtccagctcccctagcagggcattacccggagacttccagaaccactcttgccctgggcacccaggacagctggctcaaccagaaacaggagtggggaggggttcagtggcactctttcaaccagtgagttctagctcacagcaagttttagcttctcacttggacattaaaaaacaaaaacaaaaaacagctccaggaccacccaatttctggcctgctgagtagaggatgctggggaagggccacccacctcaatcgcatctttaaactcttcatctggctcagcctcctcagcctcctccacgctgcccggtgtgaggtcctgggaagagagactctatgacagaaggagaaggatggcagcgctgctccctaaggcagaggaccacctccccaagccagcatccaggctacccaaaacaccacgaaatggcacaatggcaagaaagaaggaactcacaggaaggagcaacctctagcctggcagggcgggggagatggaaacacgagcacagctggccctacagtggccacatcgcacagtggttgaaggcacgagctctagaaccacagggctggggtcttagacccagccctgccacttaccagccactctgtgcctcagccttctcttccacaaatgagaatgatctctttctcagaaataaccagcctggtgcagtggctcacgcctgtaatcccagcactttgggaggccgaggcaggcacatcacttgagcccaggagtttgagaccagcctgggcaacatggcaaaacctcatctttactaaaaatacaaaaaaattagctgggcgtggtggcacctgcctgcagtcccagctacccaagaggctgaggtgggaggactgcctgagcccaggagatggaggttgtagtgagctgtgattgccccactgccctctagcctgggtgacagagggaggccttatctcaaaaaaaaaggaaaaaaaaaaaagaaaaggaaagaaagaacctgcactccatgatgtgaatatctatctataaagcacttggagcagcatctgacacagggtaagcactcagtgaagcatggagtagctgtttttattacaattattattattgaacacttcaggggagttaaggcctgggaaatagcaggaactacaacagaggccagcccaggagccaaaaacaagctgataacaggggggcccacaagcggccacagcaggctctgccctgacagtggcacttacctccgtgggtgtgagggcaggcgtgctgtccatcagaccatccttccccccaacatctggtggtggaggactctcaaaggcatgctcttcctgctttgggttcatcctctgctgcagagatgccctgtactcagacacaactacccagggaatggagaacaaggtaggaggcaaaaatgagacaccgtgagtggcactttaggggtacccacttctgcagctggctggcctctcttcccttcactacaggaaagagtcaccctcctaactctgagcgagtcacctaacttaagcctcttaaacaaaacttagataccaccacctgccccagacagctacagagattaaatgtagtaaatgctcaataaatcatggcttctgtaataaataactctaccacagggaggaaaacaaatacagcaatcacccaaacatatgtacagactcgggcctctgcgactcagtgcctctccagactgcctcagcgctttagaagccagacaacagaggggtattctgggatcacacagagatgtggtagcaactccaggtggctgcaccccaggggatgggtggcagctttgggaaaaacatccttccctcatcttccagaagccatcatatcatataagcagtgattcatctgccttgggaagggagcgaagggagatgggagcccaatggtagcagcctcccctggtgagattccagcttcatctaacatctcagagatgcagagcccatgagagaggaccccagtgtggtgttgcacttgtggaagcacagcaaactgatgattagctgtagagacagaagaactggggagcctagcctagccctcagagccagcttgggccccatctttcaggcccttcagggcttacctcggaagaactccacattccccagaaagagcgtgctgtttaaaagggtgagaacccagcagagtggcagcaaatacagcatgcagactgtgcccagaagagccccatagaacctggatgacagggaagaaccacaagatcagaaattcgtaacagcagaaggagacgggtttggagcacacccacagcagggtccaggtgagacacagctctgggcacattaataaactgacaagagccgctcatcaaaccagcggaaaatggcgatgaagactgagaactatcccaagtcaccggtgcaaacacctgatgctggtgaggccaaagtggtgtcagctggtggcacataaactggttcaaccatcatcactccttaaggtctagactctgaagtctagagtaagacagactgggatttgaatccagctctgccacttctcattctgagaagtctcttggttctctgggcacagctcccttcccgtgtaagatggggactgaagtagcgcctacctaatggagttactataagagtgagataatacagagggagtgttgagcagtgcctggcaccaggtgaacacaacaaacattagttatcactattattcatattaaagagcctcaaaaacacccattctgtttgatatggtagtttcatccttgaatttactccaagaaaaattttctaaaacattaaagctaaatccataaaaatgtttaccatggggttagtaatgaaaagggaaattgactaaatctgtaacagaatggtttcacaaattatatttgccatctatattaatctggtattataaataattccaaaagctatatagcaacaaagaaaatcatctttaatataatgataagtggaaaacaaaagaaaaattgaacatacactatgaaactatacatccgtaaagtagatgcatatgacaaattctagcaggcaaaacaaacaagagattcggctgcatggtggactatatggtgagttatttttctattattatttttaccacacataaaagcaagcatctaaacaaaagcagtacattagagcccgcaagcatatgtgcagatatacacacaagagcccaggaggcgagctcttcccctgaggtaagaggggcagaggtcctctcaaggcagctggctttgctcgggctcaagctgcaaattcctatagggtggtggcgggagaggaggggtcactcactgtgaggacacgacggggttctcccagtgcagcacgcggtaggcggcttcacatgtgcagcacaggcggctcaggaaggcctccagctggatcaagctacagacacaggggctttggtgagtgggcaggacagaagccctgggaagtggagcctggggccttgcaggtacagttggctagggatggtcaatctctttaaacacactcaccatgtgcttaaagagagaggagtcgagagagcatgggagaaacaggcctggctaagccaccccagctacatttcagtcccctttttggagcctcttgctgaggtggaaacagtataaatgttcctgctttggtcttctaactgttgatgtcaggcaggctactgaaattctccagggctgtggcttctttatctataaaatgaggatcagaggacccacctcacgggtacacagcagctgtcagaataaatggcatgatattctctacctgggatgtgaaacagactcacttggggagttctggttgttgtttttttaaacatggatgaaccacagaagccatgagcacaatctgaacccagatctgggtttctgaagggaaaccaggaaacatggagataagctgattccagggctggggcagggaagtataagatgaatttgaccatcctgttgtaccataaaggaagcattcaaaaatgacagggaccaatgcaaacaagagccaactcaaaagagctcctactggccaaatctaggacaatttgagatcaaaataaataatgatagtaatagattctaactcatcaaataaaatataaatctatgagttcatactgataatagtaagaaagagcttccttatagtagaaagccagctaaaaaaatgtcgatagaataattagaagatcatctttgcaaccatcatagtaataaactgattaaggcaagacccatcaatggatttttaaagcagtggataaatgtttgatgaggaacaagatatttacatagtctcaaagtatctcccctcaaattactactaatgaagagtaaaatgataatttacagtatggatgccttaaccaagtgatcaaagtcagtatttcctgacatcaggtgcctcctgatacggatgtactgaacatgacacatcacttgtcacactctaaatctgatcacaaggaaccaaacaatccaaaaattagggagattctacaaaataataagcttgtactattcaaaaatgtcaaggtcacaagaaacaaggactgaggaactgctccagattaaagaagactaaagagacataaaaaaattaaacatgatgtataatcctgaattggatcccagatcagggaaactgatacaaagaactttattaggacacccacactggctcacacctgtagtcccagcactttgggaggctgaagcaggaggattgctagagcccaggaattcaaggccagcctgggcaagacaatgagaccctatctctacaaaaaaattgttttaattagcagggtatggtgcatgtgcctgtggtcccagctactcaggaggctgaggcagaaggatcacttgagtccaggaggttgaggctgcagtgagccatgatcatgccactgcattccagcctggatgacagagcaaaactccgtctcaaaaagtaaaaaaaaaaaaagaaaaaaggaaaaaaattaataaaagaagaaaaagaactttattaatacaactggtaaaatccgattacgaattatacattagttatcaacgttaagtttcctaattttgattacagctctgtggatatttaagagaatgtccttgttcttaggaaatacacgctgaagtattaagtcacgtttgcaacttactttcaaatggtttaggaaaaagaaaagaatatgtatatgtagagagatagacgaagccaacatggcaaaatgttaataattgttctatctgggtaaaaggcattcttggtattattcctgtacttctttaagtttaaaactatttcaggctgggtgcggtggctcatgcctgcaatcccagcactttgggaggccaaggcaggcagatcacctgaggctgaagttcgagaccagcctggccaacatgatgaaacctcatctctactaaaaatacaaaaattagctggacatggtggcacatgcctgtaatcccagctactctggaggctgaggcacgagaatcgcctgaacacaggaggcagaggttgcagtgagccgagatcacgccactgcatttcagcctgggttacataacaagactctgtctcaaaaaaaaaaaaaaaaaatatatatatatatatatgtgtatatatatataaaactatttcaaagtaagaaagtcttttttaaaaaaactacatatccaggccccactccagataactgactcggaatttctggggtgaggcccagccatctgtttgtttataacttttcttgcccctattctatttcaagagaatgcagagaccccactccagggaagggaggtgtaaacgtccactgctactgaagttgttagatgaatatttttcaagtcttaaaatgcttcctcagaagtaccagctctgtcatgtttacgaagtttctccacagtgtagtgatgataactaatatctactcaacacttccccagtacaagacacctgttcaatcttcacaaccaccttctgagtaagccctgttatcattccatttaacagatgagaaacttgagacacacagaggctaagcaacttgcccaatgttacacagcaagtaaatggaagagctgggatttgaacccaggcagtggcttatacatgcacatgcttagtcaagaccctaaactgtctctccagcagaaagaacagggccaggcgtggtggctcacgcctgtaattccagcattttgggaggccgaggcgggcggatcacaaggtcaagagatcgagaccatcgtgacaaacatggtgaaacccggtctctactaaaaatacaaaaaattagctgggcgtggtggtgtgtgcctgtagtcccagctacttgggaggctgaggcaggagaatcgcttgaaaccaatggaaggcggaggttgcagtgagccgagattgcgtcactgcactccagcctggacaacgagagcgaaactctgtctcaaaaaaaaaaagaaagaaagaacagaagctgtgaaaacaaacagctagatcgagattctcatcccagcttggccactttctagctaagtaagtcagcctttttctttacccataaatggaagatgttaatattaactacctcccggaactgttaaaaaggttaaatgaagtaacagctgtggtttgcctaatatgatgtcgagcacacaaagctagcacttagtgtcatggctgctgttactgttcccccacctccctggcctctcttccatactcacaagctcttcacctcagccacggcctcgggacgagacaggcgacctctctgcaggtcctcctgcctcacgctatgatacttcctccgcatcagctcggaatcaggcagccgtgcccggcaaacctcctgaaggtagcccagcagggcgggcactgaaatcatcagggcacctactgagtaccatgcacctgcagaatcaaaaacactgcaggtaacacaggtaagcaaagaccaggagtcggcccacccagacgcccactgcttgttcctcacctcctccagggctctgccagtcaggccttccctgatagctctgtacgacacagtgtctcacccctactctccagcccccttaacccagcttcattcctcatagaccttatcaccacatgacacattgcaggcatgtctgttgtctcctctaatgaagtaagctcttgagggctgggactttgtccctttggtcactgctgtggccccatcctcacttttaatacgttttaagatgctgctagcacagaggaggctcacgctggagtgtgactgccaggagctcctgatgcctgacactcggacctctgggccactaaggaagctagaagcctttcgttcagcttttaggacactgcagacgattgtgccttgagaaatggcgaagccgagataaaattcaaagaaagaacttcttccatgtaacatggcaccccaacaacaagctaacagagcagcgggcccataataaatgcttactaaacatctgtcataggaactgacttactttgggagcatatatagaaaaatcaaacatcctaggaagttttgaacaggtaaagatgagtccaactaagaaacagaaaatgagatcttatatgaactggatttattttcaacctactcaatccctatctccagaggaaacaaagaagacacctgagaaatacaaggtaagtaaaagaacaaaaacatgaataatggcccagctcctccaaacattctgtcccagactctttattctcaccctgaggggtttggctttttatgtggccatctgccagcgccaaccacggatagggtagggtcacggtatgcactgtagtaagaggttcatagaagacattacccatgaccccaacagacacccatgtgtccacacttctatctcaaaggcttcatgccactcctcactgctggtgactgcccagcagctcccgttaggctcactagctgaaccagagaaaagcaacagatatggcaaaaatcccttatcagctcctcatcccagtacctttactcatgccatgtccccagatgacccttgaatcagcttaaaaaccaaaatggaaaaaggtcaatgcatcctcagcaggaagtcaagaaggaaacaacgataatactgagagcagctacaatgcactggctgcctcttccacgccaggcactgtgctaagtattatgcctagactgccgcattcctcacaaatactctaggaggaaagcgtcatttttatcctccctctagaggtaaggaaaattaggccttaacagggaagttcaataatctgcccaaggtcacagcaggcagctcagcctggatcgtccctctggaggctgtttctgactccaagcagacacagaggaacactaactccagggcaacaagagcagctcccacacatagggtggggctgcatccaggtgttcttcccccacattcgttcacaaaaaccactggcccctgaaggcagttcttaccctcattcaaagtgaggaacaagacgttgaggcccaggcaggtcagcaaggaacacaaaggcatctgccacctacaatacagagagtcctgatcactacagagagtcactcctccagctggggaggggagaccaggcagcacagacgggacatcaaaccagaagaggaggcctggaacacagaaggtcaaggagaaacgaaaagggggcctctcacttggactggtgaccaggagaggcggtaagatgtcacacattagcacctggggtgaggaaactggtaggtctgtagtgctttctcccaaaaggaagaagaatttataaaatatcagttaagaaacccagttaataccatttaacctgtgttttgtaaggttgtattctccttaagaggtgacactgacaaatgttcttaatattttcctctattctttttttataatttcataagaatatataatcattgcacaagattcaactaatacagaaatccagaaaaaacaaattgtggacttctttggccccatttgtgcctttatcttcttatgtccatgtttttgaaaatttgagagtttatctgagagtttattttgaatacctattaattcaaaaagagaaacaatagtaaagattttattttaatatattaaaaatcaagatgaaagtagggtgcagcattcacttagcaatcacaccttaagtgagctggaacagacagaagcaaacacagatacatcactgccaccaccaccaccaccaccaaatggcaatgcagaagcccccaaacagggaacaaggaagaccagagactcagattgctgagaacaagcaaatgctgctggctccgtccctgataaaggacatttagtagggaaagaggagcacagatgcaacaatgaagccacgacacccaaattctaaaggcagtgtcaatatataggtgagccactaggagagagacaaacatcagaaaaataaacaggtaaattgctggcaagcattgaatgtattttctttttttttttttttttcttttgagacagagtctcgctctgttgcccagactagagtgcagtggcacaatcttggttcactacaacccccgcctcctgggttcaagcgattctgtctcagcctccctagcagctgggattacaggggcacgccaccacacctggccagtttttgtgttttcagtagggatggggtgtttcactatgttggccaggctggtctcaaactcctgacctcaggtgatctgcccaccctggcctcccaaagtgctgggattaaaggcgtaagctaccgtgctggggctaaatatattttcttgtgctctggagtatttcagagttactgaatgaggttaactaattcatgcagggcttttacttttttttattattatacttaaagttctgggatacatgtgcagaacgtgcaggtttgttacgtaggtatacacgtgccatggtggtttgctgcacccatcaacccatcatctacctcaggtatttctcctaatgctattcttcctctagcccccacccctcaataggccatggtgtgtgatgttcccctccctgtgtccatgtgttctcactgttcaactcccacttatgagtgagaacatgtggtgtttggttttctgttcctgtgttagtttgccgagaatgatggtttccagcttcatccatgtccctgcaaaggacatgaactcatcctttttcatggctgcacatagtattccatggtgtatatgtgccacgttttctttatccagtctatcattgatggacatttaggttggttccaagtctttgctattgtgaatagtgctgcaacaaacatacatgtgcatgtgtctttacagcagaatgatttataatcttttggatatatacccagtaatgggattgctgggtaaaatggtatttctgcttccagatccttgaggaatcgccacattgtcttccacaatggttgaactaatgtacactgccaccaacagtgtaaaggggcttttactttttaatgaaatttatgagtaagggaatgaaatgacatctgtgtctttctcctgaaattcaacacactccacctgtaccaccctaattacgcctcagaacctctagtggcagctaccagggtaaaagcgaaataaaagccaatcccattttggaaataaaaacaccaccactcaagtcactttcattttaaagcctcttcccttctataaaatgtctttactgacactttggtcccaggagacccaagcagtagagtagctgatcccaggagagagtctgttaacaatttactgcagctctaggcttcagacctaatagccagagcccaagattaggtccctcttcaaagtcaaatcctctttactaagaaaagaacaatcaaaagcacaaactaacgtgacagccactttcacggaccagtgctccctctcccagcagcacagaaactgcaggctcctgggggcttttaagtccaatgctcctcctgcatcctgctttaaccaatcctaccacatcctccaatttttaattccataaaatggaaaaaccctaacacattagtgtgctaagacgcactacggactagtagaggaaaaggagacgggcaggacaggatacacttaactttcgtactttgccacaaagagcaacacacacatacaaagaatgtgccgggggcacagcctctctcctaaagaagaccaaacttcacatcatgctgagattataaaaggagaaaacagcctctcctcatactgtctccctaccccttgtgggaagagcacagtgatcttacagtagagaacacagctctggaacactgactagctcacctctacggatacagacataaattaggtgaacaagaaaaatgtagggcctttgccagagaactagtaacaaaacatccactatttccagactgaggcatggataaatactcaatggcatcctcagaggttaacgtaactccactcaccctgcttcctaccagtctctctcatgtatttcagaggactgagggtctttatgagaatctgatgaaaaccagaagcttttccctagaaatatacacatgtgcagacacataattttacatgcagtttcaggggattcactgatccctaaaactcacccataggctccaagttaaaaacctctgctctttaggacaatcaggtttttgtgtgactcctgatgcaatgcaacaccaggggcacaacatttacctttgcaaaaaaaaaaaaaaacacttttctaacttcaatcaaatccaacctttaaatctaacttctagtctgcaccacaaggaagaaaccagacaaatctcggtagtaaattctccaggaaagtcagttcaggctcagtctcttcagcaaatcaatgtcacgagagagattgtcttagactgaaaaaagacttaaaagacataataagtacaaacaatgcacactcctggactgaaatgtgatttagccaaaagagatggtacaactgaggaaatggaatatgaactgagtataggatgacatcaaggagttattaattttgttaggtatggtgttactttgatcttgaaagaaatgtccttatttagagataaaaactgacatatttagggagtagaatgccatataagtaatttaaaataattttaacataataaaatgagtcaaaagaaaaaatgaaaattatagagaatgaaaatcaaagcaggataggagggaaaaagttaagatccataatctcaataaattagtaaaaatgggctgggcacagtggctcacacctgtaatcccagcactttgggaggctgaggcaggaggatcacttgagcccaacagttcaagaccagcctgggcaacacagtgagagcctctctacaatttttttttttttttaattagccaggcatggtggctgaggtaggaggatcgcttgagctgaagaggctgaggctacagtgagccatgttcacacgactgcattccagcctggacaatacagcaagattctgtctcaaaaaaaaaaaagtagtgaaaatggtatctgcttattcacaggtttttgtatttctttaatttttgttcaaaattataccctaattttttaatattaattatgctaatattgggggcaaaggaaaaaattaagcctgctctaagctgtagaaggcgtgatgttcaaggttgtccagcagtccagaggaaggagcttattcagtcacaaagaagaaccttgctgaaaggcaggatcattcccagtatctgcctctcctgggctgggcctgagacacagggtaggcctagataaacccagaggccgaacagacctcccagaactgctcctcactagggcagaaaggacagcccagccactgcctaaatggtcagtgttagttactacagagcaggacggcagaaggcagagcagaccagagcaactccacaaagtctgtacctgagcaagtatcgaacaccatcacctgcatccttcaagggttccaggtagatctccagcctcttgtaggagagaaccaagttgaaaaggtcaaacgctggggacttggtaggaaaaggtggagactccaggggagcctcgggcatcacgctggggctcagctccggcccactcccctcacgttctgatgtctgcattctgtaaccataataattcccaacatttgcattgcacgtctagtcctcaacacaattctacctacagattcaggtggtgccaacagtaaacctgtgagcaagggaaagtgaactattcagacctaaaatcctgttctttgtactctccatccaatgctcttttccccaaagatccatcaaaactaaaaatcataaaaaccaagcataaatgatcgctgcagcgaggcagcccatgggctgaaatgaaatgatgtcctggaacatttttctcccactctttacctggttaattcctactcatccttcaggtatcagcttaaacatcactcccttactctgggaagtctctgccaacacccccaactctggactgggagaccctctccgatgctcccaaaggatcacgtactcaccctaacagagcacttatcacatcccatcgcttcttggccttgtggctaagatcaagtgcagagcactgaccacgtcaaagtaaaactccctgctcttaactggcctccattcacgactgcttctgtacacagtgggtgcttaacaaatgcctgctgaatgagtgaatgaaataccgtgctccaggactctcgcccgatcctctaactcttcccactcccttcggttcccaacaacttcctgggccatctctgccccagggcagtcggcatcagaacgccccattcccgtctgccctttctgatgaggaaaccgaggagcctttacggtctttcccagttcaaagtcctatcctgaactctaagcagcaaacgagggggcggaacctcggcgaagagcaacataaaccagtcccaggcaatcagccgcgacctgatgggagggtgaggggatgggacaaaggggccaacgggaccccgaaatccccgcaggccgagccaaggcgaaagggcacagagcggcgccaggtatgagcccaggaaggggcgaggtatatcgacgcccgcactggccttggccaacacctctgcagccaggggcgcctgatggagcccgtgaggctggacagggaaggccatgcccgaggtcgtggggccagcatgtggcggcccccgctgcgcccaagcacccaactacacacagcctgcggagacactgggacgcggggggacggcacctcacctacccggccgctggctccgtgagggaggcggcagggtcgggcaggagcaggggtagagccactgggccccggagcgtttcttcaggcctcccccggctgaacgccgctcctcctgccagggttgttcggaagtcgcaggtccgaaaatctcctccgcctacgccgcggccgccaccgccgcttccgggacgcgaatcgctctgcggctgcgtcctcatgacgtcatcccgctccgggtttagctccgcccaccccagcacaggcaagcacccttgccagcagtgcgcctgcgcgtctttcccgcgcgctccaggctggagttaattctgtccttggccggccgccgttcacaaagccttgaggacccttggaagcacgtgcttggcgaccctgcagctcgttgccctgccttgccgcagggaacagttggcgagaggcttaaatgaagaatttacgtcttcatcctctttccttccaactttggaactgaactggggactgtgtgtgagccccggaaagacaccgtatcctgtatgagatgcccagcagagcatgcagttgtttccggagtagctagtgtgtacaaggtcctgtgcaggcctctcccagctcagttcacttcacaccgtgtggcccagttaatttcccttaaagcacacatccgatggctttatactagtgacttagcgctcaggtacagaggagccaagcactgaaccggactgagctctttttagacattatctagttctcctccaacgaccctattagggttgtcgccattttacagatggggaatctcagacgtgttaaggaacttctttagagtcacagctaagaagcaaatgggagctggaatttgaagcttatgtgtcatctgaccccaacgccccaaccataccaccacccaccttggtctgcatttcctggtcttgtctcctgccatctttcagctgcctttaactttggccaactgaacccctccactgttaccctcaaatgcccctggcactcaaatgtctgtatcccttccttgagtgccccagctggaagtaatcacttccctcttcaagtagccacagagctttaactgcatctcttcctccattatctcctttcagaaagacaggcccatccctccagccaggacttagctgtgctccagggtccaactcttatttccttagggctttgctctaacaggcctgaaatcttgactctcgctaactcttaatcatcattctagagacaaaattcatggaaaatttctcctttagcctaactttaccccctctttcctacatgagttggaagactcactgtgaagtgctctctaccgctgcttcctcgcccaattcactcctcactgcactgtggtcctgctcccctccatatttctgggctacctgcctgctcacctgtgacatcctggctgctaaatccaatggacacttcccagtcctccttgcagatgacctcagaagcactggaatctctttccttcttggcaccattgtccaccttagcttccatgacaccaccctctcctctctttccgaccttcaaggtctccttagggcttttcttcctacccctcaaatgctggggctccttttgctacccttctttcttctgactcaaggcactccgtgaggatctcattcactcttgtggcttctgtcagctaatgtttcgtttcccgtgtctatgtctccagcacctaaagcagtacctggcacatagtaggcattctgttaagaagggttgcaagatgttaccattggggggtagtctgtgggatcaccctgtgttagttcttataactatgtataaattgacgattgtcccaaaagtaaatgcttaccctgtgtaggtatttttctcaaagctccctgctttagttgactttgtcaattacccggcatgcgccagtcccaacataagtaaggtaggagggcttctcctcagatgaattgcttggttggtttttccagctgtaaaatggggataaccatagtggtaccctcagtgtggggctgtgatgagaattaaatgagctaaagtatgtaaattcctgacatgttataagtgttcaaaaatcgttagcaatcattgtgatttttatttttactcaaagccctaccaccaccacccctagcccaaaaatcagacaagaatccacgaaaggccaaaatgtagaaagatccaattcccacacatatcactaagccatatacagaaatccactcaccaccccttagagaaatggactgagctttgtggtggtccaggcccatctgctggactctgcctctcctcccttaggatgggtcttttccccgaaagctcctgggtctgtcatgcagatagcctctgaaggcccctcttcttcgtttcctaacctggcctcaggtctgaattccaggataggccatcgccactccccacccactcccatcccccaccctgtccacccctctgtacctttctcagaccactctcttggtggatagtttcagtggccccctgtgacctccaggataaaaccaaagcctggtgtattcaactctggcagttctcggatatgtcacaccttctcccattactgtacctttctacagactactctcaccttttttttttttttttttttgagatagagttttgctcttgttgcgcaggctggagtgcaatggagaaatcttggctcactgcaacttttgcctcccaggttcaagcgattcttccgcctcagcctcctaagtagctggaattacaggcatgcaccaccatgcctggctaattttttgtatttagtagagatggggtttcaccatgttggctagactggtctcaaactccttacctcaggtgatccacctgcctcgacctcccaaagcgctgggattacagacgtgagccactgcgccccatattctttagttggccagctcttattcttcctccaaaattcagctcagatctcacccctgaagaaagacttctctgacaccttccccatcagcagccactgtctggattacgtgcccttctgacttggctccgtgggcctgccccaccccagcacttggtgcctcctcctctctctagacagtgagagtcctgagggaactgcctataatttctgtgtccagcatctagcacaaaggaggtaccaacaaatgttccttgaatgagcgcatgcgtgtcagtttcctcttggagcacagaattcacatctctttcaacaaaagccccagaacaatgcccatttcttttttctttttcttatctttctttccttttttaatgtaattttattttatttttgagatagggtcttctgctgctgcccaggctgcagtgcaatggtgcaatcatagctcactctaattcctgggctcaaacaatcctcctgcctcagcctccagaggagctgggactacaggtgcacaccactaacacctagctacttaatttttatttttatttttttttgaaacggagtctcactctgtcatcaggctggagtgcagtggcacgatcttggctcactgcaagctccgcctcccggattcaagcgattctcctgcctcagcctcccgagtagctgggactacaggtgcacaccaccacgcccagctaatttttgtatttttagtagagacggggtttcaccatgttggccaggatggtctcgatctcttgagctcgtgatctgcctgcctcagcctcccaaagtgctgggattacaggtgtgagctaccgtgcctggccaattttttttttttttttttttttgtagaatgaggtgttgctatgttgcccaggctggtcatgaatcatttcttaaaacaatgactgtgaaaccagcaagaatgaactggacagaaattctaccctctatgaactcttagttcaacagaagacgctgacttgactgagccatgatataaagcaggggattctactgtaaccgtaggagcagagagaagaggcagacttaatctaagtgagaggatggggaaagttttgtgttcaacaatgtagtatttaagctaaggagtccccacccttcttaagaaaaataaatttttttctttaataacctaagtaccggtcaggcacagtggctcacacgtgtaatcccagcactttgagaggctgaggcgggcagatcacctgaggtcaagagtttgagaccagcctggccaacaaggtgaaaccccgtctctactaaaaatataaaaatcaggccgggcgcggtggctcacgcctgtaatcccagcactttgggaggccaaggtgggcagatcataaggtcaagagatcgagaccattctggctaacacggtgaaacctgggctctactaaaaatacaaaaaaattagccgggcatggtggtgggcgtctgtagtcccagctagtggggaggctgaaacaggagaatggtgtgaacccaggaggcggagattgcagtgagccgagatcatgccactgcactccagcctgggcgacagagctagactccgtctcaaaataaataaataaataaatataaaaattagccgggtgtggtggcgcgtgcctgtaattccagctacttaggaggctgagacagaagaattgcttgaacccaggaggcgggggttgcagtgagcggagatcgtgccactgcactccagcctgggcgacagagcaagactctgtctcgaaaaaataataataatatatatatcctaagtgcctgaaattctcacactggtaatttactccaaaggtaaattttagtttctttgcaattcctcctccttggcctcagtctgacagtggagagtaatagtatttgttttctcttccagcagctatagaattgagagatattattcaagaatttctagacattatctggagggaacattggaggatacaagaaggctttaaaaaccagaaagggacaatagtcgtggcctgtagcgatgaataaaggcctccccttataattaagagacggaccagcttgactgtgctctctcgagtctaattctgatttttccataatcaagttctagttccttctttccctcctgcagcattctgcctcaactcctggtgctgctgatgttttcccctcggtagcagacaggtagaagagactaagggagaaaattaaataatcactgaagataatatcttaccttgacattttgcagaggttagtatttgcttcaataagcaagtgtgtttatggcccacatacttgactcataaacctcactgtggcccttggagaaatactaggtggaaatgctgaggagaacaggctggagaaatcagggaagagagaagggaatgtctaagcatgcctcctccaccagatggctcccttgcccactcttatggagaaacatggcatttcagaagcatctctttcaactccaagtttctggctttaacctctcgtgccagcctcaatgcatttctcgccatttccacactatgccagatattttcatgcttctagctgcattagttatctcttgctgtgtaatgaagtatttcaaaacttaattacttaaaacaacaataagcatgtattatctcacagttttttgggttctgggtgtttttagtcagaaaatcaagagcagcttggtgatggttttggctcaggcgctttcataaggttgcagtcacatgttggtcaaggctgcaatcatctgaaggcttagtggggctggaggatcggctcccagggtggcttcctcacacagctgacaaggtgatgctggcactctccaatagtgacaagatggcagaaggtgccaggtcctccctcggggctctcctgaacgcttcttgagtgtcctcctgacatggcggatgccttaacccagaacaagagatccaccagggagccaggaaggaagccaaaagtctcttctgatgcatcctcagaaatcacacgccgttttctttttttcttttttttttctttttgttgttgttgttgttgaaatggagtataactctgtcgcccaggctggagagcagtggcatgatctcgactcactgcaacctctgcctcctgggttcaagtgattctccagcctcagcctcccaggtagctgggattacaggcgcccgccaccatgcccgactatttttgtatttttagtagagatggggtttcaccatgttggctaggctggtctcgaactcctgacctcgggtgatccacccacctcagcctcccaaagtgctgagattacaggcgcgagccaccacgcccagcctccatctctctctctttttttttttttaacttttatttttgttttaggggtacatgtgcaggttggttccatagataaattccatgtcatggggattcagtgtccatattattttgtcatccagttaacaggcatagtatctgtgtatttataggtagtttttcaatccttagcctccttcaactttccatcctccagtaggccctggtgtctccctggtgtctgttcccttctttgtgtccgtgggtattcagtatttagctcccatctataagaacatgcagtgtttggttttctgctcctgtgttagctcacttaggataatggcctccagctccatccatgttgccgcaaaggctatgatctcgttctttttacggccttggtatatatgtaccatattttcttcttcttcttcttcttcttttttttttttttttttttgagacagggtctcactctgtcacccaggctggagtacagtggcaccatcatggttcactgcagccttcacctccttgggctcaggggatcctcccacctcagtctcccaggtagctgggattacaggcacgcgtcaacaagcccagctaatacttgtattttttttgtagagccgggatttcaccatgtttctcaggctggtctcgaacgcctgggctcagactatccacctgcctgggcctcccaaagtgttaggattacaagcgtgagccacagcatccggcctgtaccacattttctttatccaatctaccattgattccatctctattaggcacctatcaccttgcatttcactctatctcttgaacatgactgtttctccattgtttcctaagttctaagagcagggaaacagatttaacattttggcagcctcagtttctaccaagtatagagctgtggcatagtaggtactcaatgaatgcttgtttaaaaatgaataaataacatggaaaataagaagttagtgggggctgggcatggtggctcatgcctgtaatcccagcactttgggaggctgaggcgggtggatcatgaggtcaggagttcgagaccagcctgaccaacatggtgaaagctcgtctctactaaaagtacaaaaattagctggtcatggtggcgcatgcctgtaatcccagctactcaggaggctgaggcaggagaaagcttgaacctgggaggcagaaggttgcagtgccactgcactccagcccggacgacagagtgagactccgtcttaaaaaaaaaatagaagttggggatgtggagaaatcggaacccttgtgcactgtcaatgaaaatgtaaaatggtatagaaagcattgtggcagttccttaaaaattaaaaaatagaattaccatttgatccagcaattccacttctgagtatatacccaaaagaatttaaagcaaggtctcaaagagatatttgtacacccatgttcattcgcagattattcacaatagccaaaaggtggaagcaacccaggtgtccatcagtggatgaatggataaacaaaatgcggtataaacagaagatggaacattattcagccttaaaaatgaaggacattctgacacatgctacagcatggatgacccttgaatacattatgctaaatgaaataagctagtgacaaaaagataagtactgtatgattccacttctatgaagtacctagcgtagtcaaattcagagactgaaagtagaatggtggttgccaggggctgtggggaggaggaaatggggagttattgtttcatggttcagggtggtagttttgcaagatgagaagagccatggagatggatggtggtgatggttgcacaacagccagtatagaccatgttgtttaacaacatgaatggacttaataccatcgaactgtacacttgaaaatggtcaattttatgttatgtgtatgttactacaattaaaaaaattttaagaggctgggcggtgtggctcacgcctctaatcccagcactctgggagacaaaggcctgcggatcacttgaggccaggagttcaagaccagcctggctgacatggcgaaaccccatttctactaaaaatacaaaaattaaccaggcatggtggcgcttgcctgtaatctcaactactcaggaggctaaggcacgagaatcgcttgagcctggaaagcggaggttgcagtgagctgagatcgcgccattgcactccagcctaggtgacagagggaaactctgtctcaaaaaaaaaaaaaaaaattaaagccgggcacggtggctcacgcctgtaatcccagcactttgggaggctgaggtgggtggatcacgaggtcaggaaattgagaccatcctggctaatgcagtgaaaccccgtctctactaaaaatacaaaaaattagctgggcatagtggtgggcgcctgtagtcccagctactcgggtggctgaggaaggagaatggcatgaacccgggaggcggagcttgcagtgagctgagatcgcgccactgcattccagcctgggcgacagagcaagactctgtctcaaaaaaaaaaaaaaaaaattaaaaattagtgaatgatataaacaaaatatattctatccgttcactggaatattattcaccataaaaaatgagtcttgagatcatattggaagacaaaaaaagaaatgagttattaatacatgctacaacatgaatgaaccttgaaaacattgtgctaagtgaaagaaaccagacataaaagccacatactattccatttatgtaaaatgtccagaataaacaaatctttttttttttttttttttttttgaggcagagtctctctctgtcacccaggctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggttcaagtgattctcctgcctcagcctcctgagtagctaagattaccaggcgcccgccaccacacctggctaatttttttgtatttttactagagatggggtttcaccatgttggccaggctggtcttgaactcctgacctcaggtgatcttcccacctcagcctcccaaagtgctgggattaaggcacgagccaccgcacccagccagaatatgcaaatctatagagacagagtaaattagtggttgccagagactggaaggagggaggaactgggagtgactgctaacaggtacagggtttctctttggggtgatggaaatgtcctcgaattagatggtggtgatggttatacaaccttctgaatatactgaaaaccactgaattgtacactttaaaactaggaatttttggccaggtgcaatggctcacgcctgtaatcccagcactttggaaagctgaggcaggtggatcacctgaggtcaggagttcaagaacggcctggccaacatgatgaaactccatctctatgaaaaatacaaaaattagcctggcatggtggtgggtgcctgtaatcccagctactcgggaggctgaggcaggagaatctattgaacccgagaggcggaggttgcagtgagctgaaatcgcaccactgcactccagcctggacaacagagcaagactctgtctctaaataaataaataaaaataaaactgggaatttttatgtcatattatgtgaaatattatggtatatgaactaggtttccatttttaaaatgaatagatgcaacaaaacaaaaaaagaaagaaaaaatgaatagacaaatgaaagaaatatttgactggtatgtatctttaaagtctccttaatatttggattttctctagtatttaagcttatcgtttgaccagtgtatatttttggattaacagttcagtgtcattgccctaaaaagtgttcaataaatacatctttatgttcttgtacctgggaaagaagtactcatgagtaatgagttttccagctgtgagacagtggttgttggacaaacacagcaaggaaatgactgtctgcagttacattcttactcaacagctcttggcagccatgaaaacaaccattcatcaaacactggcactaaaagagttcacagagcaaggcaatgaaaacttcagcaataaaaccttgtgcctcccttgaaagcgacgattaactgtccaccaaaaagtcctgtgccccctaccatgatatagagttgttgctacgcagcagctgcctggctagggactacatttcccagcatcctctgcttataggtcaggtcctgttactcccaaggaggtgagtgggagcgctgactgttacttctagatgaaggtatgcaggaagcaggaaaccttctcctgcctctcctccctcacctgcgagctcagtgcagagcagatggccgagccacggggtggaaggagcctgggtccttgagtcaccgtatggtggagcgtctccctctgccccagagtagccacagtgcacaattatgtgaggaagaaatagatttgtatatgaataacaaatagattttcattatatgaaactgctgaaatgctgaggtgtatttgttatagcagctagccatcagcatttattcattccaccaaatgactacgtatcatgtgcctttcatgggattatagagatgaagagcctggaattctttcctgaaaagcttacagcctagtgggacagacagacaccctgaataagtataccaccaatgggagagcagtacgtgacccaccaaaaaacctgaatacaccaactatcatttacaaacttgaaagaattaaaaataaaaagaaataaaaatgtaaaacccaaaaggcatcaggcccagatttatttcatagacaaattttatcgaacccatttttttttttctgaggcggagtctgtctctctctgttgcccaggctggagtacagcgcgatctcggctcactgcaacctctgcctcctgggttcaagcagttctcctgcctcagcctcccgagtagctgggactacaggcacctgccatcacaaccagctaatttttctgcttttttggagaggtagggttggtctctactaaacttaatggtctagtaaataaatacataaagatgtatttattgaacacttgttgaccaggctagtctcgaactgctgacctcaggtgatttgccccccttggcctcccaaagtgctgggattacaggcatgagccaccgtgccagctagaacccattttttaaaatgatatagttaaactattccagagcatagaacagtatgaaaaacttcctaatttagtctgtgagtccagaatcaccccctctgttacaaatcccaagcaagaacacacacacacacacacacacacacacacacacacacacaccagatttcatctggggtatagacaattttaaaataataaaaacaataagcctaccacacaaatgagccattccactgctagctgtctacccaaaataaattaaagcatatgtgtccacacaaagacgtgtacatgaacgttcaaagcagctatatttgcaataaccaaaaatttgaaacaacacaaatgtccatcaacaggctaaacaaattatagtgtatctgtatattcactcagcaatgaaaatgaactactgttactgcaacatcatgaatgaatctcaaaataattaagctgagtgaaagaagccagataccgccctctcccaaaaggagcacatactatacatttcatttatataaaattctagaattctataatcatagaaagcagatcaatggttccctggtgtgggggagatgggaaggaaagaagagggagtacaaagagcacagggaagcttttggacattatgaatatgttttctttctctttttttttttttttgagacagggtcttgctggagtgcagtggcataatcatagctcactgcaacctcaaactcctgggctcaagtgagcctcctgcctcagcctccatagtggcagtaagctgagatcactccattgcactccagcctgggtgacaagagtgaaactccgtctcaaaaaaaaaaaaaaaaaaacacacacacacacacacaagaaagaattcaagaaagaacagtagacaccaatgagaaagaaggattagccaaggctggtgagattatcattccttaggtgcagggagacccagagtggaatggggcaggagggaattcacatttatgagcactaactatgactgtgggtcaggcgttgagcccagcattttatgtatatcttatgaaatcctcccaacaaacatatactgctgagggctgaattgcactgatgaaattgccaggcacgcctcatctcatgaagctctttcaacagcccagtgaggtaggtactaatattatccccatttactaagtgaggaagctaagaggcaaagaggtttcataaattgcctaagactggacaactaataagagatagagctcacctctgacatcacagcctgagctcacccaaaaattagaacgagtcatgctaactgcctgggagacacaaaaggagacagaacagagtacaggacaagattgcaaaaggcagaggctttagtatccagagtttggagtcaggtcaggtgtccacacctctggcacagggccacgagagggaggaggggctgggaggccctctgacatatccttctcacatcctgcggacagagggatggtctccagggaatgggagagtgacctcggcataataagctgattatacctaaaggtaactagctaacttcattatagcctgggaagagagaagtgacataattcagatttgtaataccttttttttaaatatatacagggtcttgctctgtcacccaggctggagtacagtggtgcactcatagctcgctacagcctcaacctcctgggctcaagcaatcctctcacttcagccacccgtgtagctgggactactgctgcatgccaccatgcccagctaatttttttattttttgtagagatggagtcttgctatgttgctcaggctggtctcgaaatcctgggctcaagcaatccccctgccttggcctcctcaagtgttgggattacaggtgtgagccaccacgcccagcctatcacccagactggagtgcagtggcaccatctcagctcactgcaacctctggcttctgtcactgcaacctctggcttctgggttcaagcgattctcctgcttcagcctcctgagtagctaggattacagatgcccgccaccatgcccagccaattgtgtgtgtgtgtgtgtgtgtgtgtgtgtgtgtgtgtgtgtgtgtgtgtgtgtagtagagatggggtttcaccatgttggccaggctggtgtcgaattcctgacctcaagtgatccacctgcctcagcctcccaaagtgctgggattacaggcgtgaggcactgcacctggcctcctggcctattctttagtctttctttcctgcattagctcaagatgtaaatatttcaaaactcggatgaagtttggatgaagtattcagatggttgggaaaaagcttgtctgctgggaaatccttgaagcagcatggtggcatggtggcacagacctgagtttgaatcttgtttcggtcagtgcgcattcaagtgccaggccacatcaacctacccctgtgagcctgtttccatgactgttaaatgggggtatttgctacttcgtggaaatgggaggataagagatgttatataaggcacccattatgttcttggctcatggtaggtccttcctaaagctacttccctttctccctcttcccagccttgactcagaagtgcttcacaactgcgtgtcagagcactgccttcaggcatcctggagatggcagcaaggataacttgcctctagctggagggacaggcaagtatgaagcctggagggtcagcctccagcctccagcagcttcctgtccccatctgtgctgcggaaggaatggcacagccttggtgcctaccagatcccaaacagccacccagttcaaaaggaatgaggtgccaggtgtggcggctcatgcctgtaatcccagcactttgggaggccaagctgggtgatcacctgaggtcaggagttcgagaccagcctggccaacggggtaaaaccctgtctctactaaaaatacaaaaattagctgggcgtggtggcacgcgcctgtaatcccagctactcaggaggttgaggcaggagaatcgcttgaaccagaaggcagatgttgcaatgagccgagatcgtgccactgcactccagcctgggtgacagagtgaaacttggtctcaaaaaataaaaaaataaaaggaataaaggaatgaggccatgaggccatggattaaggagggaagaagggccttcagattagaaaccaatctggaatttccatgggctgttgaggctggcctgggtgggtcccacagacctcctgccaggcatgtcttaagtgctcttcttgggttctgaccacctccccagcatacgttgccccaccgggcccagaaagtctcaggccctcctcatctctttccagctgcccccaccaaccctagtccctgggactcctatcctcaagactggctatggagtgggatgcagccactccagggctcctcccatccttgctactcttggcagcataagggttagaaagggcacaggcccggggaaccacctgccctcactatctgtttcctcatcactagaaaaggacccacctccttttatgggtttaattacgatctctacagggaacacccaagggactaacaaagttaaccagtgtaagaaagttataaaggttccagaaagcccatagaactcttgcagtccctgactactgtttctatggacatagagagttggaactatattattgttacatttaaaaagttaagtcgtgcaagagtctgtgtgtgtgtgtgtgtgcgcgcacatccataaatgtttgattagttataaaaactagagaggtccggcgcggttgctcatggctgtaatcccaacactttgggaggccatgtcggcggattgtttgagtctaggacttcaagaccaggctgggcaactggttacaaccctgtctctaccaaaatacaaaaaaaaaaaaaaaaaaattgctgggtgtggtggcatgtgtctgtagtctcagctacttggaagactgaggtgggagggtgacctgagcccaggaggtcgaggctgcagtgagccgtgatcacaccactgcattccaacctgcacaactgaggaagaccctgtctcaaaaaaaagaggaaggagagttaatagttaacaaagattttggtggatggatcacctcagatcaggagttcgagaccagcctggccaacatggtgaaactctgtctctactaaaaatacaaaaattagctggttgtggtggcacacacctgtaatcccagctactcgggagactgaggcactagaatcacctgaacctgggagacggaggttgcagtgaaccaagatcatgccactgtcctccagcctagccgacagagtaagactgtgtctcgaaacaaaaaaaaaaacaaaacaaaacaacaacaacaaaacacaatgatttttctctagggtatgagattaggatggtcaaggccaggcatggtggctcatgcctgcaatcccagcactttgggaggccgaggcaggcagatcatacgatcaagagatcgagaccatcctggttaacatggtgaaaccccatctctactaaaaacacaaaaaaatagccaggtgtggtggcagggacctatagtcccagctactcgggaggctgaggcaggagaatggcgtgaacccgggaagcagagcttgcagtgagccaagatcacgccactgcattccagcctgggggacagtgtgagactccacgtcaaaaaaaaaaaaaaaaaaaaagccgggtgtggtggctcacacctgtaatcccagcactttgggaggccgaggtgggcggatcacaaggtcaggagatggagaccatcctggctaacacggtgaaaccccatctctactaaaaatacaaaaaaaaattagccaggcatcgtggtgggcgcctgtggtcccagctacccaggaggctgaggcaggagaatggcgtgaacccaggaggcggagcttgcagtgagcccagatcgcgccactgcactccagcctgggcgacacagcgagactccgtctcaaaaaaaaaaaaaaaaaagaaaagagagattaggatggtcaaatgacttctttatactttttttttttttttgacactgagtttcactctgttgcccaggctggagtgcagtggcacgatctcggctcactgcaacctctgcctcccaggttgaagcaattctcttctcagcctctcgagtagctggggactacaggtgcgtgtcaccatgcccggctaatttttgtattttttggtagaggcagggtttcaccatgttgcccaggctggtctcaaattcctgaactcaagtgatccacccaacttggcctcccagagcgtgaaccacctcgcccagcctctttttactttttgtttttttcgttgttgttttgagggtctcactctgtcgcccaggtgggagtgcagtggcacaatcatggctcactacagcctcaacctcccaggctcaagagatcctcccacttcagcctcctgaatagctgggaccacaggcacacgccaccatgcccagctgatttttttcatattttttgtcaagacagggttttgccatgttgcccaggctggtctcgaactcctgagctcaagtgatctgcccacctcagcctcccaaagtgttgggaattacaggcatgagccactgcgcctggcccagcttctctttttacaaatctatactgcttacgttttttgatggtgcatattggtattatattttcatggatatatattgctattttattttataaataactattgtgaccaaacaaaaaacacgtaaataaatcatgctaaccaaacttttctctctcatattcctgctttttccttttatcattgaaaatgttcatttattaattcttgttttttaccgctgaccaccccacctccaaccctagaaaagcaggaaaagtaatagacataaaccctgagatttcccactcataggacctcattatgtctctgagaagcagtgtcttatttcaaagtgcactaagcaggaaatgccagattaggccattcctaaacacctggtctcctggaaggaaaaccaaactccctagactctctagagcctgccaaaggaccacagggcttaaagaaacctctgccttccagtccctgccctgccgctagccagctctgtgaccatggataaggcctttccattctctgggctccatttcctctattgaatgaggtggcagatgtggggggcaacaatgccaacctatgagactactgggaaggggctgggtgcagtagcttacgcctgtaatcacagcattttgggaggccgaggcgggtggatcatgtgaggtcagaaatttgagaccagcctggctaacatagtgaaaacccgtctctattaaaaatacaaaaattggtagggcctggtggtgcgcgcctgtagtcccagctactcagaaggcagaggcagaattgcttgaacctgggagatggaggttgcagtgagctgagatcatgccattgcattacagcttgagtgacagagcaagactccatctcaaaagaaacaaaagactacagagaagatcaaatagggtaatgcagggggaagcacattttcaactgcaaaacgctccactgctaaaatagagtagagcaggggcttaccagcctttgcagaaagcagagccactttttactttgcctgaaattcacgaacagacaggagagggaagaggggagtaggggaggggccttggcagctgatggtgttttcctcccccactctccagtcacaaaccaaattatgaagagagtgtgtgtgcctgtgtatgtttgtgtgcgcaggcactggaatggttctttggaagacagtgggtgtggcgcacacacacgtggcatcagatcccagcctggagctgttccaggtgagttttgaaatcttcctgtttcctggctgcagatgtcacgcccagggcacagggaggaggaatgttccaggtgagttttgaaaaatcctctttccaggctgcagatgtcacgcccagggcacagggaggaggagcctgggaggaagcctcttaactctgccctcacaccctttccagggcatccgtcagcagccagcagctggctggacaaagaatctctggggaatcgggtgaaaggcaggtggggtgtggtccaggaggcaacaccagagcaggccacagtggtgtgcagggaaaaaaacagggcctggctacgggagaccccaactctgcccctaatcagctgtgtagcatcaggcaggttgccaccacgccctggacttcatttcctcttctgtaaaacgatggggttggactagaacaggaccctctagctccacaaccacggtctttctgcgcacagaatgagaggcagtggagctccctaacagagggcccattgagagcagggacaaaagcctctggaattccctccagcctccatcagggacacaggcagttttcttccctctggtttctgtcctcaggcaacccctggcccaagctcctaactgcactagagatctgtgaactcactctctttccctcctagaaggaaagaggaagccagagaggcagaaaggaggccagcagcagggcgtgaggcacaatgagatagaatgggaggacctcacatggagggacgctacagaggaccaggacagaagacacacacaccaagagcaaacaaccaaactttatccagaaaagcatatttgtaatcaccactaaacaatgaggcacatcggtcccctctccccaaccaccctcactcttcccaaacccactctctcttttggcttttatagaacactgtagaaatcctttcctgagtctgcaaatggccccagactgggatgggagctgcccagagtagtcttgggctggactgagtcctggtgcccagagagggagacctatgcaactgcctccagtatccaaaagttctgggggcaggtcgggtggccacccctatggcacagggccttgagggagggtgagtgtggtggcggtcttacgtgttcttctcatacctggcagacagagtgagcacaagccgctggaagccaagcgggaaggcacatctagaagggcagtgagctctggaatgctacaggcacgtgtggatggatgaggctccatggcggccaaggagatatctgctcctgagtaaggtcacctgaccacagacagcaccaggggctggggggctaagaaggagatcttgagaaggatggacctgagctaaagatgtaacttagatggtgatctgaaaaaaggaaaaaagaataaacgctggaactcaaatccactgtttagggtacaggagtacacagctaagttccaggtatccagaatcttgtgtccaaatcatagcacaaggagaacaggaattctcttgagttaaggcaaaatcaatcttcacccatctgggctcttccattgcatggtttggaaaggaaggggctgggcagagatcattcctctccccatctccccctactgccagtgaagactctgaaagcttctgcaggccaaggccagaatggtgttgccagcccagggcagcgggccctgagagcggtcggtgtgaccagctctgggaatctccatggcctcagcaacatggaaacctgcaacaggagaaccaaagtcaaagggcttccaaagcaccccaagtgtctcaccccaggctctcactgcaccagcacttggggctgaggggactcctagtctcaagcctcggccccccaaagtgctgggattacagacatgagccactgcgactagctgtgaatgttcttaatgccactgaactatacacttaaaaatggttaagatggtaaattttatgtatattttaccacaatttaaaaaatagctacattaacagtatctaacatgtattgataccctactatatagagtatagcctggtcatgaagaggccaggctgccagggttcaaatcctacctctaccactcattagctgggagaccttgggc

SEQ ID NO: 12172 - DNA, 43992 bp, Human
ctgatcgcgtgggatagtccctaagaggagggaggcccaggctcttacgtcaccagaacattttacgcaaggcgcagatgacaacttgaaagtgggatttagatgaggaacctggagttttgagtttatcctaatgggacatcggctaaatatagcaacagcaattaaaattataaattgctttctacaagaacaataaaacgaagtctggggagcgcttcggaagtatttgacattcagtaaataacatgtagaatgagtgaacgaaatggacgaaatggatcgtttctggtttaatcctcaggaaattggcacatgctgttttctctgcctagaacaatcttttcgcagctcttttcctggctgatttatacttttcagatcttagatcgtcaccccaggaagccttttcttccccaaccctgacaatatcaagtgcctacaacactgttcttttccttaaagcaattacagctgtgtctatttattagtttgttatttgactaatgaattaatttctgccttttgtcattagttctggcgagggtaggactcattcctcactggaaccccaggacctgttagtaactgatcatatttaccaggtcaataaatgtttgagtgaatgtataaatatttgattgaactgtgtagatcaagcagattaaaagcctcacacaaaacagagaacttcagtgtcagcctgtgagtgtagaaacaggttttctttctttctttcttccttccttccttccttccttccttccttccttcctttctttctttcttttttcttgagacggagtccctagtagctgggaccacaggcgcccgccaccacgtccggctaattttttctattttttagtagagacagggtttcaccgtgttagccaggatggtctcaatctcctgacctcgtgatccgcccacctaggcctcccaaagtgctgggattacaggcgtgagccaccgcccctggccctgaattgcattctagaagcatctttctggctgccatgacaaggaagaattggaggggaggactggtggaaagtatggtcaaggcatgaagacagacctagatgtctagatgtgtcacgtgggcaactgaatggatgaacacaggacagagagagagaggaagagaggtggccgggcacggtggctcatacctgtgagaccagtactttgggaggctggatttggtgggggggttgggggttggatcacctgaggtcaggagttcgagaccagcctggccaacatggcgaaacactgtctctactaaaaatacaaaaattagcctagcatggtggtgcgcgcctgtaatctcagctacttgggaggctgaggcaggagaatcgcttgaacccgggaggcggaggttgcagtgagccgagatcacgccactgcactccagcctgggagacaaagcaagactccgtctcaaaaaataaataaataaataaataaaaatgggagggggctgaacacttagacgaactggatttagctaagatgagtaaacaggaatctgaagaatcgtaagcaggggccccttctacttcccaacctccctggccaggtttaaactaagcgcgttttccaagacgttagggtcacctccacgactccagggggcgctgcaactgctacggcccctctaggctcgccccgctcaactcactgacagaggcggcctctcccgcggtagacaatgtgcacgtgcgctcttcagccggcagagggcgcgcgtgcgcagacggggccgggggcgcgcgcgggggccgggggcgcgcgcgggggccggcaccggaagcgtgcggttgccatgtaatatcctggccgcgcgggcagcggctaggagggcggcgccggcgctggcgcgcagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccaggtgagcgcaggcccaggcgggagccgagtaccgggccccgggctgcccggatgagggagccaggcccgacctggcccgggagggggccggggggaccgaggtggggacgttggcgcgtgtcccctgccaggtgggaagaccaagggacggacgggggcgacgaggtggcccaggccctgcccgccatgcgggctccagaagcggggacagagcccctgggaggaggggagaggcaccctgggctgcccagggacgcggacctctcccctccttctctccgctgcaaaggcggggtgcggggagagaaggggaagagaggagtcccgaggctgtcgacacaggactcttgccagataacccagagccagggaaaagttgcgtctagagcagttacgttcaaaatcctctggatgggcaaggtacaaagttgaaaaggtagaggaagaagtcagtttcccctctctgctcctcgggcagccagcccttctccccagagacaagcgactgtcatcgactccgtatgtccctttcctaagatacgtgtgtgcctttcctttaaaaacacgtaccctgtgatagcatatgccacagaatcctgtgtgctgtgtttttcattgcttggagatcacactggagcgggatttctccccctccgtcggcactgttgacatctgggctggattgttctccgtggtggggccgtcctgggcactgcggggtgctgagcagcgcccctggcctccacccactccgggccaggagcacccccaagtcgtgacaaccaaaaatatcttgagacatcactgtgtgtccccttagaatcagtcctccttccctcccttcgttccttccttccttctttccttccttcctccctccctccttgcctctctccctccctcccttctcttctttccttcctcccttcctttcctgtcccccaggactactgcactagaccatactccacacttcttggattttttttttttttttttttttttgagagggagtcatgctctgtcgccccagctggagggcagtggtgcaatctcggctcactgcaagctccgcctcctgtgttcaagcaattctcctgcctcagcctccccagtagctgggactacaggcatgcgccaccacgcccggctactttttgtaattttagcagagacagggtttctccatgtgccccagggtggtcttgaactcctggcctcaagtaatccgcctgcttcggcttcccaacatgctgggattatcgacgtaagccacctgcctggcctacttggctctttttaatgggtacattgtatttcattccatgacatataccataatttatttaaccagttgtcagttgatagatatctctattgtttaccggaattttctgttaccattactacaataaatagccagtgaatatctttgctcaccagtgggattagttttataggatgaattcccagaagtagaatgctgcatcccagcctaagtgcatttgatatggacagataaagggttttttttggaaactccagggcccactgctcatgaatctggtgaaagctgtggatccactctccagaaaactgggcacatttaaaattttcactttgcaatttcgaatgcaagaagcctcaaatttggccgggcgcggtggctcatgcctggaatcccagcagtttgggaggccgaggcgggcggatcacttgaagccaggagtttgagagcagcctgggcaacatggcaaaaccccatctctactaacaatacaaaaattttgtatttttgcctgtaaccccagctactaaggagggtgagacaggagaatctcttgaatccggcaggcagaggttgcagtgagccgagattgcaccactgcactccagcctgggtgacagagcgagactccgtcttgaaaaaaaaaaaaagacaagaagcctcagattgttgaatcctattggtccgtgtactgcagggtgaggttgtgtggaatttgtgtagatagagtccaccgaggaatgagcaatgatcttagcaaatgcttgggccaaggtggcaaacagggttctctgcccacagttcggagatgcccagtgggagcaaagagaaacgagtccccagtaacacccagcaggtacctttgcccctggaaagaaaaaagtaaggaccctgccaggtgctgtggctcatgcctgtaatcccagcactttgaaggctgaggcaggggttcccttgagttcaggagttcaagaccagcctgggcgatatagggagatcccatctctacaaaatatgaaaaagttagccaggtgtggtgatgtgcacctgcagtcccagctacttgggaggctgaggcaggaggaccacttgagcccagcagttcaaggctgcagtgaactatgatcgtgccactgcacttcagcctgggcagcaaagtgagaccctgtctcaaaaaataaataaaaaaagtaacaaccctagtggttgtttagggatatagatacttagggtctatctctacaccccagatgatggttaaaccctggagaaagatttaatccagacgaattttagagttgtcactgagaacagtcccacccccttgccccagcactttgaaatcagatggcctggccctgggttagaccttgcccagcaggcgtcagaccttcacctgcttggttagagcaccatagagtactgctccctagcaggaaagatgtcctcagaggtcttggaggaattcctgggccactttgttccctgctatagacaggtctctggaagccaccacccccactcccagcgatcagggcctgtgcccatattgtcctgagctgacaccctctttagaggaatgaaccaggcctcttgtgccggccaccaggactttgtctctctcaagggaagcaggatgacctgcgttcagatctgtgaatggcgccttgaagcctggaaaggacagtgtggtgttagctgggcttaggattgcctatttccacatcccgaggcctagtcccaaagcacaatggccacagcccaccctcggggctgtcgtcttggcctcctggtcaattctgtcctgagtcgtgctcttagaagtcaccctggctgcgttccatgctcttctgtgatcattgccatggttccctctgacatctcagctgttatctggacgtatccgactatttgtgtctctttttttgtttttagtctaataacaactctttcaccctctgctgtgcctgttggaaagtgacatctctcgggatctctcattacgtagtgatacaaacatttattgagttctcaccatgtgagcaggcagtatgctttataccagtaggtctcagctggtcttgcttatccggtctaagggtaaaaaacattcccccttttacacaaaaggattaggggacatttatcttcctgtaaaacagggccagttctgtcctccaggggacattgacaatgtctgggacctttttggttgtcacagcttggtgcggtgctgctggctactagtaggtagaggatattgctggacatcctccggtgcccagggcagcatctccccactgcccccaagaattacctggccccaaatgtcaatagtaccaaaatttgagaaaccctgcttgaagatttggaaaaaaaatgaggataattataccaaaacaaaggaacaaaaaaatccccactgagccattcttacgattttcctagtttggccaggtgtggtggctcacgcctttaatcccagcagtttgggaagcactccagcctggtggatgagagcgagacttcgtctcaaaaaaaaaaaaagtaaaatataaaataaaacaaagattttcctagtttgctaaacacagatagccacatgtgtagtttgtttttgtttgtttgtttgtttttgagacggagcttctctcttgttgcccaggctggagtacaatggcacgatctcggctcactgcaacctccgcctcctctgttcaagcaattctcctgcctcagcctcccgagtagctgcgattacaggcacccaccaccatgccccactaatttttttgtatttttagtagagacggggtttcaccatgttggccaggctggtctcgaactcttgacctcgggtgatctacctgcctcagtctcccaaagtgctgagattacaggcatgagccatggcaccccgccccacaggtagatatttacataaaactcagcatccagaccctaaggtcgagcccaccctcaagtctttaggaaaattcgagtgtctttcagtatctgggcttcttttttaggggggagctagatccaccataaacattttatgtgtatatgtacaccgtttatcatatacatattgtgacaactgtatatatatatatatattttgagacagagtcttgctctgtcacccaggctggagtgcagtggcgcaatcttggcttactgagaccaacctccgcctcccgggttcaagcgattctcttgcctcagcctcctgagtagctgggattacaggtgcgccaccacacccggctaattttttttgtatttttagtagagacagggtttcaccatgttggtcaggctggtgttgaactcctgacctcatgatctgcccgcctcagcctcccaaagtgctgggattacaggtgtgagccaccgtgcctggcctaaacaacttgtatgtatacatacactgtttatcatatatacgtattgtggcaaccatatgtatgaataagccttcaaaaggtgagcacctgtatttcctggtaattgacaatgtcagttttgtgtgatgtagtctctatggaatttcccgtacatatgatgacagaaacaaagactgaaacatggttcacagagaaacacagaacatacatgactctcagaataaccatgtctgctgctgtgtagggaactctttgagaggaaacactttcactgctggcctcaaatgccactatccacttaggttcttcagtgtgaacctttaattcaaaagtaccttccagctgatcacgaggaacctttatcgcttgcacctgaggaggtcagggctgcagggagccctgattgtagcactgcactccagcctgggagacagagccagaccctgtctccaaaaaaaacaccatttacagtgacttagaaaagggacagtttccagtgctacacacaatggttccatacacagcttaaaggtttccagttctttgctggaacttgatttaatagttgagagccacaggcatcggggctcctgaaggaggggcacgcgcccatcagcgctgtcagccggggatggcgcagaccccttccttggcttggcaatgtcggagacagttgttatcgcaactttgggagagaatgctcatggcatcgaggggataggggccagggatggttgccaagcatcctacaatgcataggacagcttccccccgctgcaaaggaagaattctccagccctacgtcagtagagttgagcttaagaaaccctgctttaaaccaggctctagacttccaagggttcttacggtgtcctttctaaattgatcaacagaggccgggaggatgcgggagagagtgctggaaaagataaacttactttctaacaggcgaggctgtgttgttggttctgagtttctgatctctcgttggtgataatggtaagaaccttagtgggttccaggctagttcatctccctgcaaaaccttttgggaacttgttcaaaattggtttgggcttgagtgggcagtttgtgagtttttacttcttgtcatgaactggccatagactggttgagggcctgagctggggaaagttgaatcatctggaagaaagcagtaaaaagccgtccgtcatggtcccatctccctggttccctcctttctgcctgtgtgacacccactccctcaagagcctcctggcatccgtgcgcagctagaactgggggactaaggagggtgaaagaatgcggctagcgagagctgctctcagaagttcccttggtgtgctgggggtttgggtgacattatttccaggcttaagctgctaactggcttcctgataaatcttgtggccgggctgtgtgagattgagagtgtaactaggggtagagctggcagctgcctggaatgctggctttttttttttttttttttgcctgaaaggagggagagggtttgaacatttgaatggaaagattgcttcagactgagctaggagggacattcacaagcgtcacctcccatagctttgaaatctgcctgatgctccttaggccctgggtttgtgcctaggagaaaaggagaggccagtggggttgggggaggactgtctgccgggggatcctgggccccacctatttgggggctgtaggtcagagtaagcagtgtctgggacatggctggtgtttcagaatgtcaacgatactgcttgttctgacctatttttatttttatttatttttaaattttaatattaattttttgtttgtttgagacagagtctagctctgtcgcccaggctggagtgcagtggcgcgatctctgctcactgcaacctctgcctcccgggttcaagcaattcttctgcctcagcctcctgagtagctgggattacaggcacataccaccacgcccagctcatttttgtatttttagtagagacggggtttcacatgttggtcaggctggtttcgaactcctgacctcgtgatccacctgccttggcctcccaaagtgctgggattacaggagtgagccactgtgcctcgcctatttttatttattttttaatttttttgtagagactgagtctcactatgttgcctaggctggaggctccttaaaccccaccactccaggtcttgaactcctggactcaagtgatcttgtctcctcattctctcaaagtgctgggattacaggcgtgagcctctgtgcttggccctgacctttttttagtttatttatgatggtgtttttttttgtttgtttgttttgttatttttgttttttttgtttttgagacggagtctcacaccattgcccaggctggaatgcagtggcgcaatctcacctcactgcaacctccgcctcctgggttcaagcaattctcctgcctcagcctcccaagtagctgggattacaggcatgtgccaccacgcccagctgatttttgtatctttagtagagatgaggttttgctgtgttgaccaggctggtctcgaactcctgacctcaggtggtgatcctcctgcctcagcctctcaaagggctgggattgcaggtgtgagctaccacgcccgggttgttatgattttttaaaattttacgtatttgagatgcagtcttgttctgtccccactcccaaggtggtgtgcagtggcacgatcttgtctcactgcaacctctgctgcccagttcaagcgattctcctgccccagcctcctgagtagctgggattacaggtgcctgccaccatgcccagctaatttttgtatttttagtagaaacggggtttcgccttgttggccaggctggttttgaactcctcaggtgatccgcccgccttggcctcccattgtgctgggattacaggcctgagccacgtgcccggccctgacctcttttttaaaacctcactttgtggggccactcttggttttcctaccaaagtgcttgacttgttaagccataaacatggaatgatcttttgtgtgtgtgtgtgtgtgtgtgtgtgtgtgtgtgtgtgtgtgtgtgtgtgtgacggagtcttgctctgtcccaggctggagtgcagcgggccgatctcaggtcactgcaacctccgcttcctgggtccaagtaattctcctgcctcagcctcctgagtagctgggaatacaggcgtgcgccaccacagctggccaatttttgtatttttagtggacacagggtttcatcatgttggccaggctgttgttgaactcctgacctagtgatctccctgccttgcctcccaaagtgctgggattacaggcgtgagccagtgggaataatcttaagatacaaaaatatggggttcataaccccttcaccttggcacagataaaagtgtatacccttgtgctgggagtgacaggtagttgagaggcacttttgtgtgggctggtaagggccggcgttggtgattcagaggctgtgcccgggacaaggccggtgagtccagcagctgcaggctgacctccggaagccccctctccctcggggaggtgttggcaacagatgtaggaagggactttgctttgtgatgtccacgtatgatgggaatggagttaagtccgttcttgcaggaagctctggtgactgaatccaggaacgtgcggcatgtactggtgtgtgccttgaggcattggagccggcattggagccggcggcgtggaccctgggccaccccaggacaggcagggctcactctgtttctggcttgcagacgggtggaaccagcagctgtgtggaggcctgaactgtgtgccagctgggctgtgcagacacagaagtttgagactgcctttccccaaaggaagctagaggctccttacaccccacggctccccgggcctgtctgtgaaacctggctcacctggcccccttcacagggttggctgttggtggtcactgggcactttgtaaccaagcagcatcctacgttttcccattcttaacaaaccaggaccaaggggtcatcagactccgatttctgccacccgtgactgctgtacagtaggtcccagaacaagtcaagggctgaaagttcggctaaaagtttgtctctgactcagaatcccgtgttcaccaaagaccagttggggctccgtgggtgctgatcgccctgcttatctgggtgtgtgttaaagcccagctctgcagtacttaattatattccaggtgcccctaataacagcctgcgagtgcgagatgaggtgtctcaccttatgccgctcagttgaagaaattgggggctgtcacattttgacaccccagacctatcaagcacacagagaacatgacactgctcaccccgcccctggccacccaggggtggccgctgtcacgtgcgcagtgcacctgaggtctgagctggcagctgggcccctcagatgtctgtgtgtgtgtctgttgcattttttcctcaaaggagaaacctgcaggttgaggcccgtcccgctcagacctgcctgtgtctctgtgtccagtggactttaatccaggggcctagggtacagccaagccttcactgctgccttagcccttttcctcctccgtgattgtttccagtgttttgcaactgatctgatctggggaaacgtcgtgtttaatttggagcatgctgccaacgtccccagtaggatttcggaggcagccgcaggtttcggcgctgcccggggcagagcttagaggagaagctcagagcggcctccatgtttctcttttccaagcccctgaggtctttaagtgccgggagggttggaaggggaagcattgccccggggtgggggtggggtaggtgtcaggagctcaacaggctctggaggcatctcagcaggacctgagctctccaactctaatggctttttaatgtgtgagctgaagtgtcagggggcggtctcttctggttctttttcgaagctgtccctggaaagcggatgaaagaatgtggtggccagggctgcagcgggtttccctctctcccttctctcccctcctctccctatctctcccccctcttcttcctctctttctgttctcactcttcccttgtctttctctctgtctctcccttcttttgccctctcacctcttcttcctctctctctgtctgtcctctccacaccttcttcctgtctgtctgcctgcctgtctctctctttctctatctctcgccttttgcagggctggatttggcaagcacttttcctgagcactgcagcttggtgcgtttctgctcatttcctgttaagcagtacccagggctccctgaactcaggctctgggaggacggccctgtcttccttttcctctccactcctagaaaaacctgctgaccaggccctgagagcagggtcacggggagacctcctcaccacagcaggaagatagacggacagtttcctccattggacctgactcagcagcggcccactgaccgcctgggagggggctcccgcctagcgggccgcagttccacacctgggtaaggggacgaagcacccagcaggggtcatgccgcgtgtgacacagtctgtaggggcggtggtcatggcagatactcagaatccagatggcatcaggcctgcgagggcatggggtgagtgggcccactcccctccctgggccgggaacatgcgtctcctctgccctggcccccaagtggacagctccccacatggtttcatgccaatgggagtgattattccattgccgttgccactggaatatgagcccattgccgccggagccaggcatttgtgctcattgctgcatccccagtgtttggtttactggctggcctgccccagggagccggtaaatatcacatggaaggacggatgggccaccgtggcccccaccctacagcggatggcctcgtgtcgagtttgtgtgagcacgccctagaggaagagaagcaggtctccacctggcccagggtacagttcaagctctcagccgaatttcgggagcttctggagcccctgccttggtcccaggtttaaatgctactcttcccctgcatgggaactcacacagtcagtccctcccgcccaccctgtgtggggccctgtactctcctgcctcctgtccatgtcaccggcctctcctacctcccaacctcattttctctccacttcctgtctgccctataacgaacgcgtttctatctccccttatccttggcatcttccggggatgcatgtgggaactgagttctcagcccttggagcttctggcctcggggtcccccacccagatgccacacgctggtgttcgtgtgaggtgctctcctcccatcggacggcagctcctgaggctgggctgtgctcgggcatgtgtgatgggccatgttctgctgggcactggcctgctgatgaggttgccagagacgccccctacagaggctgagctagagggctccttctcagagtgaggggctgtcctccacagggcccctgtggtgtccctggtggtggctcaacagcagcccctggtccgctggccaggcatctgaccaggccgtgtcacagcaccagggaggcaggtggctgacaaggcctcggagaactcggttgggaacaggtccgactgctctgaaaaaatcaacagctcagagagtgtctcctgtggtttagggtgtgtgtccagctccagggctgcagctgacagtcacctgaacttggccaggtccgagggcctgactgtgtcacaggcagtctctgacccagagcctgcctgagcagggtccctaagaagccaagcccagacgcctgcttccccccttgatcgaggccaggctgaaatgcacctgctgctgcccggctgggccggtctgctcagagttggtggttccctggcttgaatgcttccccaaactaaaccactcccagcctccagaaactggctccccagccctgtttgccaagattcttaggacttttgccatggctgggcctggccacccatcctgcagctctctccctggcctctgtgcccagttgctgcagtgacttctctctgattgccacaataggccctgcggctcctcccacttctccctgtggatggccccttctgtctctgagcctgctgtctcctgtgcttccgctgcccctctctgtacctgtcttctaagcctgcgtcccctgtcccagcgttcaaatgtgacactcccacgactcgcagaccacagcaggcagctggccagcggtgatgccctgaaatgacagccagggttcatcgcctgtccttcagcttgaacccattagctgattcggcctctttcctcttaaattacttttattttatcacttttaaaatgtattttaaaggggatcgtggtatttttccttgctcaataacagtaactggaataggccggacacgatggctcacacctgtaatcccagcactttgggaggccgaggcaggtggatcacaaggtcaggagtttgagactagactggccaacatggtgaaaccccatctctactaaaaatacaaaaattagctgggcgtgggtggcgcatggctgtaatcccagctactcaggaggctgaggcgggagaatcgcttgaactcaggaggcagaggttgcagtgagctgagatcgcgccagtgcactccagcctggcgacagagcgagactctgtctcaaaaaaacaaaaacaaaaacaaacaaaattcgtcgggcgtagtaatgcatatctgtaatccccgctactcgggaggctgaggcaggcgaatcgctggaacctgcgaggtgaaggttgccttgagccaagatagcaccactgcactctgcctcaaaaacaaaacaacacaaaaaaccccgcacagtaagtggaataacaaatacaacagcagcaaaacaatagagtgaaattttgctggataccccacccctgagcctgaggtgtgctctcttgtgaaagagctgttcgggctggacgtggtgattcttgcctgtaatcccagcacttagggaggctgaggcaggattgctttagcccagttgttcaagcccatttgggcaacacaatgaaaccccgtctgtacaaaaaattaaattagccagtcatagcggtgcacacctgtagcccagctacttggtaggctgaggtgggaggatcacttaagtccaggagtttgaggctgcggtgagctatcatcatgccgctgccctccagcctgggcaacagagcaagaccctgcctaaaaaaaacaaaaacaaagcctgtactatagtagtgcccacctggaagttccttcttgccagaataagaaatacagaagaggggccaggcgcggtggctcatgcctgtaatcccagcactttgggagggcgaggcgggcagatcacgaggtcaggagatcgagaccatcctggctaacacggtgaaaccgtgtctctgctaaaaatacaaagaattaactggatgtggtggcgggcacctgtagtcccagctactcgggaggctgagccaggagtatggcgtgaacccgggaggcagagcttgcagtgagccaagattgcaccactgcactccagcctgggcgacagagcaagactccatctcaaaagaaaaagaaaaagaaatacagaaggggaattgcagcggagttgtgttctgaccacgtgattcacgtgccttatgcttgtgttagctgccacgctgtgggaaatgcctcacggaaggcacgttgccttttcccttggggcccaccgccatgccctctgcagtctcgcctcttaggatcgggggatcctgcacactgggatttgggctcaggaaagagggctgatgggttggtaacagccaggtcctgagtgcctggggaaaggcatggaagctggagacccagcagtcagcattcttaaggagttcccaaacattgttgggcacggtggctcgtgcctgtaatcccagctctgagggaggcagaggcaggaggagcgcttgagcccgggaatttgagatctgcctgggcagtatagcaagaccctgttctccaaaaaaaaaaaaaaaaaagtgaaaaagaaataaaaaaaaaaaagagttcccaaacatcacccaagcagtaatgcaaatatcttcctccaggacacccccatccagccctgcgtgctggaagcagaactgctgactgattatttttctgctgtcatttcgggactttgccccagcactaagcagagacccttattctcaggaagccccctgcggaaggaagctctgggaactttctgcccgccctcgccgcaatcccttgccacccgcctctgtgggatgaggccccacagctgactcaggcaggcatccatcagcctaacagcctcactcatcagagtcccgattgtttgaaacagatgggcagccctggcccttcaaggccagcctttgtggctcagaagagggcagcccagggacctggttggaatttccccatctcccaaccttcacccaccctggcataagatcatcttcatcctctcctgaggcctctgatggttttctctaaggttgagaatccctgctattattttaggaaggaaggacaacccccagaactgcagagtatcttgcttcttgctgactctggtcaagtcagcgttccacccacgaggagccttggagctgtcggacccctggctgagcgtagtgtgggtgtctgggaggtatgtgctgcccactgcagaggctggctcggaggccgctggaatgctgcgctgtgccctagcttttacatttttatttcatacttgcagaatcctgtgtatttttccagtgttctcccactcccagccttcccacagcagcctccccggctagccccagagcactctgtgcctgtcagaagaaggcaccagtgggcccctctgttgagtggggtccctgtgccacctctagactggctgagggttccatagtgggcagctgcacagccagggagggtctttggggcccggaaggaaagagtgctgctgggagggagggcaggagaaagacctttggtctgcctgctgcaatcacgtttctggagcccaggagtccactcggctgtcagaggagccggtagggggtcgccctccttccaggagaggttgcctcttactgcattcagaacacattccctgggccacacgctggtcggcaccagtatgtggcacagggcacctcccttgttcaggcacctcatgaaggttgtatcataaagggtttcagatccagaaaggcagctaagaatgaccagcagatgagcaggtgcccccaccccatcccaaggaagccagagcagggccggcgtgccttcactgcgcacgttcactgcgccaaaacacgcagggttgtgtggcggtccacactgcctgtcaacaggatcacgtgctttcttgcttggtttctcgtaccctagtttttttttttttttttgagatggagtctctcgtcacccaggctggagtgcaatggcgcaatctcagctcactgcaacctcccgctcccaggctcaagcaattctcctgcctcagcctcccgagtagctgggattacagacaccaaccaccacacccggataattttcatatttttagtagggacaaggtttcaccatgttggccaggctagtctcgaactcctgagctccagcaatctgcctgctttggcctcccaaagtgctgggattacaggcgtaagccaccgcacctgctcaccctacttttaggctgagcactgcttgtgagtaccgttcacactgacacacgaggctccactcgcatccgcagctgcgtggctttccctcgtggttattccacagtgtgtctatccgttctccagccagtggacatttagagtttccaagtttctgcattttcacacagcctggcagtgagcggtcccctgtggcatgtatctgagagcttctccagtgcggtaccttgcttaatatgatcatctgctgtagtgcttgatgactatgcccatgaatagccactgcactccagcctaggcaatatagcgagaccctgccttcaaaaaaagaaaaatagccacataggttttcagcagtcctagcctggaaaaaaacaacctgttcaatttgcatgaccgaaagtcctggaccggtggctagcaatatcgtgtgttgcgcactcgtaaagtgtgttatttcaaccctcctccaccgtgctgtatgtgcctgggggccttggccaggaagccaagtgggcggggaggaggctcccagctcagggttagctctgtgtggtccggagcgggatgaactggggggctcctgcgccatcagctctgaggactctgcttctgctgggcatcctcctcacggatgtaacatcccctccagcctgtaaattcctctggagcctgcgttttcagttttgttgtgtacagtgaggccgcgctcacagaaagcacctagcacccagccttgtcgcagagggcagcttgggccaggactcacgtgctccctgtgcaaattcacctacttgataagattgatttgtagccccaaatcattccttttgcagtcttttgcagacaagtgcagagcagcaaaaaatctgtcacccatcgcatatgttcctagccgaggtcaaacaaagccacactgccttctcctagctctcaacgctgtgttctggcgtggatcactctgccttctcccggctctcgcattgtgttccggcgtggatcacgctgccttttcccggctctcacgctgtgttccggcatggatttgcaggcttttagcgccatgtttctcacatttttgggattttgttggtgatttcgctgttgagaatggtcccagcatcatgcagcagtgccgtctcgtgttcctcagtgccaggaggctgggatgagcctcacagagaaaccatgtgtgagagcagttctctcaggcaggagtgatagctccgtgtccatgagttcagtgtgggtgaatcacagtaaatatgaactaaggaaatacgcataaaggacaggtgcagcggctcatgcctgtcacccagcactttggaaggctgaggcaggaggatggcttgagcctgggagtttgagaccagcatgggcaacaaagtgaaaccccgtctctacaaaaataccaaaaaataaaaaataaaaaaaaaaataactctgtgtggtgatgcacgcctgtagtcccagctactcgggagactgaggccagaggattgattgagcttgggaagtcaaggctgcagtgagccatgatcacgccactgcactctagcctgggtgacagagcaagacctggtctcaaaaaaaaaaaaaaaatgtccaggcgtggtggctcatgcctgtaatcccagcattttgggaggctgaggcaggtggatcacttgaggtcaggagttcgagaccagcctggccaacatggtgaaaccctgcctctattaaaaatacaaaattagccaggcgtggtggtgtgtacttgtaatcacaattactcagaagcctgaggctggagactcacttgaacccgggaggcagaggttgcagtgagccaagattgtgccactgtactccagcctgggcgacagagtgagactctgtctcaaaaagaaaaaatgaaatacacaaaactgggttacatagtgaccatttgatgaacatgttgtgagcagaggctcacagaaacctagctgtgtgtttcccctctgaacagtggctcagtactggccaactctgtgcttgaggtagctttctagaacagagctgccacgaataacgagaagtgatgagctcctgtggcaagcaggacagcacccgccacggctgcccctcacctccacccctggaactgtgactgttcccttacatggaaaatgggactttgcagatgggacaaagggtacggacctgggggtgggagattatcctggcttatccacaagggcccagtcccatcagaaggccctcagaaagcggagcacctgggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccgggcgtggtagtgggcgcctgtagtcccagctactcgggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaagaaagcggagcaccttcccctgctgtggtcacagggagctgagacaacggaagagagaacaagagatagctgttgaggggccagcgcctgctagctctgacaatggagggaggagggggccgtgagccaatggatgtgggtggcctctggattctggaaaaggcaggaaagccccagaacccccagaatagagtgcagctcatagtatctcaatcttagcccggggtgatccctgtcagggtctgacctagtgaagactttgtgttgctttaatatgtcgttgaagacgtcgtgtgtggctgtaagtcactaggtttgtggcgatttgttgtggtcatcgagaccatcctggctaacatggtgaaaccccgtctctactaaaaaatacaaaaaattagcggggcgtggcggcgggtgcctgtagtcccagctactcgggaggctgaggcaggagaatgttgtgaacccgggaggtggagcttgcagtgagccaagatcgcgccactgcactccagctaggcaacagagcgagactctgtctcaaaaaaaaaaaaaaaaaaaaaggcgtgtggggggtgacagagaggcgggggaaatgaagagaggcagagggggtggagagggacaggggagacagaggcagggtagacagagagaggcagggggaacagagagaggcagggggacagagacgggagacagagaagcagggggacagagaggcgggggagacagaggcaggagaacggagagaggcagaggggacagagagatgggagacagaggtagggggacagagaggcagaggggacagagagaggggagacagaggtagggggacagagagaggcagaggggacagatgggagacaggcagaggggacagagagaggcagaggggacagagagacgggagacatagggggacagagagaggcagaggggacagagggagacgggagacagaggtagggggacagagaggcagaggggacagagagagatgggagacagaggcagaggggacagagagagatgggagagagaggcagggggacagagagagtcaggggagacagaggcaggggaacagagaggcagggggatagagagaggcagggggacagaggcaaaggggacagagagaggggacagagagaggcagggggacagagaggctgggggaacagagagagggagaggaggccggtggggaaacagagttgttttttcctctgttagctctcatccctgaaatcaacaaggaaataggaccggttcactttgccatgttggcttgaggtgccctgctaagagctggggttccatccagccttccttggctgtgacactctgtggaactaatcttcaacttcgcagaagttgttccctggcctctggaatcccaccttggtgacttaaaagctagtggactgatagaaaattcagtccccgttacttaacttggattttgaaaaccgtcccctcattcaggtttacacagaacatgctattgcccgtctaagcctgaggggaccacacaccccagaaacaccagagcagatcatgttcaaaaccgccgactgtcctgaagacagttgacaattcatgagtttgacgcacgttttttccagtccaagagctggagccagatacccacccgtgacgccctcccacatcttccaaacgggcacttccaaaccttgtcctgggcatgtttccaagccagcctcactgctgcaggctcatgtcatgccctctctcctgcgtgctcccagatcccacccatccttaaaagcccacggccacggccacctccttcctgcctcaccctggctccctccccgcaaggaggaagcggcccctccccgctggcgtcctgtctgtcatagggccttaggttcttgtgtgtgtgcgagcctgggttacgtgtctttccttttccactgtacctggcacaggtaaatactcattcagcctgacttggacctcagtgatggctccagaccgtggctttgaagaatgggcagaatttggatgtaggaagaagcaaggaaaggagggagagtttccggtgcagggagagagccctgccctgggcatcccttaggcaggtgttggagggaggcccccagcactggggccccagcagcatgggtctgccctgccgtgtccttcccctccaacctgagcccatgcagcatccgtggggccagtccttccagggaagtggaagccaccctgggaggagcctggctaccagaccatgatggcagggtgggagagatttgaatattcttactgctcgtagctcaggaagtggcagcaccagtcccttgtcctttggggcgatgacaacagagaagcaagccttggggggcagggctgctttccccccaaaatacaagtaagcacaaggcagagcggcgtgctttgtgttgacgtcgcagcagcagccatcctggcagtgaggggtcacagtcacggccacaggctcgcccatgcacagaggcacgttctcgaaggcaggaagagcgtgggtgtgcagaggtgcagggagggcgggacatccccagggaaggagttgcgttcaggatgggcagctgtgccaagttcccagctggtaggaagacaggaatgcaggttgattgggaaacaggagagagggcgcagcggctgtggcagctgcctggggtgtgagacagcagcaggtgtgtgtcagggatgtggggaattttctaccaaccttctttttaagttgagtcattttctctcttggtcctttgctgctttattttttttttttttttgagacagcatcttgcgctgtcacccaggcaggagtgcagtggtgtgatcttggctcacagcaacccccacctgctgggttcaagaaattctcctgcctcagcctcccaagtagctgggattacaggcatgagccaccatgcctggggtttcaccatgttggccaggctggtcttgaactcccaatctcaggtgatctgcttccttgacctcctaaagtgctgggattacaggcatgagccaccaagcctggcagtcctttgcttctttcctcccgccctcgtccgccagtagaacctcagaatttgtgtcacggccattgacaaatatgtcccgtgctgtgagcattttggaaccgggacttgactctgtggctgatctggaggcgctctgggcgcaacatgagatttcgtgcacgatcagccagctgtagccagtttttcctggtgtgcgtggtcctgtgagtgcctcaccagggtcccttggagatgggtgtgactcaggtaaggtgtgttccttttcttcttcttcttaagggcctgcatgaagcctcttgctccagaaaaactgggctcagaggcagtgtcgtggggcggaggtgaaacccctggccggccccacacccatcattcctcgggactcagttgctcagtgcacagtagcctaggatcgtagggtggtgtatggtttctgttttttttatttttattttttgagagagttttactcttgttgcccaggctggagtacaatgggcgcgatctcagctcaccacaacctccgcctcccgggttcaagcgattctgctgcctcagcctcccaagtagctgggattacaggcatgcaccaccatgcccagctaatttttgtatttttagtagagatggggtttctccctgttggtcaggctggtctcaaactcctgacctcaggtgatctgcccgtctcggtttcccaaagtgctgggattacaggtgtgagccaccgcacctggcctggtggtgtgtagtttctaaagcacatccacgcctgagatggttgagaaaaccgaggctcagaggggtttgcgttcctgctcagagtcacagccccgaacggcagagctggaaccacatccagtcccggtgtcgcccatccaggcaccctaatcccacgtcagcctgcttgcctcgtggcgttacggcacacctttgctctgatgtgttactggcacacctgagctcccgagggcagggctgcttcttatttatttgttatctcaacaactagtatttattatctcaccatatactcagtgactgacgccacctgggtgccaggccctgtgctgcctctgccacccctgtccctgtgcctggccctgctggcaggaagcttgtgtttgaggacagagaacttggggtgggttggcgacgagagcctgtcccgagtggtgtccctccaaggacgatgatccacagcggggcagaaggggccctgggaagcaggctgcacccgccagaatctcccaggcccgggacccaaacgcgagtcttcagacaggagaggctgcagtcttctcgctgcaggggagatggtggggggactcgggccatttgcctgcttcctctgtgctgaggccgtggtcagcaattctgagattcccagcccgggtttccaccaccgacatcactgtgtaaggagcaggcagtgcctctgagcggccaggggcacccatgcgccagagccagtgcacgtgacctggcgagggggcaggagtggccactgcaaggtgacagctgctggcacctaatgctcgcagagggccccagtgcacaggcgcggctggctgtgcagagctgctgaccgcctctcaccaccccctgccctgccccgtgccacccgggatgacttctggcctgggtgcttttggtagccacacctcagaaaacctgtcttcgtgactgtgggccaccatgggcatgagtcacctgtcaccagagcctggtgtccctgtgtaagtgtgccagataggcagaggagacaggtgaaggcacattcctcagtgcccgctcacagctctgcccaccacgcattctgtagagaacctcagtgccctcctccctgctggcagccaggcagggatttaggcggtttctgtttggcctccagtgcttgcctctcccgtgtcctatccgcccagacctcagacctgtcactgttcccgggcatcctcctggataagaaactgcccaaatgtggtagctgggtccccaggatgtgagtcaggctaggcctgcctagctcacgttttgttctttgcaaattttcccaaccttgcagctctctggggagggagccagctccaggctgggaatgggcctggcggcctccatcagtgtcagcccaggtgaaccgtccacgagccacaaaagggaaggtgatgggaggagtatcatctggctgccttccgggtcactgcggggagttgctgcccccggagcttagctgctgtcaaggggtgggatgtggcgaggacccccaagaggttgcccggggtcctttattctagggcgctaagcattggagagtgcttcctgtgtctgagacgggacagcaggggacccgaaaacaagcaagcaagaggaatgcgaggccccgtgaggatagcaggagggtggggcagccttgcagccatggggacatttggatggacagagccctggtggctaagacccagcatgggaagatccagggaggctcagtgagggagaaggaacagcgagagcaaaagctctgaggggagatgggggggccgcccaggcagatgggggtgtaagatgaagtgtgaaggggcaggcgcacgagagaggaggcatcagtggtgtgttgggagaaggtgaggagaccagtgatggggatcaatcaggagagcttcctgtgggaggaggcttctctgaggtctgaggtctgggcggataggacacgggagaggcaagcactggaggccaaacagaaaccacctaaatccctgcctggctgccggcagggaggagggcgctgaggttctctacagaatgcacggtgggcagagctgtgagcgggcgctgaggaatgtgccttcacctgtctcctctgcccacctggcacagctgcacagggacaccaggctctggtgacaggtgactcatgcccatggtggcccacagtcacaaagaaatggaagtccttcagaaatggaagggatcttagagatggtgaagatggtttctgtgtctcaggaagggctctgggctttcgggcaagtctcctcagctctcagggagtgagggaactcacggcccctcgttgagatctgtgcacctgcagcctctcaccgctgtcaccatgccccgcagttctctctccaagaccatttccagtctcttcctgcagggctatgcattgcctcagctccttttgaggagctgttgagaaaagatcgttttttaagaaagccttatcgttcctgtgcatgtgggtgatgtcatcacactctgccccctggacgcagatcctccatgctgcccccagtgggaacaccagcctgtgctcagtgctgcagagctggtgtttccctgccaggcggagcctcaggggatttatcgcctcatttgtttgtgggttggctttttccttttataagttttcatcggaaactgattttaccagttgtatgtcacacagccctcctgcctggtccccaagatgagaaattacaatgcatgatgcatgaggctgattttcatgtagatgtgttcgctcgggctggagctctgggtgtggtttgttcctgggagaggagccccaggcactcactggcatctccatgtttggatgaaaccctgtgcaagggcaagggtgggagcgtgtgtcccacatagctgagccccctggttggcaggcctgtcctcccgtctcctgggaaggtagcatgagcttcccacctgctcccagattcctcgcccagccctggggcgttgcccctccccttccacctgccctgactgcattccaggcagagccagggttggtggggcctgcagtggggatcccttgaccttcctagccactcctgctgtctggccttgggccaggcatgtctctcctaggcccttagctgtcctgtttatcaagtggagacatctgcccagaggcggcagctgggccaggtgggggctggagggcccggctggctctgtccactcctctcggggttgtcctggagctctgtggggtcagcctcgcaccacagacagtaggtcccagctttccacagcagagggcaccccttctcccccacgcatggaggggcaggtgggtctcgtaggtgcccgaggggagcaggtcgggctcagtgctctgctgcctcctgggcagactggtagtggtgatgggagccccagggctgccggtcattagagccgagcccaggtcaccgccctgccaccatgtgctgggacagcgtgtggcccatggcttctgccagacgggcggtgagggagcccccaccattgggcagcactggccagcctaggccccatacggccaccaggcgcagcccgcagcctcccccacacccatgtggagctgggccaggcagggtgcgtcctcggcatgcgtttccaaggactgctgagtcacctcaggggtgactcaggggcccaggggccaggccagagccaagggggacagcaggggagaggccgggctgcaaggccacagcacgggaagggcagcatgcggaccagaggccaagcctctcaatgcagacgagggccaggaggccagggaggaggctgtcccgggagaaacgccgattgccccatctagggcggacgggccaggttcgggctggtggaggccttccgggatgcaggccctgcacagggttccttagggtttaaagtcagcagccagagctggaggcctcatcagaaaggcagtgtgggctggactcccgctggtgactttgctgtcagcacaggagaggtccttctggccctggggctgccctcacggagcctccggccaccagaccatcatagaccaggcctgaatgtcccctttctctctcggggatggtcacagagctggcccctggcccctggctgccactctgttgtggccaccgctgagcaatttcctgtcgtggctgtcaccacttcgtctgcgtgacttctttccagtggctgattccctctctgcttccagttcccctgatgtgttggcctcagactcttggatggggcctccagggcccatctggaggatttctcttgcctaagtttttttctccccctcattttcatgtgctgtgacttcaaatgacatcggctcgctgccgcgcacacaacaaagcatttatcgctctctgccaatctgagagtcctttctccagctccaagagccaggagtcaggcagggcagggcccgacagcctgagagacggcatgaatggccagcaccacagttggcagaaacgcacccccaaggcgatttagactgcggtggccgggccgcaccatggcccccaatgtctggctgtctttccctaccatggcacccagccacacctctggccaggaagtctgtggcaggcctgtccccacagcctgggggccgtggggaagccgggctctcagggggccctctgtggcctggtctgaggcagagcccattctggttccagtccagagccggtatctcggttgccagcccaggcccaagggactgcccctttggctgagaggacgcctggggcttccagagccactgtccttttgctgccagagcttggttcccagaggagcgcctgacccgccacagaggtgggtctgtggctgtccccgggtgcccaatctggccatggtggcagcgtctggtttggggtttccgtgagaaaataatttcagaaactttgtcttgattcattgttttcagtgcctccgttcccaaaggctgctttttaaaaaccattcagccttgatggacaggaggggagatctctactgagaggctggaggctcgaaggacagtggcaaatccagggctctcagaactcccagatgctgaggggagccccggctgtcgggacccttccctccgtgcatcacacacagtgggtgatgacccagtcagccccaaggcagaggctccctccatcttcccttgggctggggagtgggtttctgccgtctgattcctcgccgccgggccatgaggatcacctggcacctgtgagggtcacttggcacctgtggtgctcctgtggccccccctcccactgctcctctccctccccctcctggcctcatccctgagcatgtgcaggaatgactactcctgcttttcacctgcggatgccctgcaggctcccagaccaggagcccaggggccacaaccccacccatgccaggcacttactgtcacaggaaagctcagagctgcctgcagccagcgccgcccctgtagataggcgagctttcatagtcagcacgcaagggcctcaggtctggagagtccccatgccactggggccactgaaggtttccaggaaggacagacagacacatcagcaagccaggagcctgggagcccacatggaaaaggggacacgaaggccagtggcttcctgtgtcgctgggcagcaggccgcctccaggctgtgcgcgtcttcgactttttgactcatgggaaagaagctgtgatggactcgaggtggccatgtgtgttgggcagtggctcccaggtgttgggccagcagggaagggcgttgcagatggaaaggggttcagagacacacggatatgatacatccctacatcctttgcccctgccctcttcccacgtcagggctttttctacaccacagggatccttacgtccctccctggggcctccaccccgaccctgtattccagctgttttgcacagaggtctgataaggactctgctgcttctgcaggccttaccctggctttgcccctttccatggctgaccaggccttgaacacagctgcagtgttagaactgcgcccactgtgaggaggggctgagcactcgcctcctccacgtccccttcagcttcctcctctgtgacgttgggggccgggcacagagtgcctagcatgggggctggcacatgggactgtgaatagtggcccttgttccgtgtgtcctgcctgccctgtccctggtcctgcaggtggctgggcctggaccccctcctatggtccccagctccccaacccatgctttgtcctggggctgttgtcccctagtcctgtaaatgtatggccttggccaggcacactgtgtcatgcctgtagttttggcacttggaaggctgaggtaggattgcttgaggccgagtttgagaccagcctgggcaacatagtgagacccctgcctctttaaaaagaaaaaaaaagatgaggccttgtcacaggtattcgctgcggttgaccagccgtgcccacctgccatttctccgctctgtgcctggcactgggcgaggcccctgtggtctgtgcgctcacagattccgctgaggaggactgcagggagggacgcggagatggctctgtagcacagcgtgcagcaccacagcaccaccgatgccgacgggcaggcagacaccagccagagacccgctccccagccgagggaggacccgtgaactctgctgtgaacctggaaattaccaagcaccacagcatgactgccagtgagacctgaggaccctggggccgacccctctgcgggcaaatgtggcgcatccctgcaggctgggccacagcagccctcccttgccctcccccacgctggctttcttctttaaaagagaaaaaaaaacaaaaccctgtgaattcatcagagcagatagtctgctggggcaccaagcccgagacgggcatttgtgttccgtgctgtgtggatcaggtttccccgctgagatgtttaaatcccaaggctgcccatcggcagcagccagctccactcggcaggattcggaattttcctcctgctcctgccaagtggccaccacagctgtgcctgccgggcacagggcagctgcccacacccctctgggtaaaacctgggattctcctgcctacggtagccctgtcctgactctcagtccacagtgtcttcacagttcatttctgtatttttccaccttgtattctctgttctgtgtgtcacatcccttgctcccctccaaagagagccaaaggtctaaactctaatgaatgccaggcttcaaaggaatagcccccttctcccagggggacaagagtcccatgctctggggcaaaaccccatcttcgtgtccagcttgctcgtttcccaggtgcctggctcacaggtgacagagtacagggtcaggcagaaaatccatgcggcatgcaggtggcgggtgcaggtgggatgcgtgagcatagagtgggcaggtctccgctgggcatctctgggcaaagatctgaaagaccacaagccagtcttgccaaaccctggggaagtgtccggcaggcaacagtgggatccttcccagaggccactgccaggcctgactgagccggggcctctcccatagtgacttctcagccctggtcctcgcctggcagggttggccaaacctcacttctccctgctccaggcggggacatgtcacagcctctgtgggaggccagccggcatctgaagcaggggcagagtcttggagactgttccctcttgggctcggcctgtttgttccaggcatggggagagaaggcgctggtgttgctctcaggatggcagcccttgtggggcctgcggttggtcactcggggtttgcagctggtactctgaccccgtccaggtggggccctgtgggagagtggggagggggcccccacccaccctgccaccctgatgtaggttcagtcagcggagggtggtctcacccctgagccctgttgggtccctggctactgagtggccccattattttcctccgtttcctgccatgcggggtgggaacaggaggcgagccttgtgggtatgggatggactcgagtgcggagctgtcattgccactgctgagtccgctgcactagtcagggctacagccagcctgcagagtctccctcggcaggaatggactgctgggaccatggcctcagtcctccctccccaccggtagggtctctgatgcgggggcattggggctggctgccccacaacaggcagctcttgcctggcagatggcaccagggttaggaacactcgctcctgacagcgagcccagaggcgccctctggtgagcctccccgtggcgcccagctctgccgcagactctcggtcccctccgtgctcagcagtgctggtgtggagaccgcagtgagtagggccccggcgggcaggagcccacgcttggtttccgcgcttgcggccggcgctgcacgtggcccggccgccttgcttttcccgtgtttcccttgtggctgctcatccctgtgtccatctgtgctggtttctagcccataagccttggagagaaggggccttacagggttgtgtcccctgcccagtgcctggcccgtgggggaccatcagtcaccacaagggacttggctggagctgagcagagggacccgggtagttagggcacagcctcccgggtgtcaggggtgcgaggagtcaggcggttgtgggggttcaggaagtcgtcctggggctcaggaaggcagggtcctggattcccaggtgagatgggcaggtggggccagggccagagccagaggccaccaggtgggtctttggtaccgtggcgggtccccagcccctcccctcagaggcaggatgtggtcctcgccggtagggcctctcctcctgccctgtgtgaggcagggggctggggaagggccctgacggagccactcctgccagcctgcacactgggtcctgcctgggcaggtcgtggggccggggtggcctccgcccagaaggtgtggtttcgcagcccgctggcttcagttctcctcccggcttcccagaagagtccagtctcacatcagccactcatttccctctccggcagccgctggctctgagcacgccctctctcgccacaatcaaaagaagtgaaactgtcccaggaaatagagtggaacgccccaaaaacacctagggagggggggctccttcctcctaatgccttcagcagaaatggagggcagccccactctcctgccccgcaagggacagttcctgcttctcacctgtgccagagtcagccctcccgcggtgggtgtgacgaggtgattttttttttctttcttctttcttttgagatggagtcttgctctgtcgcctaggctggagtgcagtggctggatctctgctgactgcaagctccacctcccgggttcacaccattctcctacctcagcctcccgagtagctgggactacaggcacccgccatcaggcccggctaatttttttgtatttttagtagagacggggtttcactgtgttagccaggatggtctcgatctcctgacctcatgatccgcctgcctcagcctcccaaagtgctgggattacaggcatgagtcaccgcgcccggccaacgaggggatttttaagaagcttccaaggtgctgtgtggctgagttgagagccaccaacccacaggcaggaaagggacaggggtcagaggcatggggcctgtgctcactgaatgcccggcacaccccgcacatgaaggcaggtggacagaaagggtcccgatgcgtgggtgaggacagtcccgtggtgtgggggcttccagagccaagccttggaggagggccaggaattccttggcaaaggggctggtgtctttttgggcaggttgccaggacacaagaccagccgtgtactccgggcaggctaccttttgcagaacttggggttgggggcatttgcactcatggtgccttgggctgtgacctccaggcatgggctagagggtacaccaggtgcctggcgtgggcagagccccaggctcaagcttctcctgcccccgcacttcctgctcttgggtcacttcctcccaggctgggtcctaaactcctgactgccctgctggacaccccccagccccacacagccaacgcagtgtggcaccacacggaccctcatggcatcccttggccacgtcttgtgacagctcggggcaggcaagcaccaatcagacctggggagcaccaggggcacaggccatggcccacggcacgcaacacctcactctcctgcccaggccgtgtgtgcacgtcttcacacaagtgatcagacccgggatgttaaatttgccgatgacttcagagatggcacaccctgtgacacttggcccccagagggcagggccaagcttgtgacctcaggcggcctccctctgggagcctccatttgtggcagggcctggcagccactcggctcttcatgaagcgctgtgtgctgggaagggcctcacactgtccatcctcactctgtgcggcatcccttggcgccaggcacacatgggatacgtggggtgaagaaagcaacgcctgtgctcagacagcggtgctggggttcagtggttcccgccatgttccatgggacatttcagggctgtttttcgcatcccaggcgctgtcagagggagtggtttgggaattcagtgcttgcttctgccttcccaccacacgaggaaagacgctgtaagtgcctgtcattgtcatcgctttcaccgtagctgagagccgtgaggaccaaggtgtgccaggcctgtgttgactgccttgtgaaactcagtgtccacatggggcaagggctgggctgtcccatcctgcagacacgggcaccagagcacaggagaatggcggcctccctgcccggctgcctgcacctcttctcgtaactgtcagctcctgctgcctctcccagccaagctggcaggatttttttttttaagtagaccccacatactcaaggatgggggcagatccccacattgctatctgtggggatgtttgtgtaggcgcttctggaagcagtgtcttctgagccatgtgttctcaggctgaggctctggactccaccgtggcccagatggggcctactgtggcagggtccccagtgggtatgtgagtggcagtcgggacacacacaggtgggcaggccacccccaccctccccctccccctgcaggcccaccctgctctgcaggcagcgtgtggccctggggtgcccacggcagtgcctgaggtgtgtgtcctgatcacttggcctcctgcctccagctgtggatgcgatgtggctggaaggcggctcagggcctcctgtcctcttcttcctcctacccctgggctcacagcgtttcccctcttctgtcctctagctggtcagtgagaaggtcggaggggccgaggggaccaagctggatgatgacttcaaagagatggagaaggtgaggaagaaactgcgtgctctgtgtggtggtggcactgctggggcctgacctctgccgggcatagtggaggcggccaaccttgatgggcctgggtctggagtgatggggcccggcaggtgtggagagatggggtggtgtgggggcctcgtcagctggacttgacgggcaccagctctctcccctgccgtgggcaggcagctgtggggacatggctgagctgaagacatggagagggggttggggggtcctggtatgggctcttagggcaggaggcggtgcagcagcgggggtcttgtgtgccttgggcccccactggctgtggagtcttatatgctgcttctcttcacagaaggtggatgtcaccagcaaggcggtgacagaagtgctggccaggaccatcgagtacctgcagcccaacccaggtgggtgctccagccactgccagggcctgccccaggccctctggcctctgtgtcagagggaaggcaggggatgacagaaccgccaggctcatgggttgtgggcttcaggcacagctggatcccggagtgcagaggccatccttggtgctgcatgctgcctttccacctcaaccagcagctcagcccctctgttggcttcactctcatgccgactggttcctcagggccgtcccagccttcaacccctcttccagccagcagtcctggcagggagcctctcccccagcttacttgtgggatccatttgtattggccgcccctccccagtgcccctggcctggacttcacctcttgggcttgggactgggtctccctggctgagagacgggcttttccccaaggaaaacccaaatgctggctccataggaggccacggacagggggcagacgcacacccagcagtgtccactcaggccctgccaggagcagacccaagcgggcagcggaagggacacagctcatcacccaccccgggagccttggcctcaaccaccccccgctgcacatcactgctgcgcctcctccctggcaccccccagatgaggggtcatagccacgttccaagaggagcagcccttggaaggaggaggttttgccccctgaggagcttggtcacctctccacccgctgccagctcctttgaggctagcaggagcagggaagggaccctctggggattccactgtgctttgtgtggcctaggctgtccacaggcacaggaagcaagggtggggaggagatgtgggggctgcagtctgccagggcagaggagtgcaggcctcacagcccacacccacctggccatcctatcccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgagtggtgctctctggaagccacgcccaccgtccctggaggccacacctcaacacaggcagggcaggtccaggccctgcgtgtgctgagtgccggggacgtacagtggcccccacagctttccagctgcagaggtgcaggagactgcacagaccaacccatccagcactggccagcagctgatagggccccttcctgtagctccagaccttccccaactcaagccagctgcttccccagggcctggaccccccagcatctgtccttccacctgttaagggcaaacctaggcccttttaggagcattggagggtctggtttaacgtccagcatcgattcggattttaggatcctttgttttgccctgagttccaatttccgggccctgggcttagagtgttggggggctgttagaagttgggatggggccaagtgtggtggctcatgcctgtaatcccaacactttgggaggccaaggcaggtggatcacctgagatcgggaattcgagaccagcaagaccaatatggagaaaccccaccccgcttctactaaaaaaaaaaaaatatatatatatacacacacacacacacacacacacacacacacacacacacaattagccgggtgtggtagtgcatgcctgtaaccccagctactcgggaggctgaggcaggagaatcacttgaacccaggaggtggaggttgcagtgagccgagactatgaaaaaacaaaacaaaacaaaacaaaacaaaaaccgggtgcggtggctcacgcctgtaatcccaacactttgggaggccgaggcgggcggatcacaaggtcaggagttcgagaccggtgtggtctatatggtgaaaccccgtctctattaaaaatacaaaaattagctggatgtggtggcaggcccctgtaatcccccttactcaggaggctgagacaggagaattgcttgaacctgggaggcagaggttgcagtgagctgagatcatgccactgcactgcagcctgggcaacagcgagacttcatctcaaagaagttggaaaggatccaggtgtgggggtgaacgcctgtggtcccggctacttgggaggctgaggtgccagcatggcttgagcccagtttgaggcctgcagtgagctggtacagcgccactgcgttccagcctgtgaaacgctatttcaaaaacaaaggctgaggagtgtctcagtctagtggtcccaggcccggtatgatggcttcccccaccacttctccacaggtgacgcattgctggatgccggcgagtccatgaagcgcctggcagaggtgaaggactccctggacatcgaggtcaagcagaacttcattgaccccctccagaacctgtgcgagaaagacctgaaggagatccaggtgctgctcctgcgccagcctggggcctgtcccttccccctgccggatggggcagccccattcctgccaccctcacctccagcctcggcactgccctctgggtctcaggcaggcaggatccccagtggtgcagggacagtgggtcaaagccatgcgtggggcggccctctggccgctactggtgtgacccatgtcccccacgtctccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacgtgagtagctcggggtgtcacatcctgagaagacctatgcccttgggaggccggggtggtgcctcaagggagctggaggacagatcggcacctacctggccgctgcagcaggggaggtggagggtatgggccccagtcccctgtcccctcagcccccttgcctcctgtggcttcacctcgggagtcagggaaggcacaggacagtggcactggcaggagcccctgagccctactgtccccacagatcgagcaggtgagtcagctctcggccctggtggatgcacagctggactaccaccggcaggccgtgcagatcctggacgagctggcggagaagctcaagcgcaggtgagcccagggccttggtctctccagagtctgggctgccatgcgccctctgccagcgcaagtgggcagcacacctcgctgtggggtgagcacatggcagagcagcatcctggattcttcctggggactgagtggaaaggcctggggggccgcgaggtcagaggagctggggctctgagaactctgagtcaacaccaagccctgccccgatgcaggccccggggactccctccctggctgcacgttgctgctgccacaggaacacccaggctcccctccctgaatgcagaggccagacctgcttcaggggccttggcgtatgtggggcgccgtccgtggtggggaattgggggaggaggcaggggatgcgactgggggtgttgtaggtagatgctgtggcaggccccagctgcttggcaatctctgggatgcctccaaggtgggggtccaggctggaggccctctgggtagacatcccagtctagctgtgtcccagggtccatgtgtcacaaccccactgacggcctcttcctgcagtcccaggccaggtcattaggcagcagcataaatacaagagtggggctgcctcggccgtgacacgggctcggtccactcacgcctctcccttcacaggatgcgggaagcttcctcacgccctaagcgggagtataagccgaagccccgggagccctttgaccttggagagcctgagcagtccaacgggggcttcccctgcaccacagcccccaagatcgcaggtaatggggcatggagccctcttgcggaggcaaatgccagcgggtgggagtggccaagggctggccctgtcctgggtctctgagcgccagactcctgggtgcagctctcagccgtgctccatctggaccgccaaggcagacgggaagggctggccccagccttctgcagaaggggccctgcccgaccgttttgagcccacagcctcctcgttttgcttgtgtttagcttcatcgtctttccgatcttccgacaagcccatccggacccctagccggagcatgcgtgagtgttcccaggcccgcctcgacctcagtgctgccttctcggccattcggggagggtgtttctcctcccgccctgttctctgcccatctcaagcagggaggggccaggctcgtgcagcagtagggggcacaggccccacagcctgcaagatgccacccctctgggtctcagcctcacagtgtgaatgagggattgccaagggcactagcccagctagctctaggctgtgtggtggctacaagggcttgagggcatctggtcactccctgtcaccgcagcagcaccgggtgtccccagcacttcccaggagtagctttggtgaccacttaccaagcttctcccatcctccctcctgggtggcagtagaggccggaccccagaagtggcaggggcagggggtggcccaggcagggcagaggggaggcccatgcccacccacacgctccaggtcacagcaggtctgagaccccagactgggcggggtgaggcgtagcagccccagccccacagcccgctcccgcccccagcgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacagccccttgcctcgtcttggtgcaggggtgggcctgccacccaccgccttcctgaggggccggctccaaagccacacacaccccaggaggtccctccagcaccccaggtgctcctgagcccaaggtgggtgggactggccctgaggcttttgtgccagttcccaggtgcaggggctgaggggtatcctggaagttaatgccctgccctggaagtgaggaagctggggtgatggtaccagcctgggcacccagccaccctcaccccagccttggggagaccagcgtggctggctgctgcttccgtttctttattacctgagcccatccggaccctcaagacaactggagcccaccctgccctggaaggctcagctcccctgcttgaggacgccgcacacctgttccaggacgtgacacaggctctggtccttgggcgtcctgctggccaaggagatctgaaacgagggggctgggcctcaggctgtgcccgggggtcctagccagccctgcgcctcacagtccaccgtgcaagtccagcatcctgactgagcccccctgagaccgaggcacagggctggggtcccgcagcacagcctgctgcttacccagtggggcagtatgtaaccgagggcctggctcccaggggcagcggtgctgtgtggaggggtggggcttatgtgcacactcccgatcctgcccccacttcagcccctccctgcctggttccagacacccatggggacaccacagcctccacagctagccgagagctgagcagaatgagtccctttctatgccaggtggagggaaaccaggaaccactaccctaagacactcaggggtggccaggaccctgggccctctgcaggggagccactcccaaaacccgctgccaggacctcatccggcactgccggagcttaaagctccacagtccaatcaaatctggcctgcaccctgctggggtggccacggggtgaccagggtcaccagtctgccagctgggctgtctcaggcccctgaggcccacggggctcattgctgccaccttttaggctgcccagggggcctctcctggggccccgttaggaggtctgcggggacttggggctcaccttaagcttgtcgaggtaggtgtgctcctggctccagggttcctggagcctcacgaggtcaggggaacccttgtagaactccaccagcagcatctacaggacagaggagcatggactcccaggctccctccaagcctgaggtacctcagcgcctctcctggggttccagtctcaggcagccctgagacatgaccccatcactaacaaaccaaccacaaagagatcacgagtgaccttagccagagggctcacctagcttaggtccaggagggctctctcgagggggaggcagcagcgttgcccaagtggctgccacgagaggtccacctggacctgcactcaccgagcccagttctccagaaccacgcgggcctgacgtggccccctggttcggcctcatccccagcagtgacacctgtgaggtcacaggtttgacgaactagtttaggttttgttgggttttttccttgaggtagggtctcactctgtggcccagactggagcgcagtggcgtgatctcggctcactgtaacctccacctcccgggttcaagagcttgtcctgcctcagcctcccaagtagctaggactataggcacccgccaccactcctggctagcttttctatcttggtagtgacagggtttcgccatgttggccagactagtctcgaactcctgacctcaggtgatccacccacctcagcctcccaaagtgctgggattacaggcgtgagccactatgtctgccttagtttagtgttttaaatgcatgttgaacacacaatttttaagtgttcatccagttaccacccaaagtccctggggtttctctactggacagcctggcagaagaggccagtgccttagagaacagcaggtgggga

SEQ ID NO: 12173 - DNA, 221958 bp, Human
aatgtagggctcagttaagtattcaaagttccaaggaggcaattcaggcccccatttcacacctttcactgttagagagcggagctcctatccatcccaggcccttccactttgtagatcaattgctctatcttttggcagcttcaacaaagccctgtcttatgaaaatgctttattgttcagatcagggacctggtagtaaaaattaactataaaatacttttttttctattatgcaagtaatgggtagcctttttaaaaattggaaacatagagaaaaaagtttattcctaacaaccggagcctcagtggattaaaattactcaggtttctcactgatgctacatgcccattgaacgtcaggtggggactctgcactgctttagtctcactctggatactggctgacagaccacagctttctagaatattgcggccgaggaaaagaaagctttgcggcatctcatacatctcatattgctgctgcagaagtgacagtcacttttcctcttaaacctctagtcaaaacttgtaaccatgcctccacttaacaagaggtttggaaagtgcaattctgccatgtagggaaaggtatatgaacagtggtaagggctaccacactggagaatagctcctttcatctgcctccctttgcagcctgcgtccctagtccatgcgctctactgctccagtgcccaccactgcttgactctgcctttgtgtgtgtcagttcacattatcaagaaggaccatgactggtagctctacggatggaggacccttttgtagcaggtgttcaccctgtgcccaagccgcagtgcctagaagagtggggatgggtctgtggctcctatcaggctgcaggagttgcggagacagaaaaagtatttctaggactcccatttggccttgcagtctctacacatccttggcaatttctcccatcttggcttctccttcttatcactttggtccacatacggggacagcgtctaagttctttctgaccacctcctcagtcctagaaaaaccagacttggttaagtaccagagcacagaaggcatttagtgctgctctgctcccaagtcatctattagtttcactttagccagccatacctccttggttacatatgaagcatctgtatataacttagtatcatgctttttcacattatattttgatttttatcggaccggaaaccctaaatccacaagcataacaacaagatcacatttgggctttttcatttctgtaaccagaggattgaacgctagttttgtagtaagacttcaattctatttatctgtccaggcttaagggttcctgttcttctttttaagtcattaaattgtatcagacaagggggaaaacgcgtgtgtgactttccctaaggtaagatgggcttaagggatattgaaaccagggcagagaaatgttttctgtgacccaccagtcagggcaaggcatagaaggagcaatgacttattcattagcccagatagaaggccagtctttttcaggctgcggcgcagagacgccaggctcaaagggcaggagggccgtctgcaggcagcgccgccgcggctacctggaagcccagcaagtcacctgagtcctgcgggtgcctgggctgccaatctgcagcgacccgtccgcagcccccgggggcaggaacaccaaccccgggacaggaggacgtcctcggcccgctgactagggatccgccagcgggtgccgctgagccacatccccgcagttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcaggtaaggcgcgcggcaggtgcgtcccggggcagtccggggcgaagctgcgaggggcgcgctcggcgctggccgtccggcggcagcttggggagttcggcaccgagcctcgcccgcgccggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctgtcccgggatgtgttggcatgagcggtggccgcactgggggtggcggggcggaggccggcggtttgcgctcttctcccttaccctgttgtcagaaccctccttccccgccgcccgcaggctccaggggaatggaaggctggggtcttcctttagggacccgcatacattaacttttacctggagaactcggtcgtgaaactcctttgaggccagggcatgacaaacagtctgcgggtcttaaatatttccctaaaacaaccaaattgttgaagacttaaaatcatcatgtattttaaattgtttttaataaatctttggcatcttggatgtgcccatttttctttatggggttaataagctgtgactgtaataaaactgattaatttagattctaataattaaaatcattggactcaaagaattttacataggggcaagtaagcgaatacttacgctgtgacctatttcttacataatgtgtgtgattactacttttttatccttctgaaataggttcaaatttatgggatctttaaggattttgatgacttaccgcgaaatgtttttcatgatttggtgttaaatagtttttcataggttagccttaattaacgagctttctcataatttctcggaagtagtgaggtttttcctaggctaccacagtggcagccttgttatgaaccacatccagaaaaggtgagggttgtgttttacagaaccttggttaacttagggtgacagatgcagcatgtaattcccgtcgtgtgtgtgtttgcacgcatctgcatcatcttcatcacacattcttgcctttatagaatcaattatacctgtcaacttaggaaatcaagaaaagtaagactatttctgtaaaaatgtttcttaatgtaattatttttgcttttctattataattggagttatctgtgacctctctgccagacatgtttatgaaagtaagtgatttgtttgttgatgtagtttggaaggcttctaataactttatactgcaagttctttcaggtttacagaaccaagcatatgtgctgcccaggaattctgtggcaggacttcttcgatattactaacctttttgattgctctactggtcacttctctatagcatatctcagcactgcgtttaccaacacatcttttttccacttggattctaaagatttcttttgcaaagcttagtgccctcaaaggcaattaagagtcttggctttggagtgggaaaggctaaggtttgaatcctgcctctgctgcttctgaccttgagagagtatttaacttctgaacctgtccatgctgaagtgatgataatttccgttgtctcttcagggttgaggtgaagagaaacgagtgtgtagaacacacgtataaagtgttcaataaattatagttattgacataaaggatatttttattagtataaaatactatcccttatgctatgaagaagttacccaaggtagaccttttagtttttccaacttaaaaaatagagcgctccatttccgctaaatcttgaagttctgtgtcgccctataaagtgtagaaaaaataatttaaactgcgttaggaaagaacttaaaaggttggagaaggtcggcatgtgatgcgatacggttaatgtttatcacaccgaatccaaatgcagaatcactgcgtcattgtcttccttttactgaaaagccttttatttgaaaggtgaagcagcacgtagtctcttatccataatttagtgtagcacactcttagaaagtctaaggcacaggtgactgttctgtgcatatgtatatttaggagagtatgtaaagcccatgttaatgtttgcatgtgacaaaaaaattagagaaatagtcctgtcctacttttgtagccatttttttccatcaggtccgtgaacctgatgttatctacagagaagctttagacctagaattacttccttttgagaactgatgtgctggataatatagcctgggtttgtttgtttgtttatttatttattcatttgagacaaagtttgactcttgtcgcccaggcaggagtgcaatggcgtgatctcagcatactgcaacctctgcctcctgtgttcaggcgattctcctgcctcagcctcctgagtagctgggattataggcatgcactaccacgctcagctaatttttgtatttttagtagagacagggtttagccatgttaaccaggctggtctcgaactcctgacctcaggtgatctgcccgcctcgattacaggctgagcccccgcacctggcctatagcctgggtttataagtggaaggagtctgttcacgcaaacgtttctttctatggaattgagcttttttgcttgtgttagtaagcgatgataaataaaacagtatattgtttgtacttggaatttctgattaaatgtgtcacaactgttgtcttatattagaattggttatttctaccttgttgctgacagttattttcaatatgtttacaatttggaggtaaaaaaatgcttttgccaagtaaaatttattagagaagaaaatcctttcagcatgaaaatatataatgataccaaaaattgatcatcttattttcatgtacttcattacttaattgctcataaagatataatttactgtataattagaataaagtattctttttttactgtaataaagggcagatgatcttgtgttgctcttttagtgagttttattcatattgagatttcattttacaaaagtcatgtcagtttttttacacttgttttaaactggcagcagcttagttaaaaatagctgtttccagtgaacatgaagctcctacaaaatctgtatttttaaaaattcactctatcatgcatatgatgtggacacattttgctttacaatatgtaaaagtctattataaagtaaaatatattaggtcattttatgagtttgctggagctgctgtaacaaagtactacaaactgagtcgtttcaacgacagaaatacattgtttcccacttcttgagacaagcacacttgaagtctgagaccaaggtgccagtagggccacgagctctctgaaggtatgagacaggatctattcgaggctgccttcttagctcttgtgctttgttgggaatctttgggcttccttggcttgtagatacatcaccttggtctctgccttcatgctcacatgacattctccctgtgtgtgtctcagtgtccaaatttccccattttgtaaggaccccagtcatataggattgggcaagcccatcctactccagtatgattttatcttaaataattaccatctgtaatgcccctatttccaaataaagttgcattctgagctattgtaattaggactttaatatgaattttgggaggggcacagttcaatccataacagtcgttatttgcataaaaggattaaccacagtattctatatttgattcaacatctaagaggacagttcagcctataaataacatataactttctattgcatcaaaaagatatactttctccttttttaatgagttggttagtatattgctaagttctgaatgtgtccctctaaaatacgtatgttgaagcttgactgccaatgtgacagtattaagaaatggggcctttaggaggtgactaagtcatgagggcactcatgattaagtcatgaatgggattagtgctctcttaaaagaagttgaaggggtcaccctgtccccttccaccgtgtgagggtttagcaacaaggcaccatctttgaagcaaagggtgggccctagccaggcacaaatctgttagtgccttcatcttggactgctagcctcccaaactgtgagaaataaattctattatttataaattaccccgtctaagatattttgttagtagcctgaacagactaagtcagaaatatacctattataaattgtgttttctgatttttttaaatgataaaattaatttgggtaggctgggttttatgatacagtctggtatatgtttatttgtcacactcagattccttaactgggaaaatttcatcatgtttgtgttctgtgtctttttgttttacctaatttcctctttcagaatgctgtattttatatggatgctttgctcaggagaccattacatgagtcttttcatgcatttgttgatttggtgagatgttaaacttactaagtattggattaaatatctaattagttatgactttatctcagtgagattttcagtttcttaattgcctctaagcagtcaactctctgctgcctttaaaatcttggctgtggcttgttgcttgacccaggatttctacacctgtaccctttcacattcttagccagtagtctctaataggctgcaaggggcctatatattttataaaattataagtaacattttatacatgcatttttctgagggagaatgcccttagcctgttaccagattcttaaataaattcctaattgctgccccttcctcccctcgaaaagtaaaaatagggtggggcgtggtggctcactcctgtaatcccaacactttgggaggccaaggcgggcggatcacttgaggtcaggagttcaaaaccggctttgccagtgcagtgaaacctcgtctctactaaaaatacaaaaagattagctgggcgaggtggcaggtgcctgtaatcccacctacccaggaggctgaggcaggagaattgcctgaacccaggaggccgaggttgcagtgagtcaagatggcgccactgcactccagcctgggcaacagagtgagattctgtttcaaataaataaataaataaattcatcatgtcatcaggagaaagtggatgtttcttacaataatcactccaacagttctgttactgggctttaggatgcctgatcaaaatgcagccttctctgcattaatttagcagcaatcaaatgtaaaaaacctttccagaggtgtcaggattgaatgaggtaatgcttgtgagagtgccatgcttgcataataaggatcacttgaaccatgtaaaacaaaatgttgttaatgcgcttgaagtcaacgatacgggcctgtggggtatatgaaaagaaagtggtgactgaaaatgatttctctgtagactgagagtcctcgtgattgaagtttgtgttgttgaaacagctatatttttgcaagcttttttccccatagtgattctttaatattttaaattgagtttatatgaattttggtttcagtctacttagaaaattttaaagtaacctgcaaattaattagaagtaccctagaaaatggcaagacttggttggggcaaatggtgactgttttgagacagatgtcattgtggaagggagaggtttaatattcaggggaagggagctgaagcttgcagagcagattccattctgccaagcctcttgtgctgcatacagagtctcagggcatcaagcaacccgagggctttcttcagaggagtagcttgaggcagcggcgagagaagggcaggacacactgacaaatgaataatgagaattaggtgaggagatggagtttaagaactgcttcaaactttaaggtggatacctgatggggctttctagagatgagcaattcttctcaatttaaggccagataggggagatgctaagtaggtaagaagtcagtggattttttggcctccttttttctctttttgttcttttaatccttcgtacccttgtcctgtgttcttttaggtaatgttcagtgaggtgtagccacaagaggggacataggagaggctcaagaaaacagagtttattatactcacatgtcttagaatgacaatcactgtacaggaggataggaggggggacacgtggggtggaggtgacagctctgagagcaggatcagctaagcaggtgggaaacaggtgggagcagagagagcaaggactgtgggcaagtgcctttactagtgatctcagtgcagttcacagctcagtgcagttcacagtgcgttgcattggtgcattggtaggtcgtggtcagaagaagacagagaggtgaacttgtggtaggggccaaccttatcaaacttgtgcacctggttacctgggtggggtgttcacagttagcgtatgtgggaatgaatgttgaggcagcaagaggcagcaggagacaacatgtgaagttttgaaactttgtaatacaacccttctcagtgtttttagtttagaatttattgtttccataatcacttaaggagcctaaaagcttaagaatgatgtacatggtatccgatggataataaagactaaagagagctataactatacttattaaaatgccatgattgtgagaccctgccaagtcttttgcattctaccaacaaaatattttcatgctatactaaatcattagctgatgacaaatgcttcaggaaataatttcactatttataaaggttttacatttagtacaacttctaaatgccaaatatgatgttgtagttgctctaccctaatctccctccgccatcccctgggtcaaattgtatatagtagtaatgaatatggagaagctgtctgtaatactcgtgaagaacccacagctccatggaggtttacttggatacttaggacactgaaggacctctaggcagtgttttctgcctttttttgaattatgatatatataaaaaatagaaatatcttttttataattcaaactaacctttccccatagatactaatggaagcagttttataatgctgagaaacatctcaatatcaagctatgtattagtctgttctcatgttgctaataaaggcatacccgagactgggtaatttataaaggaaagaggtgtaattgactcacagttctgcatggctagggagggctcaggaaacttacagtcatggcagaagggggatcaaaaatgtccttcacatgacggcagcaaggagaagtacagagcaaagtggggtaaaagccccttataaaaccgtcagatctcgtgagaattcactcactatcacgagaacagtgtggcggtaaccacccctatgattcaattacctcccaccaggtccctcccatgacacatggggattgtgggaactacagtttaagatgagatttgggtggggacacagccaaaccgtatcacagaataatgcttgaaagaaacataaagcagatagcctatgcttttaaacgtacaggaaatcggctgggtgcggtggctcatgcctgcaatcctagcactttgggaggtcgaggcaggcagatcacttgaggagtttgagaccagcttggccaacatggcaaaacctcgtctctactaaaaatgggaaaattagccaggcttggtgatgcacagctgtatttctggctactcaggaggctgaggcaggagaattgcttgcacctgggaggcggaggctacagtgagccaagatcacaccgttgcactccagcctgggcgacagagcgagactgtctcaaaaacaaaacaaaacaaaacaaaaagtacaggaaataatgtccacagtgaatgacaccagtgaggaaaggagagaaggggagtcaggacagttattgtccataacagtgatggcatcctgcagggggcattgtgaaatcccctgcctgccagtagaggaagttccttggttttacaatctggctctgcaatctgggaagaactcttgttctttcttatatatatttggccaggtctaaggagggttagaggaaatctgccctctttgggaacggcataacttttcagtcaacttcctgtttatttaaatttggggattgttttacagtcatagggttttcactatccatggtagatttgagtaatgaaatttcttcataaacttagtaggcttctggccaagtgcggtagctcatgcctgtaatccccgcactttgggaggccgaggtgggcgggtcacctgaggccaggggttcaagaccagcctggacaacatggtgaagccgcttctctactaaaactacaaaaattagccaggcatggtggcctacgcctgtagtcccagctactcgggaggctgaagcttgaacctgggagagttgcttgaacctgggaggcagaggttgcagtgagccagattgcaccactgcactccagcctgagcagtagagcaagtcactgtctcaaaaaaacaaaaaccaaaaaaaaaaaaccagaaaaacttcaacttaataggcttctgatgtgttttcttgtgagtttcatttgccaatttctatgatggaaattcttttttagacctaattttcatccagtagacttggttgtgttactctgaacttaacaagagggcctgatactttggcttaaccaagaagtcttaatggtactttgttgctcaaagtctttttcatttatatttcccgttatttgcttcagggactcaggatgaccctggatcggttctgccatctgtaacatatggttttcaaggttgccaaagggaaagaatatgtttgaacaagcatgggagatgttcataagccaggcctggaagaggaatatggtagacagaatgctacgattgttggtgactcttgctcttgtgtactctcctcccctttgagtgtgggtgcaatgttcaatttgaaaagatgttattcctgagacttttaactttgtaagacaaaagggagattatatgattggacttaatctaatctcatgagccctttaaaagcaggatattttctctggctggtagtggaaggaaaaatcagagagattggaagtatgagcaggactggacatgctgttgttggtttaaagagggaggggccatgtgagtagtaatgcaggcagcctctaggagcagaaatcagctctttggtgaccatcagcagggaaaatagggatcttagacccacagccttgaagaatctgagaggaagggaattcttcccccaagcttccagataagagcccagtctagccaacgccttcattttggccttgtgaggccctcaacagggagctcacttaagcaggcccagacttctaatttatagaattgtaagataataaatgggtattgttttaagctgctaaatttgtggtaatttgttatacaacagctgaaaatgaagagaaggaatagttccttctgtttatgtttggttggctggaacttgtaacatggcccctctgtggtacacctaagagaaatggaagaaggcaagtgtagcctagctatgtgcccaggatgtaaaagtgggtttttggttaaaaagctagcagttttgctattactggtgcctataattaattaattgtgtgtctgtatattaatctatttgtgagcttgtaagtgtatgtatatgtgcatatgtccatatgtacatacacaacatacatatgcacatatgaattttaagtctagtttgctgaataagtcttttcttaatacataaggctcagtatgttccatgtgccttttgaaactgtcgtccaggctggggtataatggggcgatcacagctcactacagcctcaatcctctgagcccaagcaatcctcccacctcagcctccagagtagtgggactataggcgtgtgccgctatgcctggcccatgtgcctttttaatatattttttattttatagatttttttctacagtgctttggctttttgatatttagatgtttttctctgatgaggcacaagtttatttctgtggctcctgatcagttttttttttaacagtggcaccgttaagtacttgctgagcagtaccttagcctggtgggctggtggaacagtgacaacttctctaaccttggaatagagagactacagatctgcaaagaagtttctgaattcttagtctctgacagtgtggcagggatttcagttagagtagaggagttgactgttaatcctgcatctgtttttgtgcttgggggaaggctgaggccaacacagacagtgaaatgccttacttagtgcaggcacatcggatggctacatggtactttgaagttgttcattaagttgttgaggattgcagatttgtgtagcacatttgaagtgtgttgtggtgtaagcagcagggttgagggtggttgtgggccccgtaacatgtgggccattgtctgtgatccgttagccccatgctctttgacgtgattcatggatccttagccctgaatggttttctaggtacatctggtagacggtgccagacataatttggaaggcatgcggtctggcaccctgagatatattttagggacttggtgtcagttgagcagcttggccagggagagaatagtgaggcctgattttgtatctgagtggtaagtaacctgaaggagaggtgtcctgtagaaattgcagggtggacacacctctcacttctgttattttctgcatatactggttgctgaggtgaccctaatgtgcttctttctattgagttaatgtgtgtacagtggcttgatggctgaatttataccattcattattttactgcttaagtggctgcatctgggcaagaaggacctacaaaccctttgccatggccattgcacatcatcatcatataatacactggctaaaggaagtgttttctggaggtgttcatcagtactgtagttaagagtttactgattaatattaatagcctgttatccagagatcttctacttctgatgatgaaccttgcacttaagttctgtctcccatttcactttttagttaagtttaacaaacagtaaaactgttttccattattctcttttccattcatctcatccattatgctctatgtattttgggccatttgaagctgataaacctaaaatctttggatttttcaccttttgatcattatattcaccttaaacccagtccaaattttgcagatatatttatagtgctcatcgtccctatgttctagacatggaaagctccttttccctagctccaagaaaagctggaagaatgtcattctttacacaacttaaattgttcagaagatatttttgtgatcacaaaggtgtatttaattcatttttgttttattttgtttttgagacagggtctcactctgtcgcagtggcgtgaccacgaatcactgcaacctcctcctcccaggcccaagcctccctcctcagccttccaggtagctgggactacaggctcacgtcaccactcctggctaatttttttgtatttttggtagagacagggtcttgctacattgcccaggctggtcttgcactcctactcaagtgatatgccttccttggcttcccaaagtgctgggattacaggcatgagccgccgcgcctggctaacatttaattcactttttacaagctctttcagctactttctgtgtctgaagacacagacatgtaaagcattttgatacattttcaccaaaaaaatcaccttacataaaaggacgtgtcttaaacagaaagcttatcataaaatctctatatcaattgttttcctaaattgatgactgttacgtcttccccttttgtgaaacagtgagttatactgatattttgtgatatgtactggcttgccctttataatatctaaattacctaaattcttagtgttgtcacccctccagtgccccccaaaaaaggtcaacaggtcagagttaaattagcatttactcaggaatggggtttgcaacctggctagcagtcagagattgtaccacccgagaagggcaagggggctatttaaaagaacttatttagattacataaattgcttgtcacattatttcattggtgtattaaacaagtctttaatcagtagtagaagggtacatttgtatcagttattcaggaaaaacctatatacagagtgtttgtaaagattaggaccagttttacttgtattgtgtagtgctgagagcacggttgtttgtgaaggaatgtttttcacagttccttttcgggtctcaaagttcatcagcagtttaatatggagtagtagcccaagatggagttactgatataaagcctggaacattgctaagctcatagtgtccagtaaaactgtgtctactggttgctgctgtgaatgattcaggtgaacgtaggcgttttctgtaggcgctttccacatgattatggtagaataatttgattgtttcctaagcgtatcattcagttgtatcttcatgacattttgtcaatctgtattcatgtttactgactatataagggttcaccagcaaaacagaaccaacatgatatgtagatacatgagagggatttattatgggaattggctcatgtgattatggagactaaatcctgcaatatgctttctgcaagctggagaatcaggaaacccggtggtgtaatacagtccaagtccaaaggcctgaggccccggggagctgctggtgtaagccccaaccccaaagtctcaagaatttggaattctgatgtccaagggcaggagaagatggaagtcttgcttaagaaaagagagcaaatttgctttttgctcttcccaggccctcaagcgattggatgtctgctgccctcagatcttctttgctcagtctactgattcagatgctaatgtcttctggaaacaccctggcagacacacacagaaatattttaccagctatctgggtatcccttaacccagttaagttgacacataaaattaatcatcacactgacttaatttaaaactgaatcagtgtaccattttcttaaatggaaaaatcactattaattatcatgcaaaacaaaattaagtcctggatactcttgcctgagtaaatctgtgagcttgaggtttattctgcctttgttaaaacaggagattaacagataagtagtagatattctaacaataccctgagatttcctccttcactaaattagaatggaagaagaataaaatggatattttaatttggggattcagtgttcttaaggaccatggtattgtgaaatatgtatttcgtctccctgtttcctcacagaaaaaaaacctctaaaacccatgggatcatcagggtggtaactgtcttttctctgctacgagatgaccagtggctggggactcctatagcttcaggttggggactgttcaccagaaagaccaatgtatgcttagagggttgggactttcagctccagcctccttagaggggaaagggggtgaaggttaagtggatcaccaaaggccggtgatttaatcagtcatgcctatgtaatgaagcctccataaaaacccaacatcacagggtttgggaggattttcagacagctgaacatgtggtggttcctgaaagaggatgtgcctggagagggtatggaagctccaggctgcttctcccatacctcgacctatgtgtctcttccatctggctgttcatctgtatccttttaatacctttctaataaatggctaaacataagtaagtgtttccctgagttccgtgtgctgctctggcaaattagttgaatcacaggagggagttgtgggaaccctgatttatagctggtaggttagaagcacaggactgtgcttgtgactggcatctgaagccagttgtgggaccgagccctcaacctgtgggatctgacgctatctccaggtagtgtcagaattgaattgaattagaggacacccagctggtgtccagtggagaatcatctgcagaatgggttgctggtagggagaaatccccacacattttggtaaccagaggtcacagaaatagtctgtgctgggtattttgaggtatatatataataggagaaactgtgtttgtttttttcctacatccttacaaggacacaagaatgtaccaactgtcttgttcaaaacatggcccttcccatacataatttgactatggaaatggttgacctttttctgagtaccaaggagttttctgcctgtaatggggtatttaattatattttagaaaaaggaaggtcatttgtttagagcagcactgagtcatctgttctgtgcccgatgttcggaaaggaggtagacatgttctttaagagaagcttttgaagtaatttagaaaatggtgcaataccatccgtcatcaggctgtgtggcacaagatcagtaggagcccagagacttcacatctcctagttttcccattctgagcacttgtgagaccccagaccagtcactagtcacttgatctcaacttcttcctcctcacacccacattttctcagttgcacagctgaggtaatatggtcctgggcatgattttaggttctgacgttctatgcttctggtctcgttcccctctggttcattatctactgtggctatagtgacttttctaaagagcaaatctagcattgttcttcttcttaaaactcttcagtggctccttatggctcccaggataggtccctctgaagtcctgttcaggagtctgaagtgtcatctgtgtcctgctcagtgatctgctttcactctcacactctaaatgtgctctgagttgtagctgtgctagttatcctgacaccttgcaattatgccatacgtttcttgcctttcaagccttcgcaccatgctcttccctctctgtggaaattcccttctttccacttggtatttgattaatcaccactttatcagcttcatattttctcagagaggttacccttccctcatttagtgtgggttaaatgtccttccatgtgcaatgaaaattgcatgttgtgggagaggaacaacacacaccagggtctatggggcgggggtgggagagcatcaggacaaatggctaatgcatgtggggcttaaaatctaggtgacaggttgataggtgcaccgaaccaccatggcacatgtatacctatgtaacaaacctgcacgttctgcacatgtatcctggaacttaaagtaaaataaaaattaaaaaaaaaattgtgtgttgtacctctgtgaagtgtagtgctcggctcactgctatacaggcaccagtctccttgatggtatcctctagggtgggtataaagagaaggaccctgccattctatacttcattctgttgccagttcctagcctgtagtgggcatttaattgataattgttgaatgaatacatagcttctgtttctgttgatccttatgtatatttaaaagggggtcctatgcatatatttttgatgtattcatttctgcttaaaatacatcaccgatttctaaaagttaatgtagaatttaaagcacaccctcataaaattgtaagattgtaagtttaaaataaacttccttcattgtacaaatggctagcctaggtactattttaactcatttattactcacagcaaccctatgaacattattatccccattttacagatgaggaagctgaaacacagaggtggttacacagcttcagtggcagagtcaggattgaaaccacaccacctggtttcaaagccagtaactgccagtagtttttaaccatgagtcctattgtcaccttatatatcaaaccaagacatacctaaaagctcttagtggtcaccaagaagacgcgaacactttagtagaaaaataagacaacaatatgaaaggcagtatttgaaagagcaagtggccaagatacgaatgcaaaaatcaaggaaatcagacagcaatatctgacatttttcattgtttagattggcagagatgaaaaggatagtaacattctgggttagcaagagtataagaacatgggtccccgtttatggtgggagtgtaaactgttaaaacacttctggagatcagtagttctcttccctgtaattctgtttttaggaaactattcacagaatataaatgtataagtatgtacaacttaggtacaagattgttcactgtagtagttattgtggtgaaaaattgtaaacaacctcaataagggatgaggaagtaaatctgtatgtcaatattatgaaatctctacagctattttatctatagggcaatatttattgcagtagggaaacattcatgattattgccaaaatgaaaaaagccagccataaagcagatatgtaatatgtagtaagcctgatattgtaaaaatatagctatgatggtagctaaaatgcactgagaatttatagaccaggcgttatgctgtattgttacagtaagattatttttttaatgaacatttgaacagtgattattcctggtcagtgggtttatgggtgagtagtgtttctatattttctttcttatctttggtaatttgatctattacaaaattttctttccacttcatcgtctttacttgtaaccccactttctcaggataagttgaaaacaaggaatcgaataattttaggagccatcacggggactaggaacaaacccagtttctagccaagttctagaactataaatatatgtcagtttgcttcattaggcatttagcttaaaactattggaacacctgccctgccctccatagagccctgaattaaattgtgctgcttgggtttcttctgaatgcatggctacttttctggtttcaccaagaagatgtgtacaaacattataagtaagcagctgctaatgacttttgctggcatttcttttaaatgaagatttttttttttcagttccctaagtcttatccctagtgtcatagcattgacactgttttttcgtaaagggaaagagggcagctaagacatgtatagggtattggagtgctcctgtaagatgttcttggtaatttggtgtgagctgttcagcctcattctccagcccttaggccacgagtctcctgggcatctgtcacttcttagcttctcagcaaaaagcctgtaggcagtgccattctagcaaaaaaagaatgaagtgagggagagatacctgagaagataggagacgttcccagtgatccctgttgaacttgaatgcggaacattgttaatagtctctggcaggcttctattttgaagacagaaaatacaaagtttaggaagccataaatggtaaaataatatattcttctcagcaacccaaacaaaatacataaaaatggaaaaaacactaccgtgaaacgtagcctcagtaatgagatgggcaggccacttttgcctttctcccaaagaggacacgtctagcaagatccactggactgctgacggtggtggattgctgggcacaagcatgcctttatggatggtctggctttctctggggcctgccactctttgatggcttcaatggcaagtgcttcgacctctgagataaataatttctgtgaaatcatttctagagtgaagctaacttttccaacctctgcagcatcttgtgatgtttctggggataatattaacttgtaagctgagaaacagttgagactgcttcaagagatttgttttcttgtgtagtaatctgctgaagcatataccaaattgatgtttttatttgctgcaaaacttcgggttttggtccttttaaagtagtttcagatttcagcatttaaaaataattgtcctggcacagtggctcacgcctgtaatcccagcactttgggaggctgaggcgggcagatcacttgagttcaggagttcaaagccagcctgaccaacatgccctgtctgtgctaaaatacaaaaaaattagctgggtatggtggcacatgcctgtaatgccagctactcgggaggccgaggcaggagaatcgctttaacccaggaggtggaggttgcagtgagccaagatcatgccactgcactccagcctgggcgacagagtgatactcagtctcaaaaaaaaaaaaaattactatataacaatgattttttgaatgaaggtagatgtagcataattgaactttgttacttatgtattctgtattatgtgcttgttaggtggttctcttaagagtaagggttttgcaagatgcttctttcataattggacacaacttgtagaaagtgaggtgtgagtttgtttgatttatatgtttttcttatcagattatggaactatccattaataagctactctagaaattatttggatttaaaaactctctttggagagttgcaagggcctgcctgatctgaccctggcctctccaccctgattgagggccagtttttcccctctttatgctctggtcctccatctttcttaacaaacagtaagcattcgcccattaaccgccaggctctgtgctgagttttaggtatagagagatggataaaatactcattccctgcccccgtggaactggcagtgcagtgtgggagacagaccaatgattatgcaaatatataattagaatttgtcacaggtgcagcaaagaacaatgctagggcactctcacgtggaggtcatacctgacattctgttgtggagagaggccatgttcttttcagtatgtagaaaggttaaggttgtctatgaggtgcagctggggaagctctcaccagctgacgtcattcaaaaagtgaacagggtactactatttgcacataaaaaagagcaggttatggtttcacagacactttagattcttattcagagaggatagctttgagggtaaagaactacttctcatgtcttactgaagctagggtcatggaacatctccagctggaatagtttctgttaaataagattgtatgatatgattttacatcattatctttcttaccaaagatcataactctgtctcacagaaatgtgtggtcatgcagtgtttccctgaggatgcgtctttaaactgagaaattgaggctgagaagaaaccaggcctttgcagagttgcgggccaaggggtttgagcccaccccccgacctgcccacttcatgtcatctgggagctagtccactcccactcatcctttaggccttgatccagatgatacttattggaatccctttctctgacctagtaggttggatcaggttccttttattacattcaccatggtttgtgattgtgcattaattttatggccattcgattaaatgcctgtctccttcagttggtctctaaattcctgaagggagggatcaagtttctgctgatctcttggggtagttaccattatgcccattttactgatgaggaaactaaggcacagggaagtgtagtgactcatccaaaataatacacggtattaatggtggaggcagagtttgacactggcagtccatcctttcaaagttggaatagactttaaatgaatcatttaattatttaattggtcaatggaacaaaatggaaagtccagcaataagtagtacattgtggtgatttggtatacaataaaggcagtatttaaaatcatcaaaaaagaatagattatttagtaaatggcatttggacaattagctattcgtttgagaaataaaatttaatcctttttgtcacatcttaaaataaattttaactagttggaaaatatgaaggtaaaagagtgtaaaaagaaaatatggtttcttttgaaatggagaatactttctaaacataacatatcatgcagagactgtgcactatggatgaaggctggtgaatttttgctacttgtaaaaatgaagaactgctgagtagcaaaggatcctaaagatggttgaagtgactaatgggattaagatttgcagcatacaattaaaaataaaatttacaaaacccagccttggcaagggtacactgccaaatggcactgtatttccagcaggttcttctttctgggatccagttaggcaatatgtgtcaatatgcagattccctttgattaaggtacttcttggaatttatcacaagtaggataattggggatgtgcaaagatgtatgttcaaaatttattgctgtgttaatggtagtgaaatattggtccagtcatatgatggagttttatgaggcaaatgatgtgatctacattcacgtggaaacctttctttgacgtgcttacggttgggggacagattctagccaggcatttgtagcatgaacccatatgtaaaattgtgggtgtggcctgtgtatgttcttttggatgggtggtgatttggaactagggtcacaatgttaattatctctagatgtgggctttcaaacgttttctttttcttaaaattttttttgatatttcctttaaaaaatataaacggtgaatatatacctattgataataaacccatccaggaaacgggaataaatatctaagactgcctatcttttttttttttctaatctgaacagttattttgcttatgaaatataaaattaggacactttgtcattttgtatttaaattcttatatcacttattttgggctcctatacatgctcttcctgcgtttggctttcctagccactgtagttgggatgtttgaaatattcagggtactgaacagcagtttagacacaaaaaggtacctgggtgcagaagcattttcattaaaattacatgaacgctggagtttattctacagcacaaagccttcctggatgaactggattaatgtttgatagaaacacagcctcttaagcatcaatgttcttaaactgtttgattattaattaaatgtcctatgttcttcagccttaaaaggtaggagaaactaagacaaaggagaaaaaaatcaagatgtcaaagacaggaatgtaatgtcgaagggagaatttcaaataacccacctccacacaagcctttctcagggagacggttaaacagcacagctggctccgattctgatgttttctcagttagatcttcagagaacagttttaataaagctttaattatggagcatccctacacacactgtagacagggatcattcagctgcataatgttgctgatgatatatttatggaatgctatttccatcctagtttaaggtatctgttgctcttagttactggagctatgctgatttcagaactacaaacagcttttaatattgaacatgctaactggttcaatgtatatgttgtactactttagtttttgtggggaatggactttaaagattagtttcatgctgatccacagtgtgggaacatgtttggtatttttaaaaactctttactcattgtctgaggtgagaaattgttggaagacagagcagaggggagaaagagatatgttatttatgtaggtgaaaaataccatgtgaatttagagtttagagtttagaatatggcaaccttaatgaattttggagctgcagtaggtaatggatctctaaatttttttctgcaatttttgttgttatccattagctcagtgacaatcactgtgatcccctcccttggtcagtgtgtccctcagcattcttaaccattgtgtatgtgcactaccaagcttttccctgggtgcctcatgtgtggtggtgtttctacagcttttttgcagtgctcaacgtcttcacctaataggtcacgtggtggctgtgcctgacctgcacatggtcatttctttttggttgctgaagcccaggttgtcttaagagataccgttgtttttctttttctttttttggaatcaatttttttttttactaaaggacatacagcaagatgggtgaaaggtggaaaaaataaacacagggcttaatgttgagagggtatttttagacttagaagcagcttgctgctttccatgaaatagttgagtgtaattcatgactcatgtttccgtttttggtggtttttctttaaaggatgaaggctggattaactgtgtgtttgtgcgtgcctctgcagtttggttctctggattcataggagtgggtttcttttatttagtaactatgtgcataatttccttttgtcctttgtaaaatatctttttagtcataaaaatcaaatcatcttcccatgtaagcttcagaaaaggtgaagttatatattgaaacaaaccatgacagtagttaaattttttgtagggatagcagaggaagccagtgagtggttcaataacattgttaattttcaagttctctggaatgcttaaatagagctgaagtacgttttaggtcattttgagttggtacacttttgttggtgacttgttgtgtcccaaaaacttggggtatggtcactggggaagagaatcctattggtgggaaatcttcatctgtctgtggtgggtttgatgctgccaaataggtaaaagtaattacaattctggtagtatgaaagagaaatggtcaagcttgggagtcatggattgtactttggggctgggaatcttatagattgttcatatatggaaagcattttaagggcatttcagaaagccttctggttgaacttcatgaaacttaactcttccttcccgactgtctctcccaccttctgaaaaccacagaaacagctctatttattgggttctatgacttaaaagaagaaaagactgaagagtgacaatcagacgtctttaaagttctcttttggacccaaggcaggatgctcgtggcatttcaacaccttcctcaggatcagagtagggagagacagaaatgatctttatttttgggatcacagcttgaaatggggctgctgggctgtattggatttgattctgtccaaaaggcgaaagtaatgatagctgctgggctcccatcctccatgaaaacccagtcagttcattgtcagtttaattgttgttttctgagctcttctgttttgaacatttttaaaaaagacttttgctttcctctttctaagtgttttgtatcataccccaatgcagaggccaccagccaccttgcctctttcacccccatctccaggagattggcaggtctaatggctgtcactgtagaacagaccttccaggtgactcttgacccctcaaatgaggagtaaccggatcccatgtagacctggcagtataaaaaaactttaatattattgatttgcaaaagaaggattataaacaaaacgctaacaagacagttgattgtcaaattttcctctttatttctccatttttggggaagatggagtgggaataaggtaggaaacatgcaccaaaatgaaaacatttcttgtaggtgagaataacaaggactctatcactgaaacattctctttttaatgtttaactgcaggatgcttaaagaaatcctacaattattgtagacattgatgtgctatcaagaaaaatccatcttaaatcccctgcaaagttcattaaaatcttcctcattgtggtactttacttgagattaatttctttaggtagcatgtttttactttagttgtagcaaagagccacatttacaacaggagcttgggcccagtcatggaacagtgctgtgtgtgcacattctgtgggactgattctgaggacatgccactgagtcttttggtctgtgttggagaggtcaccttaattccagagcagcaaagagttttatttatgagaaatatcctgatatgttaaaatatgtttttgaacatattttggatcaatttgtcttattaaaaagccagcattatttgtatgccaatgttcattgcagcattattgaccatagtcaagaggtgggagcaacccaagtgtctgtggagagataaatagataaacaaaatatggtagatcctgccacatgctacaccatggatgagctgtaaggacattaagctaagttaaataacacagaaataaaaagccaaagactctgtgatcccacttataaggtacctagagtagtcaaattcatagacagaaagtagaacagtggttgagaggggagggcaactggggagttgtgtaacgggtacagagtttcagatgggagagatggaaagagttctagagatggacggtggtgatggttgcataaaacatgaatacacggctgggcgtggtggctcactcctgtaatcccagcactttgggaggtcaaagcccatgggtcacctgaggtcaggggttcgagaccagcctggccaacatggagaaaccccatctctattagaaatacaaaattagccgagtgtggtggtgcatgcctgtaatcccagctactcgggaggctgagacaggagaatcatttgaacccgggaggcggaggttgtggtgtggtgagctgagatcgtgccattgcactccagcctgggcaacaagagcgaaactccgtgtcaaaaaagaaacaaacaaaagcaaccatgaataaacttatgccactgaattatatatacacttacaagttaagatggtaaattttatgttacatatattttactacaaataaaagttaaaaaatagaaaaaagggtgagtcagtctccgatatgttgtttttagtttctggtcatggtggggtttggctgccctggtcctacgcttgttacaaaactgctggtgggaagggtccttagacctgtcatctgctccaacactttcacttcatacgtgagaaaactgggtctcagaagtgaggtatttaccccctcctgcgtgggcttcttccttcagtttcctggagaggctgtgcaaagtgcagcaagagctggacactggactctgctgcctgggctccactctgctctgctgcttactcgccaagtccacacagaccgttaacttttctaaacctgtttctgaatgtataaaatgggaataatgtcagtatcctatgaggttgttatggggattaactgagtgaatgcattttaggtgcttagcatagtattttcacacagtaagtaacacatgaatcttagccgtttgttattgctttgttattgctgttgttactggcatgtgctgcaaagagcctttagggacagaggtttgggattgaggctcagtggcaattacttgttagttctctgtccttagccatgctgcttaatttctccttgttacccagtgcatgaagtaaggatgggtgaagcacttgtcttggtgtggtgcttgtgaagagagagagtggagtacctgacagagcacttggtgaatggtaatgacccaggtcagttttagtgggtaagaggatgtcactgcagcctggagggctggcatctactaaggcgtggtcttcaagggcggtgctgagaacaggcatgctcagctctgaccttgggttagggtggaggtgtgttcttctaggcccgctttctagggcctcctgagaaaggggtcaccggacttctctaggtcagttgtccctaaaagtaggtcgaggacctgcaggtagagcctggtatagcttgagtcagggacagaggtattagtgttctttcacaagtcatttttttttttttttgaaatggggtctttgtgtcccagactggagtgcagggggacagtcatggctcactgcaacctcaacttcctgggctcaagtgatcctctcaccttagcctcccgagtagctgggaatacaggcattcaccaccatgcccagctaacttttttagaaaaattttttgtagagatggggtctttctgtgttgcccaggcttgtcttgaacacctggcctcaaatgatcctcttgtcttggcctcccaaagtactggcattacagacaagagctactgcagtaggctacagttacttttgtttccaatcccaggtaatagacatcccctcactactgactcatcctcttcctgactgtttttcactagcttagccttacctacttccagaggaagacttcatccgaaattgagatgaccagggaggtcatttgtgctcaagaaaaattcatctagcaggcatgtattgagaaccagtatatgataggggtaagaggctagaaatataaagggtaatgaaatgctgctgacatgcaggggctcagcactttcagtatatagtcctagtacctgagagctagcaaaaaacaagcagagatgtttctcttagcccaggcagctcctcactgtgggggtctggtgccaacattgcaactgtattgtgtattatttaaatgtgtttgtatgtttgtgttcagtgtacatatgttttcagatttgtgaaaaatacataataaactgcatgtcataaaattcatggtgtgagatttgtcatagtctattacattcctaaagactctcaatattgtggacattcaaactaaatgattccagaatgactttaaaatgctagtgtcagagcaggcagtagggatgccttcctgtatgggtgtggccatattcacctgtatggggcccaggcagtaactgaactgatagtttcatcaaagtcaacacgttattttttgaactctgacactctatgcttggtatgcttgagcacatgatccctttcattaatggcttatttttttcaagtagtctcattctacccttgtcaaccttgacggcggggtcagcttcacttgcgtgaggtttgtttgtttgtttgtttgtttgtttttgagatggagtctcactctgttgcccaggctggagtgcaatggcgtgatctcagctcactgcaacctctgccgcctgggttcaagcgattctcctgccttagcctcccgagtagctgggattacaggcacccaccaccacatccagctaatttttggagttttaatagagacgaggtttcaccatctcggtcaggctggtcttgaactcctgacctcatgatccgcccgccttggcctcctaaagtgctgggattacaggcgtaagccaccatgcccgctcagaccccacaactcccaaggccaattaaaccagaagcttcccaagtgttaccaagctgcagcctggcttgggaatcattagcctatccaaaagtttgactagtatctcccttcccttttgattgatatgaatgatgctaatcttgcttcgatggtccatggctgtaccagttcagtttcttctttgtatccatcatgagagatctgatataggaaacaaggctaaaatcaattttaaaagtttctacagatttacttgatgttctctgatgaagtgaagctggatatcctttaactacctgagctgcctgccaccttctgttttctttctctttgctaaattaggggagtaaaggtgaaacttaatgttagttgttccatatcctgcagtgctgaaaactaccacaaccaagaaataaaattacaaaattcaagatgtattttggctagcttcactctttgtccaggcagcttcagtgaagtggcaatttagaaatagacggtcagcagtagaaagtaagaccccacttgtgatttacccaagttctttggaaagatgcaagccctcctgtaaacacacagtgattcagaggagcatgtttactagctgaagccctttttttctcctcttctcataaggccggttatcgagggagtttgtgtgtctggggaaaggactactttatgatagttccttaaaattatgacatacagtcatgcatcaggtaacaatgggatatattctgagaaatgcatcattaggtgatttcataattgtgtgaacatcctagagtgtaatcacacagacctagatggtggagcctgctgcaaacctaggctatatgatgtagtccattgctccaaggtaatgaacctgtacagcatattaccatactgaatgttgtaggtaattataacaccatcatagcatttgtgtatcgaaacatatttaaatgtagaaaagatacagtaaaaatatggtataaacgattaaaaatagtataactgtacagggcactttccatgaatggggcttgtaggactggaagttgcttctgggtgaattggtgagtgagtggtgatgaaatcatctaatcagttatgacatagctgagtttttcaggtcttataatcttacaggactaccatcatgtatttgagccatcgttgaccaaaatgtctatgcggcacgtggctgtatttagctgaacgattaagtagaaataacctattaagacctttttccaaagtattttttacatggttcattgttcacattctgtatatatttacatcatactgtatggtctgcaattgtatttttgactttttcttcaaattttgaatggctaaaaattccagcagggttcaagagcttgtcctttttgattgtgttttgtttcatccgtagcagaattgcctagattgaaatgaaatgaaaataatgaatggtatgacacttggtatcatcacaaactgatcattcaaatgaatgggttaaatactgttcatgtcatgatttatggaatgctttcctgtcccaaatacttgtgcttggtgctaggcatacaattatatgaaatgtttattatggtgaagaaattcaagattttccttcaccttacctcatctgttcaaatgaaaatgggatctttgtgtttggggggctgttttgcacttgtatatataaacaagtgaggaagctggatatttaggaataaaatctctttttgaatttagaatttgtaagctttcctcttttttttttttttttttttgagatggagtcttgctctgttgcccaggctggagtgcagtggcacaatctcagctcactgcaagctctgcctcccaggttcacgccattctcctgcctcagcctcccgagtatctgggactacaggcgcccaccaccacacctggctaaattttgtacttttagtagagacagggtttcaccgtgttagccaggatggtctcgatctcctgacctcgtgatctgcccgccttggcctcccaaagtgtaaactttcctcttaacggtcaaatcttactgaagaaatctgttaatggaaactttgataaatacaatgaacagatttggttcttcctcatccacataggttggaagcaacaagtattttgattgttgactcatacttctccagtgaagtgacaatgtgttgatggattaaacacagttatttttaagctgctttgacattctctaggcaaagtattatcaggaacagagccctgagatttgagagttgcagatgctttcatgattcttcactgtctgtctctccttacataagtgtttccagaaagctaataaaattattcctgaaggttaaaaacaaggaagttatgaaccggatttgaggttgaaattaggtagggggaacatgaattattttctgtaacgtacaagtggaaacaatttaatcaatcctttttatttttattgaatgtagacagaaaattcagtgcaggtggctgcattgcatttcatttacaataattaaaaaatgtttgagtaaaacagctctgttttggtggacagagatccaggacacccactttcacttacaggtgatccgctctttcactgatcccagcatctgctgcttctgtgtcacaccgctgggggaatgggagatccagagctgatgaaggcatggtcctggctctgctttgtccagctagtgacaatgttagtaacccgcattattgagcacttaataaacaataattctcacagcccgataaagtagttttttatggcatcctcatttttagatgaggaaatagaaatgcagagatgtgatagcttgcccaagatcagtctgtaagaggtataattagagtttgaagccaggtagtcagagtttttttttttctggatattttgcaaagaaagtttgagacttaaggaaagagcaaagatgctcttgtgtttaagcagatccattgagcactttttgggtcatggtctctgtacccataaaactctgaaaagtacaggggttgcaaatcatatgcgtgcgtaagccaagcaggtagaatagaggcatgaagttggccagatggtctgtggtgagcaggggagctctccgtggggccacctccctgcagctgtagccagtgagaaagtgagcccagtatggctgatctctagaagggaagctaatgaaaggtttaacaaaacatctctgggtcataaaaattgatctttacatcacatcaggtttgtgaatatacaacgtgaaacgtttagatatgtacttgatacggctttggggaatttattgagaatgtgggaaaacatttgttctctaaaagaaagttgcagatcatactgcaaagtgacagctgagcaaaggctcccccttgagaagggcatgtgctactcagctcatggcatctgggctctcattgataatggggggtaggttggaagattcttggaagccacagcaagacacaccacacctgggctctcataatcattttgccaccctagagagctccagacacacgattggccctctaacagaggaacattttaatacaagtgtgtactgctcaaggactcatttgctaagttaggggcagactccttggtaccaccaaatcctatttttcctaaatcggtcaatgtattgtcatatcccctgtgtgcagttttaactctgtgagtctggatttgaatggaggcccagctttattctagctgtgcaactgtgggcaagttccatcttctccaaagttagcttcctcagggtattgcaagaattaaatagcaaaatgcacataagtgtctggcgtagagtaagtgatagcttcctttcttttcctcattttaatcaattacccagttggtggatgtgataacaaatgaacttcctgaagatcagagctgtgtgttagtgtagggctcagatcctctttatgtattcagtgaacactatgttctgtctaacaggcacctgctctaggttattagggccattaaaggcatgttatattctcaaagagtatacaatttagtaagagacacagaaaaaactgatgttcgattgttaggttggtttaagttgttgatacatacttggaatgactaagatcattgtttaacattggtgagtgcacactgcaatgggaactttgtaatgctggagaaaccctcaactgttaaacatatacttaaaaaaatcagggtgtaaggatccctggctgaatagtgttgaatttttttcattttcctttttttgacgaagaagtttaacacaaaattattaagcaaagccattcaagaagtacagcaagttttctaaagtttttttttttaataaaagcgaatatcttctcctataaactagcttgctgacccagaaattgaactgtgattaaaaaatagggcagtgccccctcaaaatgagagttgtcttatgttatgggacgcttttttggtgaatactttatatttagtaatctcgtttttaaggttgtaggctctgtatggtaaaattaatacagtgaaaaattacagtctgaatatagagaagatgtgagtgccaaagtgttaaataaaacccttatttcttcttagtgaaggttctttcaattgacaattaactggatttttctatatttctctgagagttattcattgtgacagattttgtttcatgacagatgtaaagaacttctttaatttttgatgttcatagagtagacgtcatacaataataaccttgcaaataggaagtatcgatcattggttttttttatttcataaagcctaacaattattttactatagggaaatatacaggttgaataactttatagttttcatgatcatgaagtaacttccaagttatttcatagggtaaacgtgggtacgtgatagacatataggacattttggtttctttttttttcatttttgcttttggttgaaattgttcgtggaagctaaaatgcattctaaggtgaaataaattttcacttatccttgcggcattacaatttaatagaaagagaagctcatttagaactttattggcttcagttccttctggctacagcataatcagagaccttgactttccatgtcatcgcattggtgtgtttgagatgtgtgtgacctgtatatgggatgtatctgagactctgtgactggtaactgaggctccctgttactgagttcatgatcttacattactgttttcatgagaagccagtggatccctgagacatggactaaagcttttaatgcctctcagaatatgtctggttaactttggtcactgcagtcttcttactctgggggccttgcccttgctacaccccgtcaggaggagattagaggtgatcattgccttgggctctgtcttcagtgccaacagaaggagacatcaggacttgctggccccaggtctgcccaactcctcttgtctttggtgcccattatgggaatcgtaatgacaacttgcctatctcaacactctttcccaccataaagtaatagaatgctttatggttctgtaagctctttttgtgtgcatcatcttctttcaccctgaaaatgactttgtgaagtcagtagctaataatattgggactagttgtgcatatggggaaattctcagagagaggaggtgcctgggggaaggttgcctagcagcagagctggcatagaaggcaagcccgtgacctgtctgtatgggggaaagtccggctcttcaagggtggcattgcctgtctgtcctctctctctagttctgtgcacagaaggaacaggaacaggaacagaaggcacagaggaacagggaggaaaagcccttccgggagtgtgcctgagtgtggcttgtggtgaatttgtggtagtagctctggtcagattttacaacttagaatatgttttgaatccatatatgtggtacactctttttgtgtgggactgacacaaccctcttaaccttaccacatctggaaacttgcttgaactgctgaatctcagaccctatctcagacctaagagtcataattgctcttaatcaaggttgtcaggtgattcttatgtacattaagtttgcaaaatgcagctctattgaaatacagaggaccagaaattgtataattgagaataaggtgaggagaggaaggggtgcatgtgtgtatgtgtgagagactgggaggatgcatttcacttgtgtatgtaattgtgggagtgtgttctcattttacttgaaaaagcagctcactgagctataattcacataccatgcagttcacctattgaaagtgtactgtttaaaccacttattggttttaagtgtgttcacagccttgtgcacccataaccgcaatcaattttggaacgtttttacacctggaaagaaaccccatacctataagcagtcactcaccatttttccacagtgcctaccttgcttccgagaagcccctgattatcactaatgtacttctgcctctgtcttttggatttgtctattctggtcatttcttgtatgactgaaataatacaatatatggtctttagtgtctgaatttttttcacagtttatccatcttgtagcgtgtatcaatgcttcattccttttttactgctgtcattttgttgtcaagtttattttgagcaagaatacagagattcacctttatcctaagctttgatgaccttaggctgtctaaatacggtcttttattgtacaataacattcaataagagtaatttcttagtgtgaccattgcttttctgatgccacgtactctagaatctgaaaagtgacagtgagatagtagaagtattgttaaatgcattcaattaaagaagcaaaacattagtattttccatttgtaaagttttggttgttaattttcaaccactttctctgtaaaaagcagtggtatgccatccatgctctgctgaaaactatgcgtgcctttataaaatatggagctgatgttgctgaaaattaaaatgacaaaatattgtgtttagataaataacaacaatggcagtatttttggcaagaaatcacatattgtccctcccccaagcagtctgttccctgcaattctgaatgtttggtaattctaagcaccctagaggaaggtaacattcttcccttggtgtcagtgctaagctctgagattgttatttgtcaaataaagcacaaatgtgttttcctctagttacgtgaagaccttgtgtggaatgccttactgtttggagaaaatcttggtttggctcttgggctctctggtgatcattttataatgctcatcatgggaggtgacgggaagaatggccagcaagatgctctagcctgcagaaaagtcactttagcatttccctgctttgactatggcacacggacatttggaaattcttattctggttttggcaacacaaaaagctttcctttttccccttccctcctggctgactaagctcatcttaatgccactaaattaccaatgccttatttggcaagctgcctggtaaatcaaatgaatgacgacaatactggagatcttgtgtggtcactttctaaagggttttgtgcctcctttatactcttgtctccttctccttctttggcgggtccactcagttatttggctctgtttgggaaggctctgggaaaaatgccatttatctatcttttcaacttgaggggacatgctttcttcacagatttctttgggatggaaagttctttctttaacctgattactgtttctaggtgctgtaaattgctgatcattctcagtaaatcaccagcattctgttctttctcagtcttgacaaagttgccattgtgcatatgtgtatttgtgtgtgtgtgacagggaacatgcatggtttctgaaaaaaaaaaaaaaaaaaaaaaaaaaaatccttgccccttttagatttggaaattagcatagctaggctagccagatccctcttttggaggaaatgggaaagattggattgagcccttgtgtcaaggaaattgacttggctggatttcagggatccctgtggactggcccactaaagatctgtgtcagtatctttagtggcactggaattgggacagcgtagctattttctgtcatagggcaaactcagggggaaaagggcaggcacccaacattctatgagaacttccatgtgtcagagagtgttatgtaaatgctatgtatattcttgtgtagtatgacaaccttgtgagctgtatattactactgttgttattattaccatcactgcttcacgaatggagaaactgaggcccagggagatcgtatttcctaaagttctacagctgagaggtgggttgcggaggctgctgtccttttctaccaagtgaagtttgtctttgctctttctctgccatattctttaaaggggcagatgttacaaggttgatgcggctgatggaaacactagcataggacaaaaatacaaaatcccttcacagactcaagtttccccacacccaaaaggctccgcgacagcatttccaggtataggggcaagcttctgtagcctccagcaaccacagaggtgcccagatgccaatgacaccctgactagagtgagcatgtcctctctgctctcagagtcctctgtcattggacccctcccaactgctgtggacacttgggctgtgtgctgcctactcccaggtgttaagttactggtaggacccacggctgtgtgtttattgcacaatttggtgaatcaaaggctgacttcctggtgagcaccccctagcagggtgagatatggacctttctggagtctgttttacaagaagtgtttactgggatattttaggaattctcagataaatccatatgatagcctacctgtatttcctatgaataaattgggtatttaagatgtatattcttttcatttgtcatttttccttgattttaaaatttcccttcattggctgggtgcggtggctcatgcctataatcccagcactttgagaggccgaggtgggcggatcacgaggccgggagattgagactatcctggctaacacagtgaaaccccgtctctactaaaaatacaaaaattagccaggcgtggcagcgggcgcctgtaatcccagctactcgggaagctgaggcaggagaagttcttgaacccaggaggcagaggttgcagtgagccgagattgcgccactgcactccagcccgggtgaccgacagagcgagactccgtctcaaaaaaaaaaaaaaaaaaaaaaaaattcccctcgttaatatgtgtttattgttaaaaacttaggacgaaagttaaaaaaaaaaacccacactacttaattacagagatcttcattaacataattctgtatttattttctataggaaaatttttaatgctaactttctagaactcagtcaaaaactactgtaatcattttaatcagctgattaatttgctctagcagcttaaaatgtttttgctccattttactttttctactgcatgatagaaaaattgttgttctgtgaatgagaaagttaaaatttgtgctcaatggcaggaccccagagagatgtttctgggaattgagattcagaggcagcctgcattcagctttcttcaggttacctttattaatgatgcccttgatcagtaaggtggattacttacccattaacacttattctacatcagccttaatgttttagggaaaatatatttactaagctgtttgtgtacaggagtatcacacagtagatgaagcacttatgtttctggaaaaaaagagataaattaggaagctttcagatttgtttataaaagaaatatgaggctaggaaagaagcatgatgacttttgtgatacacacagtgagtcagcaacccattttccagaagttagcagctgcatttttttccattgagggcaaaacataatatatgggtataactttagtgctagctaattacttctattggtgcttaaaaaaattaaaatcaacaaggagaaatctacccaaactgatccaatatacactgagctaatgaaggaaggtggtgtactttttgtggggtggtatttttattttgattatgttgaagtggtagagaaagaaggggagagatctgggggtctgagagtcagaggaggctacaaatgatatagcaaagcaaataactagattatgaatcttttgaaatcatgcaggggaacaaaatattgttactgccttatcaaaaagtattttctcctgtataatttaaaaaatcaagaaggtgtcaaccttaaaaatcgtatcattgaatatagtaagtccctttttttttgttaatatagcctgttggtttagtagatttttgcatcttattgtctgatttttataccatacagactaataaaaattagtttatgcacttatttgttacttttatttctgaatagataatacagtcagcgtagtataaaaggttagacagtgatgtctgaattctactccttcccctagctagtttccttcccagaggcaaccattgttactgttaccatgttttcctaaagacagttcctgcaaatgttggcaaatctgtgtgtgttctctttccttgtctctgtgccttcctttcttttaggaatgctagcatacatactataatattctgggtctgtctggttgtttttacttcatgtgctctgtagattatttcagtacaccaagagcttccccattgtttcatagttgggtagtattctgttgtattattatgccatgatgtatttaaggaatatgctattggtggacatttaaaatgtttccagtttgctcctttgaacaatgctgcagtatataaagttgtacatatatgtaggtttgttaagaaataagtggaaacccatagctgaaagatggttttaggattgtccctgggaattagatctctatcattgtttcccagtgctccttggaaccctcctcagggaaataggcatcattggagtagaaggcaaatgggatttcatggccaaataaatttggaaaatgcagtgtccttgattattccttggagcttcctaaaataactagcatgttaaaggcttaacgtgctcatgtggttttaagaacaacaaaaaaactgccaaagataaattttcaggctcacttgagtatcacatatttgaagatgcctgttaacatctttcgagacagtttctgggaaaaaatagtttgggaaatgttgacctatgtgattactacctgtctcaccaattccatagatactggaaactagctaactgagttttcagctgacaaattgcttgcttttggagtcaagtgtcttgacatatgtagcttgttcacctctctggtcctattgcttaaagtgagaaatagcgtatttggaaggttgtatgtcaggaccatcttctgtttgtgagcgcgagagaaggtaggatcagatatcttgggtggagcccagtctccagctcaagacttgagttgtaaaaatcgtgttgtattgtgggacaaaaatcaagcagttcattttggctagggtttaggggatagaaatgggtggaggagagtcataaggctttctaaaataagctgcactacagcagaagttgcagttgggagttctgttgtagaaaatggagaggaaagcaatagatttttttccctccagtttgcattggttctcaaccggggatgattttgctttcctgctaaaggggatgtttggcaatgtctggagacatttttggttaccacgactggaaaggtgctaccagcatctggtaagtagagctcaaggatgctgctaaacatcctgcaatgcacaggacaaaaaaatacctcagtaaagaattatctagtccaaaatgtcagtagtacctccattgatatacccttctctaatgggattctaccagggttggagagttaggaaattgttactttcttcatacatggagaggagcataagtgagccatgtgccattctggactgaggtgccaccatggtgccagcatttgataatagtaaactcatgaccccttattcatagtttggaaatttaaaaaacgctggaaaatgtgacgtttcttcataattcagttagcagtaaaaccttgcctgtgttgatgtaaaggtatttatagtctttatttacctggttttgtgtgaatgttaatgcgcttgactgtagggtgctggcctagacctggcttggggctttatttagtaaatatgctgtatcactcttctaaagtttgtaacattctatacttggaaacactttggtccccaaaggtttcagagaagagattgtgaacttatatattgaactaaatttttgccaaatttggcttattttgtgtgtgtgtgtgtgtgtgtgtggtttaaggagttgaaagtttaatagaagaaaggagagaggagagcatctccttgcaagagagagagagaaagagagaaacgtctgaaaaagtccaaagttggcttatttttaaaaattcagcgcttttagtaacgtttattgatttttttaaattccaaaaatgacataagatcattttgaaaagtttaagtacaaaaaagtagtaatattatcaaccaactgtatggtacttaactgtgcgctagatacaattctcagcactttatgtgcagtaactaatttaatcttacgaatcccattatacctactttacaagtgcagaagccgtggcatagtaacttgctcaagatcccctagttgatggcagagctgggctttgaactctggcacagagaaggaagtgattcatcatctccacagctggagtgggctgctgtgtgtacatggatgtatttccttatagccttctttcagccttccctactcaactatatttgagaatttcccctgttgtcttaaatattttcaaaaaacctgattgttgaatggctgactacctatttaaaagaataggtgaggtggggcatggtggctcacgcctgtaatcccagcactttgggaggctgagccaggcagattacctgaggtcaggagttcaagaccagcctgaccaatatgatgacaccccgtctctactaaaaatacaaaaattagctgggcttggtggcatgcacctgtaatcccagctactcgggaggctgaggcaggagattcgtttgaacccgggaggcagaggttgcagtgagccaagagtcaccattgcgctctagcctgggcaacaagagtgaaactccatctcaaaaaaaaaataaaataaaataagtgagtgaaccataaattatttaaacattcttttgttgttgggcatttaggctctgtccattttttcacaatagaaaattgacatggacacatttatgtataaatacttatccatatctgattatttctttagagaatgttttaatggggctttttaatagactcttcatatatactgtgaaatgtaccagtttattctctcattagaattcattgtcatcagcctggagtgttaaatgcttttccctttgatttctgattctgtgatgtagtatcttgaagttttctgagaaaatcagacagatgattggaaatttagtatgattttttttaaattggtcaggaaacaagtagttggaataactgattttataaaattttatatttcaaaaaattcaattttagagccattttattttcagattaacccatgaagttaaatcaaggctccatttcacattgttatgaagagctggtagaaataaggatagtgcagcattaagagatactctgacctgaatcttactggtatgtgatcagtatatgcctaaaacaaccattcagtaaacatttatggaggatctgctacgcaccatacactgcattttgcactgggtatccagtgaggaacaagtgtataaaaggaaaaatagcaaatacttacacagtgctttttaggtgtcagacactgttttaacagcttacgcatgttacttaatttattactcccaacaaccctatgaggtagatactattattgtatccatttaactgatgagactgaagcacagagaagatgagtaatgggctcgcagacatgcaactactaaccaaggcaaaccactgactgtgctagtttggaagggcagacagaagagggttggtgcagtactctgggcatgagaaactggtggcttttgccaccagcaaattggtcaagcagtccagcaatgggattggagagaaatggaggcatcagaaagatttttcaagatagaatttatcagacatggtgattgaatgtggagggagagggagaagtcaagggtaaagcctaggtatcttggtatgagtgacctgctagatgatggagcccttcagtgagtccaggaacagtaggaaagaatgaggagcatgttttagattggtgatgtcagaggggtctgaaagggggaggtaagcagaggggcattatcttcaaaatatttggagtcagtagctttgaagctcaccaaatataccctggtagtttagttatcagaaaatgagtttttaaaaaatacttataatgtgtagttcatgagaaagttttccagcgtttaaagatgttgacagagtttcagttgattgctgtggttttcgtgtatgaaaaacatgtaaaatttgtgtcatattaatgcccttttgaagactaatttcaatgcctgtagacagctttctaatgtagttgtatcatgatttgggttatcaataatctgtgaatgtatagattgttgccattttccttcattgtagataattttacaatgaatgtctttatgcataaaacagttttgatatgcaggattatttctttggaggtatagctgaactacaatttccgaatcatacatatcacaaaattaacttctagaaagactgtgctaatttatgtccgcaactacgtgcaagacctgcctcttaatcagccattgggttgaattgtcctgatgatttttgtggcaccttcattcaattcctgctttttgtaacatatcccatgatcacaatcatatgatgactttgtatcctgtgtctttattttattggaatcaatgcctgattcatacagaatattgccaagaagttttacagatataatcagataagagaggagagatcaagatcatgttctttaactctgtttaaagtattgatgtcaggatgatacttcaagtttgaggtgaagtttttgtgccaaagcctggctcatggctgtgagggcacctaggactcactaaaagatgcgtgttcttcagtgtgcacattacctgccttcatgtggtaagtggtggagagttaaagccattacatggatcactcaggacaaaaacaaattttactgtaaaatttctggtgatttgggagcaaaactaggataactcttttgcacttgcagtatgccataagtgccgcagtttttgactttttctactttgcccaataaaaatgttgctctacaacccttaatttttataactgttctggcctcagttttccacagtgaatgttcctagtttgtgtaatgttctttaggttgctaatttctgcctccagagccaggagatctgtcttcttttgattattcccaaaggtaaattttgggaaaactagaatcaggctatttccctatttttcatttggaaatttctgcattcataaacagttgcttgtaaccttttaatgaatatgcattaggagttgttttgaaaatttattatttagggattatttattagcctggttacttgccagggtggtacattaaaaaaaagtttgtccacccatctgcttcatcccgtaatccccccaaacagtcatcaactaggagaatcgtaatatgcaaataagccatctgcagtgtctaaatgggaggatagcttccaatttttagtcagaaacctgccaggggcaggggaataatttcagtagcattcttccaagggggaggatctcttaagaggcagcatgattaaaaatgcttccatagtaaataaggacactagaattgggtgtccaggccacttgtgagcaaagaacctcctatttccagattcggcgccacctgtgggatactcatgtttcatcataggtgtccacaactttattcttttaatacctctacaaagaccaaaaaaaaagtgataccaattaaaaaatgtggaagaatattaattgggattgaacagtacctgtggttttctcatgtgaccctgggtttgtcttattctctgagaaagtgggctggtaggtaggtgctcttgatgtccttaatttcaaaatgaggaagtcagagcaggcacggtaagtaaagaataatggatcctgagcctcaccttttggtcactccgttggcagggtatgtgcttggggcatgaaaaccaagactcaaagactgccaatcctctgccgcagtttttgagagtaagaactatgcttgctgtaatatggcagaatgaaattatacctgctccttccttgcttcttccttcccttcctccctcccttttcctttcgtttcctttcgtttcctttcctttccgtttcctttcctttcctttcctttcctttcctttcctttcctttcctttcctttcctttcctttccttccccttccccttccccttccccttccccttccccttccccttcccctttcctatctttgcattcgttctgctttagttcactgtttggaagggtgaaataaagccctggttctgttctttccccttgtccttccatcggagtgggccctttagtggttaagggtgagggatgagaagttagtctctggtgtctaaggtccctacgatacgtctgaatgttgccaggtgtagaagatgtgtcctgtccataggaggagcttgtgggaagctagctggcgaggttcagaaagtagagttgtgggatatgtggccttaggtgttgtatacgtatgtagttcaaatggaattagattctatatagggtagtgtgtagactgagaacaaaatgacctatcaatcttagggaatgaattaagaagaaggttgcctgtgaaggacaagtcagagagaaatccagaagagattgatgttctgaaagttaagactggacaatgtttcatgaaaaatgtaatcggagaatgaaggttcaatatgttttttgtttgcattttctttttgcttggaaatcatttcaaatttacagaaaaaaattacaaagaatacctgtccatttatttatctaattcaccttttcttatatttaaccctatttataatttcctacacacacacacacacacacacacacacacacaccacccaccatatatttttctgaaccattttgaggatatgttactatatcatggtcctttacttctaattacctaagtatttatttcctaagaattgggatattctcttatactataaccgcagcactattatcaacttgagtaaatttaacattgatacaatttaaaaaatcagatctaatatttatattccaattaacaagttaacccaattacattttgaataatatttttctgtctcatacaggttctagtctggggtcaaatacttcattttatttcattcgttcgtttcttttaatctgaaacatttgcacagccttggtttatctcgtttttaagactgcatcctgcccgttaaaaatgcagtggctgtcagtttgaggttgttgctgcctcatgattagattcagggtgatgcaatctcagttggaatattgcatagtgatgtgtccttgccaggatgtccaacctgcaggcaccttatgcccatcggtggcgatgatttttaacatcctttcacagtgttgtctagtttcctgattatataattattgttttctctttcttcccttgcaataagtggtctgtggggagctactgtaaggtcatatagatatcctccttctcctcaaagtcagtgcaagatttagcatccattgatgattattactgggtccagtcttcacagtgataggtgcgcaaacatgattttccatctccatgctctttccatgtttaccatttagcctttgacattctgctctaagcaagagtctcatatcatttctatttatttattttttgtgtgcactcaagagttcccattttccgttggttcataatttaccactgtactcaatttgagccctcaatcaaatttgagttggctagtgggggccccttcaagatggctcctgtgtccatgtggcatgttcccatcacttacttttgacaaatttttcagtttctggcataacaatgtgatcaggctcatcttgtatatactctagccctggagccatctgttcctttgaggatcccagattccttttagtggagaaagggtataggcagtatggtctgtgttttccatttgcttctgtgctgtgtgaagtgttaggcccaggctttgggaactatccatttcttggtagatgttgggtcaagtggaaatgttggggtactgaggaagaacaattttgatttgcaattggtaaatgaggaatatctgttcagagtgtgagtgagatgaaaattgttcttctgtttaatttgtttgtaaaccttggctagagttggcctgacagattgtgtccctttccctctggccatactttttttgggagggggctggcctgcattttaatgaacatgcacattttggcactctctcatgcttgcatttttagttgtgttctcgtctcaccatgctctgtaggtgcccctttaacattggttcatcctgtgtgaatgggcagggggaggtggtgagtggatggtattctggttcccttggtgggagcagcctgcagaggccagatagtccacatctgttgttgattgaatcctggtccagaagccccactttatattgctgtgtggaatgagcagaattactactgtggcaacacacagttcgttttttacagtccacctcctttcattgcctcctaacttgcaagtcacctgataatttctgacactttcttaccagtatggagctatttaaaacgcattcctacttttctcatctcatgggatcctctggacaataccttgtgtgataatcaggcagagatcaattctattttacagacagggaaacaaggcaaagagagtacatttccaatggggaaagttagtctcttttccttagtagcaaagagctagtaagtggcagaaccagaacttcaacttggcacttctgcctctttgtgctttcttcttgtcttagttaaaaactgaagaagaaaagtaagccctgtggaagcagcttaggtacaggaattggcagggtaggaggtggggtagatttcttccttcttaatcagtttcctgtctgaagcttcacatactgggggtatcgtttttcagtgtgaaagggaggctgaggtcactttgtgtcttcatgggaaacctgtcccaggaggtatgtcttaaaccccatgcttacctcaaggcaattagagaaaaccatgtgacagcatcggtctcactgactgtggttgatgaagcagagcagaaaagctgttttcttctccttgtcctttacttcagtcttccccatctcatcttccctacctgagctgatggactgtcttgtgaggctggggaggtgtccacttggctctttggttttggttcccagagggaggctctggccgcaggacacagcagatggagcctgtgggagcccatgtttgtgcctcggcaggtgtgggtctgggacgggtctgacctccacctggcacctgcttcttttattgcctccatatgtcaaggggatatgagcccatgtgagtgctttcagattgctctggcctgaggccatggttgggaatggcaggagcatgttgcgggggacagggacctttgtgagggacagttgagccactctgaggttagaggaccacacagctgccccttctagaagcctcgctgggccagaggtgtggcttcattaaggtcctagttggactgtgtcctcatctctctcttatttcctgctctgtttttgattttattttcttaaaatcttcatgctcatggatttttaaaatggcagtaatgatttttatttttttaaagagtaaaacaatggcagtctagtgcagttactttaagacatatcaggtaacctttaccagtaaatcgaaggccattgaataaggaatgtgtaaggatctgtggactccctgaaattagatgcaaaatgttatatgtttgtatgaatgcattttttggaggaatggctcccatagctttctgcagattcttgtggacatttgacagtccctctccaaagtatggcctccaatatgtcttcttcacattcctttggagaactgcctttacctcccgtgtctctcatagatatctgagcactttaatttgtggaagagtcgaggaagaggaggccttgaaaatagtctcctttctaactaccaaatttgggggctggctcagcttcccctcccccattactggttccctgagcaggtctgagccaggataatcttctttaacctccactttctgtcaggccctggtcgtgtgctggatgtacctctcctcatgtaattgtcacaactaccctgtattggaggtgccaaagactgaataacatgtttaacttactaaatagaagaattgggactgccggtaaaaactgccagattccaaagccagagttttttcaatacactcaaggaataaaacgtcagctgctgtttttattagcactcaccaatgagacaccatcctgtcctgttccctgttttcatcctgcagcgccatatattgctccaaagcttagatagtgcccagagcccacctacagctcatcttcctatgaggcagagagctagcttgatctttggggaataatggcagagctctcagaaggtgctggatccctaaccgctttgctgggttcttcattcctggcccacccgagagctcttctggaagtaaaggcctgaaactgtgaccttcttggctatggtgaaaagtaacagacgtcaagtgttagcaagcagaccctatctgttatttgacttttaaaatcacaaacaataaagtaatcattattacaaggtatttttaatgtcacattggcatgaaaaattttaattctgagagtataatttctatgaattgctatgaatatagtaaattaaaaaataaattgctgtggcggtgctctgatggcatttcaaaaaggtgtttgtcatcctaccctgccccttcatccctctgtgataactgtgtagacaaaggataaaacccaggtgaacctcctgagatagaggttccagatggcactagctgaaaagacagctggcatccagagaggccgtgtggctctttgtacacaaaccatggggattgtttatttttactgctctagtgactcaatataacagtggtctgggaagacttggctttagcctcctctctgttgtgttttaacctcttcatgtctcgggcttcttacttttctcctggtgttgttgagtgtagagtggttgtgatgatgagttcacagagatttaagagctctaagttcttttgggtcagaggagtgatttctcttttttgcagtgtaaggtacaaaatattaaatatctgagacgtgactgtgagaccctggtgaagctacccggagtctcagtttcttctttaaaacacgattatatcattcaaaataatagactgtatcttaaatgagccagaatggatcagacgtttagcattgttactggcacgtgggcattcatgaagtatctaactcttctctgtaccccctcacttctgtatacatgccttctatctaaatacaatcttttgattggctggaagtagagtaggaacattaatctatttctcaaatgcagtgccaagcttaaaaatgcatctctagttctggggatgcccagataactatatcttgggtgtgtgtgtgtgtgtgtgtgtgtgtgtgtgtgtgtgtgtgtgtatgtgcatgcacatttatctatttgtgtaagtatgcataactgggtctaccagatgaaatgtggcttgccttgctgacttcagacattttgatttaaagatcttaaggtaagagaagtagagttaacagcatacatttagagctagatgccttagcagctggcttggaggcttttttttcttctttttaatgggtagctttttatttattcattttttttaaatgggtagctttaatttcaaccaaaaagttctgggtagatttttttctagctcaagggagaattgtatattgggcactaagtattaacgggtaaaatcctgccaactgcccttttatagatcttcagtgtgaagcaagactttgcataggttgccagccaaaaattgatattggatccaattccatcagagaagctttagtatttttagaagtaacactcactctagcacagcatgcggtgatacataataccaactgtttataaagatccatgttttagttaatttctagaaaattaaattacctttttttttttttgctgatgccttctgtctgtcaaacagaaggaaattgcattagagttcaagatgtggcctttgaagaggacttagatgaattgggatgttgacctttatagtaggaggattgcgtggagtttggttggctgggaggcaggagacctgggttctagccccagttctgccttccatgaagtgtgtgatctggattagtcacaaggcctttgtggccctcatattgtgtagtcattaaacaaaggggttgtatgaaattcccattgtgttttaattttgataagttattataatttcatgatagaaatgaaatatagtgtgcaagtatttttcctaaaattgtgagatcacgtctgtgagatccatgcagcttgggtggatccaccagtcttttttataatgaagtctctgaaatacttattgaatgaatgaatggtgctattaaggtgatggaaataattttccattcacaaattgctaacatactgcctttcatttcataacattcttccaaaaaacaatattcttgtgactattattgagtataaactggatacttctggatacagctctggttgtacataagtgttttcctaactaaaggattgtttggggaaaatgagatttaaagaaccaagatactgatttttggttatttagcactatatccttgccatttttcatggattcccttgtcttatattcagagaacattttcagattgccttaagcctgtttgtttcctgtttatccaggtttcacttttcattgatgggctactacaaggcctaacttttgcatatacctgtgtccaggtgtctcagtccaggaagttctgtagtcctgtttatgccatgtatttggactttcaaatattcagcaactatttttttctgtatatattttggggtctcttacaccactgtttaaaatgtggttcccaggccacctgtaatggaatcacatggagatgcttgaaaaagtggcacgtttctggttaatgtgccgttcttactggagcagaatatcttggggacagacataaaaagcctcatgttttgcaagtgactctcaaatttaagctggcctcagaatcactgcttttggaaatcagggttatagctttgttcatgttcttagaatctaacatataattagaattcaatgaatatttttgagcaataagtgagcacatgagttgctgggtttgtggtagttagaaagctatacaatacctttaccagtctttttgtaatgaaagctctgaaatatttattgaatgaatgaatggtgctaataataaggtgatgaaaataatttttcattcacaaattgctaacatactgcctttcgtttcataacagtcttccaaaaaacagtattcttgtgactgttactgagtataaactggatacttctggatacggctctggttgtacataagtgtttttcaccttgtgttacacacaaacacacaccctactccgtttgttggaagcctgcaagtgatcatgcgtatcaatgctaggagtgacgtcaagtagactggctgggaagggcagaatgtggtaggcggttaaaaagcaaaaggcacatgctatatgactttttgccttttcttgttgtctttaagacttttgtgatggttacataacaccagtgggaccagagactagggcaggccaaagatgcactgattaaggaaattactgctacctaacagttattctggagctcaagtatttcctgttcattatgcaataatgtagcctttcgagtctccaaatgccatttggaagaagagggtgggggagttggaggtagtaggttggatctgaggcttagtctcttgcctgctgttttatgggcaaggtggggcaggacctataaaaattccttcacccatggcccttttctcctacaatgactgtagaaaattagaaccctttaactgtttaggaatgtgagtgttcagcataaggatccaattaggatgatggggaggagagataagtagcaatagatttaatatgtgatgtttgatagcattaaaaatgtcccaagcctatgcatgcagtgattgcttgatactgtagttttaatttgagttatagcatagagatggtgatgctatagaggaaaaaacccgcaattatttttgcaccaacctaatattaagttttatatttcacatttgtgggcttgtttcatcaacggagcagtttccaaggcttcaaggaaacattgttctatgttttctctcatccatccccctgtggagggatgttgagaggagagtcggttttgaaggtgcagttcttgctttcatagcatgtagttaaaataaaaaccacagtgtagtgttctgacatcccctcttgctcaggcatagggcatatttggtgaaccttggccattctgacaactgttctggcagctgtttcttgtgtcattcttttctgggctttattgtaatgtaaacccaccaaacaagatttctggcagttctgtacatggaaaatataaggactcaatttgtaggtaagtggtttctatcctggagaaaacaaagcccatcatactggatgttcacatcagctgggctgtatgacaatgttggtgagtcagtgctttgaaggccctaaggttaaatgttttgaataccacccccatgcatagtattttgggttcagtggggctttaaaacatcctttattctccccacatcccatcatcttctgcaaacttaacaatttactatactttttctgaaaatgagccttttaatctcccaatccatagttggacgaggctcactttgaaaagtaaagaggttggcttattgataacttcaggcctgctccttgcttacatgctgatgtttactttttgaaatcgacctaaaaaatgtcaatactttgttatggttttgaaatgtatctgataattcctttctgggcatgttaaaagtcttaattttcttggcaacagaattttccttttagggttcagtatctgcttttcagggttatttctggaaagattttaagatagcttaagggctttcttaaccacataaaacataatttcctcaatacattttgggggaaaaatcaataattagtgttagtgtaacactaattagtgaatgccatttgctttaatgctgggttaaaattgtccttgaatttaaaaattagttaaatcttagtaccaaaaaaataaagtgaaatactacaaagaagttggtcttttgtcatacaacaacctatccatggcagtagagaaaaataattaaaaaatgcacaatctctaacacaactatttttagttttgcattttctttccatcttggccgacatagctacaaagcacaattattggaactacagtaattattttgatttttgatttttattatgtatctaatcactgttttcattttcccatatactatacaaatgtcactgtcaaagctacatattgggctgtccgggtgatttactgtgagcatgcccatattcttagaatttagattccatccagttatttgaaattgtagatgatgttatagggaacatatttttgcctatgtttttcttttaatgattacatcctttaattaaatttggactttaaatttggaatttctgggtcacagttgtttttatggccctgaaataacattctgttttatacttgtagaaatagtttttgttcttgtaaccaaccagagcacaagtgacaggcaagcttttagctttagggatgttcttaacacatcccgaagattttgtgctctcaatgtgtccctgctatttggagcttccctgaaaaagattctgtcaggagcttctgctaattaaattgaattggtccagctttgttgtaaacaggtaacggattgtggtgttttattacttgatacttattgctgaaacaagttttatgaaaaaaggagagtattagcctgaggacaaaagtagtttggagttctgtagaggagctgccagtattaatgaactatcacttggagcctgcaacctgtcagccttgacttttcctctcctgggtcagccatcattggtcctccacattgcttttcactttgccagctaaggcttttcagtggcttctgatataggtcttgtttctcaagtgagtgtgccctcaggaggggaactgggcaatctgggaagggagctttgatttcacaaccatgtgggaatgccagtagaatgagacgccatgatgagtgtgggtacctgcccttcttggcaggagtggactagaaatcagttggtgttactgcaagcccagtccattgatgtgcacatccattgtgggaggatactactctcaatggctgcactgctgccagtgacgttaaaaagtcatccatgtaaaagcatgggtaactgcttaacatgtattaaatgaaaaagcaaaatacgaaatgatctaggtactgcacaagtgtcctaaatgttttgcatatcgtcaaaataatattaatataagaaagtgtaaatagctgtaataagttatggtgagattaaaagccatttctttttcttttttgcaccaacgtgttctttagtgttttagcacatttgtagtagagttttgaagttatttttataaatcagatatgtaggattctaggtctgtgaaatgaaattgaatgaagaggatttgacagtcttcttaaacttctgggaaataaaggctgaaaacagcaggctttcatctgtgtatcttctgaagctgaaatgaacactatgcccattttgctgtatgtccatttgagtattttctaatacctttttggggagtaggtgtatcttcagctgaaagaatatttctaagtatccaagtccttaaggaagctaaaagttttgagttatgcaagtgtgccttcagtgtcctttggcaacccctttctgcactttctccactgctgtggtatgtttcttgaatgaccatgtccctcttcctgctcatgaaagccttgagcttagttgtgtataccttgcataaagcaatagagtgcagaagtaaagaatgctggttctggactcagactcttgatgtggagtcctggctggttttggaactttgggctcttgaagggagtatcctcatctgtacggtggagaccactggtaccctcaggtggctgtggaggttgcatcggttaacactagtgaagttctgagtgcaatgcttggtccatactaacccagaactgcagtggtgatgatacatatgatacatcttcttgggtagttacatattttcttcttgttaccagggtattccttttaactatgagaaatcagaaaaatacagaaaatcacaaagaagagactagaaataacccaaactccacaacaggttttgctttttgtcttctctgatgatgaagtaaaatatgttggccatttggagaagtaaagatgtttgtaagtggggtgtttccagaccctctgaaatatatgcctcttttcttgctatgcctagtataatacctcactcattgtcaaccactagagacttagcttcttgttcttggttctactactaaattttttgacttgggcaaatcatttaaatatttctaggtgttctttaaggcttaaaaaccaaggttagtttagctttgtcattctttcttctcttaacctgtgacttggtttatttatggtttgttcatttcctttatatgtcttcagtgaaagcagcacagaaaatgactttggccatgtcagtcagccaacagcttttgagcagacactcttctggccctgggaattacagaaccacacaatacacacatgatctgtggcttttggagcctgtggcagggccctggatggggaagggtaagcattctgatgctatagtgtgatggaaacttctgtggggaagcgtaggattcagtgccagtacttgtgatgcaagtagttatttgagcattccttttgtttgtttttaattttaaagttcaaggatacgtgggcaagatgtgcaggtttgttatgtaggtaaatgtgtgtcatgggagtttgttgtacagatgatttcatcacccaggtattaagcctagtacccattagttatttttcctggatcttctccctgcccacacctaccaccctcctataggccccagtgcatgtcattccctctgtgtgtccatgtgttttcatcatttagcacccacttacaagtaagaacatatagtatatggttttctgttcctgcattagtttgctaaggataatggtctctagcttcatccatgtccctgcaaaggacatggtctcattttttatggctgcatagtattccatgttgtatatgtaccacattttctttatccagtctatcattgatgggcatttagattgattccatgcaagttcttagagaccttcaaagaatatttgagcatttctaactggaaggaagtgaaaaagaaaggtgtggtgagttgagcacgtggctgactcattgaggagtcctgggtttgaactgctttatctgtaagagctcaatttaattcagagttaagtgcctaaaaggtatccagcacatgcctcctggggttcgggatgcactgttcttgacctcacagagcatttatttaagctgaaagtcatgtgcctgctgtgagattgggtgctctgagtgtacacaacagaggaaatctggctggtctatgttatttccttggaatgtctcttggagtcagctgtgatgcccccaggggttcaggcacaagggagaaaaatgagtggacatcctaaggctctctgaggatttcctggttgcttccaactcaagttgagtattacaggaaggtttggaaggataaaagccacaaaaatggcagtttctattttctctcacctccatttatcagcctggtcacagcagcaagtaaccaagaggtcctaaatgcagtgtccaaactgtatgtgggcccaagacctgccaaggtattcaagtacagccacactgaagctttgctttctaggcacaaagtttgattatcttatatctgcttgccatgctttttaatataactggagttagatgttggggtttctcagtctgtggacaaatatgcaggtgcttatgtatggaatattaatgatggagtttaaaaagagttacttaagaagaagtatctagcatgggataaccgtggattgaaaagcaccaagtgcatcttatgaatgcatttctaggccctagcacagaacttgccactgtgggcagcatgggaatgttaggtaaaggtaatggatgaatggtctgtgttctaataacctgcctgacctgtctggaatttccaacatttatcccacacccaaaactcccatctttccaaacaatattatattgcccttcctgctaaactgtttgtgtacggaaaccttatgatatataacagcatggcataacctgatccatctttgcattctccacgttgatcatagctttacaaaatgacctttttcactactggagtcatgtcacagtacaacttccagcagtgttgctgttttgataatgataagggaaattaggtatcattttcttttgactcaggaagattattttcccattgtgcaagtttactagccatagagttaataaccctcatcacccttatatgaactggaatttttatattattcttggaaatgattttaagtggatatttaattcaaatcttgttactcttgtgtccactgaacgtactacttacctagtccttggtttagtctttaatgcccaaaccaaaattaaggccagttctctacttattgttataacaattgcctgccctgtgtttcctgggtggttttctttattgtttaaaattcattacagtgatcctagtgtgttggatactagcataaaaagaagtcccttcatgtgtgatgtgttgttattgctaaattttcttacaatttgcttgtagtaggttacttgctctaacctgccagttgcctggaagggaaaggaatatcaaaggtgaacctagtgcatgaagtatttatgactcagatggtctcttctggtctgagaagaactgaagttgttgagtggagtttgcagtaaatggtggtatcttggtttgatagctttgggacaggagcacaaacatttaatggtgaattcacggtatgatgtatttcagcccaaagttaagaccaaagcacaactttagccatatatatcttattaatgaagcttattaagtgagtaaaggaatgaaaatggaaatggttggaatatgaccatcagattcaggcccaacgagagtattcttaaattcccagtcttacataagaggctgttttagaactctggggacattgaattcccataaacgtctggttatagctcccttgtagcacttgtgctgtttattattgcttttatgtctgtgttctttacttagtcgggaactcctatagctaggaactgtgtcataacatctttgaatgaataaattcatataaaagacagaattccaccctggccttcctcaggacaaggaaatagtggcaacaacattatctttggacacacaagtgtggtttgaatcctgtttcttttgtttactagccatgtgcctttaggcaaatgtcttgtcctttctgagccttagcctcctcaccagtaagagtgggataataacctcagaagttattaacatattcagaacaacctaagtgggtgctttatggagtcacagcacgtaatgaagtgcctagcataatgtcatgattactgataaactcagtcagacacttaatatctattcctccatccagcttaccttttgatcttaaaacactgatttcagccgggcgcggtggctcaagcctgtaatcccagcactttgggaggccgaggcgggcggatcacgaggtcaggagatcgagaccatcctggctaacacagtgaaaccccgtctctactaaaaatacagaaaaattagccgggcatggtggcaggcgcctgtagtcccagctattcgggaggctgaggcaggagaatggcatgaacccgggaggcggagcttgcagtgagccgagatcgcgccactgcactccagcctgggcgacagagcgagactccctctcaaaaaaaaaacaaaaaaacaaaaaaaccactgatttcatagcactgatgttttgcaagatatcctagaggggcccttaaaaatttatcatttctcattttcaagtcagtatcaaaaaagtcctatttcattagacattcatttatgtatctattatccagatatttattgggttcctgctgtattccaggccctctgctgagtgctagaggtatataaaccagcaaaacaggtaacgttttgggttgatctacctgtatcttacttacagtagagagagacaaaaaagtcaacaagtaaatgaaaacattgttgtgaaagtatcatgaggaaaaccaaatgatgaggtgaagactggttgggagtgatagaaaattattttggatagagtggtgagagaattcccctttgagaaatgatgtataagctgaggcttaaagaatgagacactgccaccagtactctcctctttgtgggcttgggggatgtgcagaacaaggacttcttgccttgtgggctaaggccataccaccagcctctactgtggttaccctgcccttggagctaatatcaacaggtaggtgggcctcccctcagctaagctgccaacctctcctcaacagagggtccttaccacccacccctccttgatgtcttataagctgatcccttcagactgggggagggggtggtggtgtgtgacttctctccatttccctggttctggaacttttaatggacatccgaattacaggggttttgtgagaattacattgttggatcccatatgtaaaaatggaggctaatctatcaattattaaccctggttgtactttaaaattctgattaagaaacgatttttggcaggagaggctattagccaagtgtaatgtatgtaacacttactttataaaggtatgttgaatgaatgtatgaattctaaattgtaagatttgaaatgaaaccattgccattttctctcatgacattagattatggaaagatttattttaaaagacatggaaggcatgaactgcaaaagaaaaaagtggtaaattttaatcaaaatttaaaacttttgttctttggaagatagatctgggggaacaaggcaagtcataaactgggagaaaatattgtaaagcaaaaatctaatgaaatgtgtgtgcttagaatatgtgaagaactcttacaccatacaaaacagacaacccaataaaaatatagacaaatggtttgtatagacctgtcttaaaagaagatgcataaatgatcaaaagtatgtgaaatttcaaggaaatgcatattaaagccacaatgcgatacaactgtatacccactggaatggccaaagttaaaaagagaataccaaatgctggtgacgatgtggagcaaccggcacctttatacatttttgttgggaatgcaagttggaaaacattatggttgtataagataacataaaattgccgtataattcatcagttcaactccttggtgttagtcgaagagaaaggagaacatgttcatacagactttatgtgaatattcatggcagtgctattcataatagtcttaaaaactggacgcaacctaattatggtatgtctgtactattgaatattatgtaacaacaaaaagaataaaatgttaatacatgaaaagacatgttgaatcttaatgaaacttttaaaagttatgctaagtgaaagatgtcaaacccaaaagaataaatactgttcaatttcattatatgaaaattgaaaattggcaaaactagtgatataaagcagattagtgattgcctgggctggtagttgagagatggcatttgactacagaaagtaccaggaaactttttagggtgacagtattattattaatatatcttgaatgtggtgggagttataaggttgtgtgcaattatgaacactcatcaaaatataaaattaaaatgagtgacttttcttacaatttattattttgtcattaatttgtaaaattataacttgtaccccagtaaaaacattttaaaaatatatagtctctgccagtttatcttatttgcttctactaatgaagcattctgcagtgtttcatcattaaatataataataaaggattatttttctaagcattttatattcttattctttcagtagtcattatatgactagagaatttggaaaaagtttccttttttcttttttttaaaccatattaatccaatttgcagaccttttatttatttttccaagggcattatttctactatgaaaagactggacaggtttatgggacacattttttttgttttgaatcaaagagcttgtcataatattaaagaaaaccaacaacgttggtatgattcaaaaggagctctctcaaccggctgtctctggtaagacaggcccagtaatgcccacctgcaaggctgttgtgaagatgaactgagaccacctatgtcagatgtagcagacagcatatgccctcagaaggctggtagctttactgtgtttctccataacacttctcatttctcggagacaaggtcagggaatgttttgaaatgtttatttgaaaagtatttattgtgcatatattatttattcatttacttactatgtccttgaaatggagactgtattatacagatattcaggtcagctttaacatatcctttaggcctaatcacttttttctttcaacatgcctaatgtagcataatagttaatagcatagtagtttgacttttaaaattgatttctagggaagaatgtaaatataggaaagcttcctgatagagattatctaaacttaggcataaataataagtaaaactctgaatttaggtatgtaattgtagaatccctttgattataagcaagttgaaaaaaattgttttttacctagatgagtttattttaaaaagttattaagcatttataaaggagccttttttggggtggctcctaattattaccaagtttccaatattataaactctgtgcttgagttgaatattatagtttaggcttctatctcctagtagtgtttccaagcaaacagtttttccagtctctcagaagttcatttcagttaccatctcctcactattcctggagtgtatgttgcttatggtagcagctcaagggacagatgtatgaatgagagcaatccataaatgtttgaattcaaattatagtttttttaaaataaattctgctataaaaagaaatgaaatatttgtccatgctaaaacatggagaaaccttgaaaactttacttatttatttttattatactttaagttctgggatacatgtggagaatgtgcaggtttgttacattgatatacatgtgccatggtagtttgctgcacccatcaacccgtcatctacattaggtatttcttctaatgctatcccttcccttgccccacattccctgacaggccccagtgtgtgatgttcccctccctgtgtccatgtgttctcattgttcaacacccatttatgagtgagaacatgtggtgtttggttttctgttcctctgtgagtttgctgagaatgatggtttccagcttcatccatgtccctgcaaaggatatgaacttatccttttttgtggctgcatagtattgcatggtttatttatgccacattttctttatccagtctatcactgatgggcatttgggttggttccaagtctttgctattgtgaataatgctgcaataaacatacgtgtgcatgtgtctttagagtagaatgttttataatcctttgggtatatacccactaatgggattgctgggtcaaatggtatttctagttctagatccttgaggaatcaccacactgtcttgcccaatagttgaactaatttacactcccaccaacagtgtaaaagcattcctgtttctccacatcctcgccagcatctgttatttcctgatgatgagcttttttcatatgtttattggctgcataaatggcttctcttgaaaagtgtctgttcatatcctttgcccatgtttctatggggctgtttgtttttttcttgtaaatttgtttaagttccttgttgattatggatattagccctttgtcagatggatagattgcaaaaattttctcccattctgtaggttgcctgttcactctgatgatagtttcttttgctgtgcagaagctctttaattagatcccatttgtcaattttggcttgtgttgccattgcttttggtgttttagtcatgaaggctgcccatgcctatgtcctgaatggtattacctaggttttcttctagggtttttatggttttaggtctgacgtttaaatatttaatccatcttgagttaatttttgtataagttgtaaggaaggggtccagtttcagttttctgcatatggccagccagttttcccaacaccattgattaaatagggaatctttttcccattacttgtttttgtcaggtttgtcaaagatcagattgttgcagatgtgcggtgctatttctgagggctctgttctgttccactggtccatatatctgttttggtatgagtaccatactgttttggttactgtagccttgtatagtttgaagtcaggtagcgtgatacctccagctttgttgtttttgcttaggattgtcttggctatatggacttttttggttccatatgacatttaaagtagttttttctaattctgtgaattttctaattctgtgaagtaggattttctaattttgtgaagaaagtcaatggtagtttgatggaaatagcattgaatctataaattactttgggcagtatggccattttcatgatattgattcttcctgtccacgagcatggaatgtttttccatttgtttgtgtcctctgttatttccttgagcagtggtttgtagttctccttgaagaggtccttcacatcccttgtaagttgggttcctaggtattttattctctttgtagcaattgtgaatgggagtttgctcatgatttggctctgtatttgtctatttttggtgtataggaatgcttgtgatttttgcacattgattttgtaccctgagactttgctgaagttgcttatcagcttaaggagtttttggactgagacgatggggttttctaaatatacaatcatgtcatctgcagacaatagtttgagttcttctcttcctatttgaatacctttatttctttctcttgccttattgccctggccagaacttccaatactatgttgaataggagtggtgagatgttgaataggagttttcaaagggaatgcttccagcttttgcccattcagtatgatattggctgtgggtttgtcataaaaagttcttattattttgagatatgttccatcaataccgaccttatggagtgttttagtcattggttctgtttatgtgttttttgtcattggttctgtttatgtgatggattacgcttattgatttgtatatgttgaagcagccttgcatcccacgggtgaagccgacttgatcgtggtggataagctttttgatgtgctgctggattcggtttgtcagtattttattgagcattttcacattggtgttcatcagggatgttggcctgaaattctcttttttgttgtgtttctgccaggttttggtatcaggatgatgctggcctcataaaatgagtaagagaggagtccctctttttctgttgtttggaatagtttcagaaggaatggcaccagctcctctttgtacctctggtagaattcagctgtgaattcgtctggtcctgggcttttctttggttggtaggctattaattactgcctcaatttcagaacttgttattggtctgttcagggatttgacttcttcctggtttagtcttgggagggtgtatgtgtccaggaatttatccatttcttctggattttctagtttatttgcatagagatgtttatagtattctctgatggtagtttatatttctgtggggtcagtggtggtatcccctttatatcattttttattgtgcctatttgattcttctctcttttcttctttattagtctggctagccatctatctagtttgtcaactctttcaaaaaaacagctcctagattcattgatttttcgaagggttttttatctccttcagttctgctctgatcttagttatttcttgttttctgctagcttttgaatttgtttgctcttgcttctgtagttcttctaattgtgatgttagggtgttgattttagatctttccctctttctcccgtgggcatttagtgctataaatttacctgtaaacacgctttggctgtgtcccagagattctggtacactgtgtgttcttattggtttcaaataacttatttgtttctgccttaattttgatatttaccttgtagtcattcaggagcaggttgttcagttttcatgtagtcgtgcggttttgagtgagtttcttcatcctgagttctaatttgattacactgtggcttgagaaactgtttgttatgatttccatttttttgcatttgctgaggagtgctttacttccaattatgtggtcagttttagaataagtgcgatgtggtgctgagaagaatgtatcttctgtttgtttggggtggagagttctgtagatgtctattaggtctgcttggtccagagctgagttcaagtcgtgaatatccttgttaattttctgtctcgttgatctgtctaatattgacagtggggtgttaaagtctcccactgttattgtgtgggagcctaagtttctttgtaggtctctaagaagttgctttattaatctgggtgctcctgtattgggtgcatctatatttaggatagttagctcttctcattgcattgattcctttaccattatgtaatgtccttctttgtcttttttgatctttgttggtttaaagtctgttttatcagagactaggattgcaaacgctgcttttttttttttttttttttttttttttgctttccattgcttggtaaatcttcctccatccctttattttgagcctgtgtgtgcttttgcacatgagatgggtctcctgaatacaacacactgatgggtctcctgaatacaacacaccgatgggtcttgaatctttatgcaatttgcaagtctgtgccttttaattggggcatttatcccatttacatttaaggttaatattcttatgtgtgaatttgatcctttcattatgatgctagctggttattttgcccattagtggatgaagtttgttcataatgttgacgttctttacaattttgtttgtttttgcagtggctggtactggtttttccttaccatatttagtgcttccttcaggagttcttgtaaggcaggcctgatggtgacataacctctcagcatttgcttgtctgtaaagggttttatttctccttcatttatgaagtttagtttggctggatatgaaattctgggttgaaaattcttgtctttaagaatgttgaatattggcccccactgtcttctggctcctagggtttctgctgagagatccgctgttagtctgatgggcttccctttgtgggtaacctgacctttctcactgcttgcacttaacattttttccttcatttcaaccttggtgaatctgacgattatgtgtcttggggttgctcttcttgaggagtatctttgtggtgttctctgtatttcctgaatttgaatgttggcctgtcttgctaggttggggaagttctcctgggtaatatcctgaaatatgtcttccaacttggttccgttttccccatcactttcagatacaccactcaaccataggtttggtcttttcacatagtcccatatttcttggaggcttcattcattccttttccttcttttttctctattcttgtcttcatgctttattttattaagctgatcttccatctctgatatcctttcttctgcttgatcgatttggctattgatgcttgtgtatgcttcaccaagttctcgtgctatgtttttccgctccatcaggtcatttatgttcttctctaaactgattattctagttagcaattcctctaaccttttatcaaagttcttagcttccttgcattgggttaggacatgcttctttagctcagaggagtttgttataacccaccttctgaagcctacttctgtcaatttgtgaaactccttctctgtccagttttgctcctttgctggcaaggagttgtgatcctttggaggagaagaggcgttctggtttttggacttttcagccttgttgcgctggttttccctcatctttgtggatttatctacctttggtctttggtgtcagtgacctttggatggaatttttgcgtggtcatgctttttgttgatgttgatactattgctttctgtttgtcagttttccttctaacagacctgtcttctgcaggcctgatggagtttgctggggggccactccaggccctgtttgcctcggtatcaccagcggagtctgcagaacagcaaagattgatgcctgctcctacctgtggaagcttcatcccacaggggcaactgccagatgccagccagagctctcctttatgagatgtctgtcgacccctgctgggagatgtctccccatcaggaggcacaggggtcagggaccccacttgaggaggcagtctgtccgttatcagaggtcgagcactgtgctgggtgatccactgctctcttcagagccggcaggcagagacgtttaaaactgctgaagctgtgcccacagccaccccttcccccagttgttctgtcccagggagatgggagttttatctataagcccctgaccggggctgttgcctttcctcagagatgccctgcccagagaggaggaatccagagaggcagtatggctacagtggctttgtggcgctcaaaattcttgtgttctaatgatgtgaagttaacaggatgcagatcacatatctaaattgacttgtaaacatttattttaggaaatgatagtatattctctcatcactaatatatttctgttgcttcaatgtgcaaaacactgtgctagatattgtggggaagactaaaatgaataatagctaacactaggcaagttcacattgtttgtcagatgctatgctaaatgctagatgtgggtgatttcatttagtgctgaaacagccctgtgacagagctcttgttagtttctctctctctctctctctctgtctctctctctaccgtttgaggaaactgatgctttaggaagacataaagatacaaatggtggaactggaattcaaattgagaccacaaagctgttgttcttaagtctgtaacatacaaagcctcacctttctcatctgaaagtgaggataacaagctagcttgttgcaaaggttaaataaagtaatactgtaaaacacttggtaccacagaatactactattacttcttaatggtagtaattattatggccaccgtagaggagggattataaagattaaaataaatgatacacataaaggatttagcatggagcatggcatgtaagcactcaccaactcaaagaggcatcctttaaattggactgtgaaagttgacagcatttttacagttgaactttgaacaacacacgtttgaactgtgtgggtccacttatatgcagattttcttccacctctgccacccttgagacagtgaggccagtccccccaccttcctcttccacctcagcctactcaacatgaagatgaagatgaagacctttgtgatgatgcacttctatttaatggacagtaaatatatattctcttccttgtgatttattaatattttctttctgtagcttactttattgtaaaaatacagtatataatacatataacatacaaaatgtgttcataactgtttgtgttattggcaagtcttccagttaacagtaggctattagtagttaagctttggagaggtcaaaagttatatgtggattttcaactacacaaggggattgatgtccctaatctccatgttgttcaaggattccacttgtatatagagagatctgtgcttgagggaaaagaacatgatcaagattaggggaatgcatgtacaaaggtgctgtacaaagatgagattaacgctgttaggtagccagtttatatctacacaaaggtacataggaagagtaaaatgttgggttggaaaggaatttggggccaaatcttacagatcttcaaggcctggcaaagaagtttggctttgtctatcttttggaaagccattgttctgagttaactcactcaaaaacatccagggtttatttcttagcattggtaaatgaattctttagacactgaaaaaggagggttgcctttgaatattttcttgttgtcattattattataataaatttattttctaaaatgtactgaggtagtgacttgacagaatcaaagcatctcagaaaatgagtcattggcttctttctaatagctgcttaggattctaaatgtttgtgttggcagatctcacataattttcttaagtctgtgtgaaatgttcaaaagagtttcctatgataatgtttggttcattcaggttgaaaatgatgaaaacaacttctagaaagagatgacagtgtaagttacatctggcaacccagaaacaaagttctgtagactactcatcatatcaatcattttttcccaaattattatggtgaaacctagatacaaagagcactgttccatcagggatcttatctatctctgaatagaactgtgtttcctgtatgatgttgtgtgtgagtgcatgtgtataaaaataagtctgtcaatgtgggctttttttcctttttctcttaactcaaggattaatcgtaaggttctctagtgtacatttttcattattgttttgagaaagagtcttaccctgtcacccacagtggacagtgacatgatctcagctcactgcaacctgcgcctcctgagtagctggaattacaggcatgtgccacaacacccagctaattttttgtatttttagtagaggcagggttttgccgtgttggctaggctggtctcgaacttgtgaccttaagcgaaccacctgccttggcctcccaaagtgctgggattacaggcgtgagccaccatacctgccctatcgcgtacatttttaaaggcacaattgaaaccagtgttctgaattaaaccactcacattagcttacaaatactacattctgatttggttggatctctgttttcagtataatttaagtgaaaaaaatcataattgtatgataaagataaatcgatgttaccaaagtatatttaaaagggcattggtaaataccacaaaacttattttctgttttaaatggaaaaaatagtttactatgtgcctatttaacttacacaagggagtttgctttattagagtaactgcaaatgaggcaacaaaatttttcttttggcaaatacacgtattaggtctcatttcaggtttgaggaaaatagtgaatatttttagttattttgaatacaaatatgtaatattctttttctgagaagcctaagtagtttttcttgctatgcctgaattttggcagataaacgtgtcaaaccaatttgttatacacctgttgtaacagaagtgacaaagaaaaatcacagttcagagatttgacaggtttgtactgaaatggtgtttagtatatctaggtgttctatctagaaaaaaagtatagaatggctcaactttaaattgattaatctaaaaagaaaagccttcataaccaccagcttttatttagtgttccacatatttctaatattccaacaaggatatcttccctggagagagtagagttgagatcataccaactctgattagaattttcacttaagaacagcagttgagatgatgttatctacattcagattctcaacttagttatggaataaaatattgcacatgctgtgtttgataaaaagtaagtgaaatgtgagtattgtcaggattttacttaaactagaaataaatgatatccttgtaacagtttgaagtacacaaaagaacgtgatatatcctctttctcaagccttaataatcatggtatggattggttgaagattatttgaggtgatatccacttgaagtttttttgtttgtttgttttttttaagacggagtctcgctctgtcacccaggctggagtgcagtggcgcaatcttggctcatggagacctctgccttccgggttcaagcgattctcctgcctcagcctcttgagtagctgggattacaggcgtgtgccaccacgcctggctaatttttgtatttttagtagagacagggtttcaccatgttggccactgctgacctcctgatccgcccgcttcagcctcccaaagtgctgggattacaggcgtgagtcaccacgctcggccttctcttgaggtttttatggctgaagcatatttttgtaaatcatgttattggtgatatgatggctaaagccgacctgaatacattatacagtctttcctattgtgaacatattaattaacttgtgagattgctcatgataattctttttagggcatcttgagactgccttctgctgcattaggagagtttattgttttatgaaatacatgttttctgcccatcactggtcatcttatgtccttaatgctagaacaataggaattttcccagggctgaattctggcaccatttcatactagaccttttctctgtttctccccttttccttgtgtgtgtgtgtttgcacgtgtgcacacatgtatgtgtggtgtgtgtgtgtgagagagacatagaacacctattttgtttcttggctttgctttttattgttttttcattagtttttactgttcttaattcctaagacataatgaattttaatatctggcagggtaaactttcagcttttgctttattttcttgaaaaaaatgtctaagccatttttttctccatgtatatttttagatttactttgttaagcttcctcaaattcctgatgggatgtaataggaaatcctctgagactataaattaattttacagggatttgacatctttaaaatgttgactcatctcatccacgagcatcttctttctgcatttatttagggaattttaaatgtcctttaaagttttgacattttctccttgagaatcttgtgtgatctttgttagattaattccaagatgtattgtttttgttgctcttataattaatgctgtgtttgccttttttctggttattgcagaggaatactcttcactttgtgtatattggttttatatttgacagctttgcagaattgtgtagttagttctccattaccttattagctgtatatctttgttttagcagtttgtgggtgataaattctttctgcttttgtctgtttaaggaagtctttattttgctttttattttgaaagagatttgtgttggctaaagaattctaggatgacatttttttccttttagcactttaaagatgttgttttcatatttccaatatttcctcatctttagtattgatattgcttaacttgttttaaattcttattttgtctgttttctcactcattacttcagtagttatttttcctctatttttattctgtctttaaactgcccagggtttacttttacttatggtgtgagtcggggatctttgccaaatcattgcctcctctctcttgtcagtcctgcctgagactcttccaaattattagccttttcaaaataccacttagtggttcattaatcagtctgagtgatgaattgattgactggattttttttagttcattgatttctgcttacatctttattttctgctttcacatttctggctttattctcttggatttgtcccctttggtggatttagttatcagctaattgtaaatcattattattttctattgaaggcatttaaagctcataatttactgttgttactgttttaggtgcatgccgtaaattttggcatgagttcttcccttctcattatactttaaggattttatagtttccctcatttcttctttaaatcattattattcattattatttttacatatatgtgtttttattttatatttcagatatgtgcagtctcttctagtcatcttttttattgtttctacctttattatattgaggtaagaatataatctggtggagtttttgtaattttttgaggcttcagttttggtctatgaggtgatcaagttctgtgactgctccatgagtgcttcagaagagcagctagtctatgtcacaacactattaattagtgtatttacattttctctgccatttctgagatgggtgtcttaatactatatattatatagagtgagtatccctaatccaaaaatgtaaaatccagaatgctctgaaatctgaacctttttgagcaccaacatgacactcaaaggaaatgctcattggagcattagagttcagattttcagattacagatgctcaacctgtattattaattgatttaaattttctatcagttgctatgggaaacatactgaattatccaatgaaaatagttgaatttgttattctagtagatctgttacttacttccttctatattttgtggtcatattttcaggtacatatacctctgtgattgttgtatttttgttctacagcatttcctgtaggtaaatttcctcttggtcctttataatgtttttggctgcaattctattctgtctgataataaaattgcttcatggggtttcttccattttatccctctgtgacataatactttccatacacttaacattgactggttgaatcatggttttctcaaaaatccaatctgaaaagtctttcttttggtatttagtttcatccatttatattttcatcatgattacttttctatcaggcttattttcactgtcttgttttctgtcttctatttattataactgttttgtgtcttgctcgcattgctgttttcttttctaccttccagtggaaactctttaaatcagatgtcttatttttttccctcagttctgggaaatatttgactgttatttcttcaatactttctcccatctgtttactttcctctattcttttgagattcctaatacttctagcctccagattttttatcttatatctcattctttttacctttaagatgccatctggagagatttttggccaggttttctaagatactgtgtaggttgtttgagctgttgtcttttattgatggtgcttctgctcctcatttgcctcataattttctctggactcatctttaattcctctggagttattacctgcttctgtggttggaatgtgtcccttcccaagtccaagtgctgccaatgtgatagtacaaagaggtagggcctttaaaaggtgattaggccatgagagctcctcgccttgtgaatgagaccattcctttgtgtacttaaatgatttattgctcagaggaacttaacttttacatggaagcctgaagggtgaaagcagttcaatttgagggtggctgaattgggctagtcttatcaaagaagaagacagatactgccttggtgaacattcatggagacattaacaaggggctgatgcagaaggtatgtgatgacctatcttcaaacaggtagaaaacatcacatctgtaacaaaagaaatgactaggcagatcttcttttaaactctgggaagagcagttgtgtgctgtattcacacagcagctatcctgtcattatcccttcagcattttaagctttgactttacccccctctctcattagcagctagcttctagaaggtgtcaagacacggagagagctgcagactgggggagggcaagaaatctggagtcagatgatcatctttcccagttggaagaaaaccagattggaaaaactgatactttggctgctcctgtttctctccactgaccactcctgtgctgccgaagactgaatcatcctttctctgtctatgctcatgtatcattcataatatcgctttactgtggtgattataacatattaccctctggttttctgtgctgcttcccctgaataaatggactcctctagggaagggggattgtcgtattgttttgtgtgttcactgaagatttgttaatgaaataaatgaattagcagtcattgaaaatgtagccatagatatgaatcctgcctgttggctagaccattgagagttttgatttatttataggagaactctgttctgagccaatatgcctgtcagtaagactagtctgtgaaagcgtagattagggcttggaatgaatagaatttaaagatgaaagttaatctttatcatctatctatatcatgtctaggagtcttagaaaatcaatgcttataaaaaattatgaaaataaatttgtagataaaaatgagtttaattatcactgactgtatgaaccagtagctagtgtgaacaagaaatagcatgctggcaggaatgagaacacattatcacgtgacagaagtgtaatacccaactgcaaaggtgctataggatcaaaatgcatagaggaaattaggtaatagtacaaaataaaaataaccaacatctggtaacatgtagacattttccatctaaattgttgcttttaatgacaaagtcatgctcctcctggaggatgtgatgggagctgtgcagtgagattaaataggtactggaagaaaccatagtttggtgttttgcagttgttcatagatcaaatagttctttgctttgtgtgaaaaatccctcagcagcgagagatgaggaggatgaattagatcagcatgaattttccttttcctctagaaatgcttcagacacctaagggccttaagccagggtccataagtggaaagctgtaagggaaaaaagaaacttcacagtccaacaggtgagaagactgtaatttctgatcaaataaatacctaggtgtttcattgtcttgtctttttgaattcatgtagtacttcctttctcaaataaccccagaaggatggcaaggggtgtacgtgctgtgttttgtccctccctcttcctgtgcccaactggtaaggaaattggatgttttactacgatctctggctccccacccctgccccctgctcatatagcttgggaagtgatgatatgcgctgagtccattctaataaaacacacaacatgacttactgcttcatgatatgttttataagatggattgatttatgcacctatataagttgagtctgaatagtcagttttcgaagtgaattaagaataaatttttgttacattgcatcttatcaataagcattttaaaaccccaagcatatttatttaaacatataatttaaaaataaatgttttgaaatggtggttgaagaaccttttctttatttttcacattttctgatgtacttgctgttctcatcttctgatttcatgccctctggccttctagccccgtgcatcgtttttgagcacatttgaacatgtctgatccatgtagtctgaacctgttgctctctgagggttaccctactcatccctgcatgcttgccttcatctggaaccagcctgatgcattccaagaggaggatagaggtgggtccaggtcactttgcacagggatctgcacttcatgatccagaagaaaagtgcttttaaagcccaacttggcacattttaagtcaaaattaggtttgtggcagttggcacatctcttaaattctctatttttttagtcccctgaaatcatatttggagtgaaagaactgaaaaagttaaaactcagtctcttagactggcttagattggctttctataattgatttatcgtctacttaggcaatactccaatttctttattttctatgtaaattgtgttgatggatcagtacacaatattgtatcatttatcatttctattggaatgtttttattttaattactttggtagaccgatttgcattaagaaagttacccatggatagatatattagaggatgttttaatattctttaatatataatattcttcagaagattaaccaactaatgtatcataaaatcggtagagtaactgactagctttatgaaattgtaaatttgttgaaaattgattttttttttactggagacgagagttccataattgaaaaaatatcctatgccagtgctttgtagattgcaagtaacgtagataatcttgcctgtagttccttgatgaaaatgatctgttgcatttacaatatcacaagtaattaattattaaagtatatgcctgtgattggtatgttttatcttaattctacttattctcttagtcatgcaaagaagaaataactgccagtggtagctgttgaaattatattcagatctattgaggagcatgttttgaacatcttttatgcttatttaaaaagaggcggagcttgtagtgagccgagttagtgccactgcactgcaagcctgggcgacagagtgagactacatctcaaaaaaaaaaaaaaaaacaaaaaaggcttttctatgggattctcatttgtttaaattatacatgtgattacttgacacgttaaagtgtacacaatttaggaaaatgggattaaaaatccagaaacacttaagaagttcttatagtgaagattaaaaaagtgatttcatttaatgactttcagaaaaaaaaatcactgggtggaacataaatgtttgaagtattcttgaacaaaagtgctctctgatactatagacataaaaattcttaaattacccgtgaaatatgctgttcctagggaatggttgtgaagtactttttagtcactcacctgatagagaaaagtagtctgaaaagctcatacacactgaattacttcttcagtttaactttttttgtgcctgctagttagttgccaggcactttacattgagtagtgaataacagacacctgcttttcaagggctgcttctgtagtatgagaaagagatacatgaacagacaatttttaatatactgtagtgaatgctgtcatagatgtacatgcacatgacctgttgtaaaatctggagcatgataggagagagagagatttgtgggcaggttgtcttctaggtcacccttccctcaacaccatgtagatgtgacctctctggtcttggcagtagtgtggttgtaccacaaacagaggcaggctgatgaggttgacggattttggtgttattctaattattcctttaagcaagtcatttacgtttctaagtctgtttcctctctgtgaattaaggaaagtagtaaaactaccctgcctcccaaggcagttatgaggactagctggggtaatgtgcctgaatgagctttgtatatagggaaaatgtatacaaattaatcgttagtatttgtggcactcactctgtgatttggcctatttcacctccctatgctctggatttattatctgtaacgggaacaataatggttgttcttacaaatggtagttgtgaggattaaatgagttaaaatatgtgaagcccttaaaacagtttctggcatacagtaaatattagctctcattttgatattcttatagcagaagaagttgaccctacctctctgttaccctggcagaaggttttcaagatactcattttgtggtaccctggacattaagattccatgtaattttgatggcataatgaaaactttctattgttggacagttgttgtagatgagcatccagaactggattaactgatccactgcagataggaacttatgaggtgagcaggtgctcccctttagctcacactatttgctgaatagtttggaaatgcctctttctggcattcaaataatatactcttctttagttgcagaaagtcagtttaatgaacagtgattaagatgctgccttttggacagtcattaataaatgttaattaaaaaccccagtctagagcatctgccgttgtcccctcagatgggtacctactatttcagatctgttttgtttagagaactacagcaagcttagtagccatttctgatacctgttttagtagcaaattatactgcttcctgttcgtttgatttcttccagggacatattttattttcctgcctccttagaatgtctggcaaaaagctttatttcatctgaattctgctgggtcatcacattggacttgtggaagaaaatggatttataatagcaattaataaaaaatagtaacaaataatattgcttaatagtaaatgtgtactgtatgtgccagccacagtgctaagcattttaatacaaaagcataaaataacattgtgagatttcctctagcaattttaaacttaaactagatgtttattcgagggcagctttaagctgcatttgcatagcaggctttttgctgtgtatttattgggaggagagctgttggaaattacagagctgttggaaataaaccctagctaattctcagggtttcttccagtattgaacttgtctgaaaagctgttggaaattagtgtgcactgactcccccaagatgcccctggaaatcaccactgcttgctctaccaaggtaccagaaaatctgccctggaaaatgagtcctttggattaaatctttccatcttcaggacctgcttgaagtgcaggtgtccctggagagggagctaattaaatcatttaacacttaaatagggattcagttatgaaattatcttctgagaaagaaaggagctgaaggctcaagtaacttttaatgggagaagaaaatggtgatggaagatttcttgctagtggtacttcctagggaattaactggagatagaactgggaagccagggagagaatatagagtgcagaaaaagaacgggaaagggcagatgggagtgagttaagcggccactaaggtcccttcctgtatttacactgggatcccatattatagagaaagtccatttggctctcttccccatctcagacaaagctttggttccctttggtctgcagcattgtctgtgttcctgggagaactcttcagttccatttattggctcagaagtagatgctgttgctataggatgatggctggcagagccattcctgagaatggctcattctatgagccagtgtcatagaattgtccttggaatgtcagccattgaagtaagtggtgtgtgtgtgtgtgtgttttctcacgccattgtgtcttgtattcctgggttggagagatattaatgaatttgtggagactaggaaaatagttaaactctagattgtctcatttaggttcagggagagaagtcttcatccttgtaacacagtgttgtacttacacgctctctggaatttgagttagaaactggtggtataacccagaaatgcgtttactctcagagtttactgattatttcatcagatgtggctcagaattagtgttgttccataaaagttgaaattggttcactttagaggcaaaagaatcttgactttcaagctgaacaaaaaataattgggaagttaggaaatatcttctagtttaagactcactgcttgagagcgcttcatcaccattaaaatgggaagacaaaaatatttcaattttcataaaactgggttcttgatatgacttttggctggaatttactaatatctgagattactttccccagtctgtaaacatggataatggtaactgcctgtaagagtagttgtaagtatagtggaagtattaagtaaacaggcttggattatgactctaccacctattgggctatgtggacaactttatttagtgtctttgagttagagttgcctcatccagtaaaaccctggcagggtaagaatttaataagatgtatgctaaatgcctggcatgcattaagttggtttgccattcacgtgtgctttctttggccagggctgtgttaaatttgaaatagtttctaacacttaagcatcagatgattccactgtaataatctggatttcagaaatcagaagatctggcagccttgtgtctgtccctctggctgcctgactcctcaagctgtgtgtctgtggacctctttgggtaggatgtgttctccagttttccacagaactgctgctgcctacagcgttctaccctgactgttcatgcccatatgttctgtagctgagccggtagacatttattgttctgccagtaaatgaatgttttggttgaaaagtatgttgcactaggtgtgatatttggtacacaatagatggtcattaaatatttccctttttctctattaggctgctgatgatgtagtgaagagaaagtttaaatccaaatgatttcagccctgaactagaaagttctgtctcagtgggctgtatgatctcagaaaatcacttaatttctccattgctcagtgtttttctagggacactagagaatttggactagctgattctcagggtttcttccagtactgaacttgcctgaaaagtgatacataaccacacgcaaacttccatggggtgtttgaataaaaacttatatcctaaaaataaaataatgaagtatggattgtaagaacaattaggttaattacaaagtggcttaaaattaatgttcaggctgggcacagtggctcacgcctgtaatcccagcactttgggaggcttaggtgggcggatcacttgaggccaggagttcgagaccagcctgaccaacgtggtgaaaccctgtctctactaaaaatacaaaaattagctgggcacgatggcaggcacctgtaattccagttactcgggaggctgaggcaggagaatcgcttgaacctgggaggcagaggttgcagtgagccgagattgtaccactgcactccagtctgggcaacagagtaagactccgtctcaaaaaacaaaaacaaaaacaaaaacaaaattaatgttcagcgttgttggttagtaccaatctagaaaactgaagaatttaatcttttagccctgtgctgttgatttggataaagctatggggggcagggatatcaatataggagctattgtgaagctgggtgtgacagtcatatgatggatgacaggcccaggatggagagacatcttgatagcatggagcagtggacacaaaattgaacaaagatgtgtacacagtggtgtaatttggtttgaataaaaccaaccgaaaaagtaaagatgaagaaggaaataacaggtaaaacagagctagggttttagatgaaatgttcaatctcaagtgatatatatacatggccatcaatgtgtcatataaagagaatattaggatttccatttatgtttatttaaataagcaacttttcaatttgtgtgtgtgttgaattacataacaggatggtactacataaataaaacaaaacatgcccttggggtattgatgtaatcttttttttaactaataggagagtgtgatcaaaagtttgcaggctgctggattggaagttctgtttgttgaaaggtagcatagtatagtggaaactacagtctttaaaatcagatagtcctgaatataaactttaactttaacacgtaatacttatgtaacataacttaatgagcctcactttcattgaatgtaaaatgtgtgttataatacttctctcataggtatgttggatggttgcaatgggatgattttactgctgtcttttggttaatttctctgttttttgtctttcatgtttgattctttagggctggagaatatacccagtataattttactcttttaaatttgttgggttttaaaaatgacccttaactgtccaatacaaagtgtatcttgctgaatattccatgagtgcttgataagaatgtgcattctttgtgttctgtaaatgtcagttagatcctgttggttgatgtcttattcagttcttctgtatctttgctaattttctatttaatagttctatcagttgctgagaatgggatgtttggtccccatgatgagatgagtttttaccattaatttttaaaaatgtacatctgtgtctggccttgtgtgacccagagtggtcagcatagtatagaaggaatgcaaagaagctgtagtgagagaatagccagcttcatataggagaaaatgttctcatgctatgatttcccatgaattcagtagcagagtctgtcatcattagctttccggggtttgtagaaatactatcatgcctttggcctcgttgttattattgagcaaccttgcatactggaagctccagtgccttctgtatacaatgagctggattaggttagttttctagtatttagtgactctttcagtcagatacagactcatgtttgaccccgtcttttggcatgttagcatgcagaattaacctgttttcacattttgcagcagcacatgtaaaaatacatgctttcagttttttggccaagtctttttttttttttttttttttttgagacagagtcttgctcttgtcacccaggctggagtgcagtggcacgacctcagctcactgcaacctctgcctgccgggttcaagcaattctgctgcctcagcctcccaagtagctgggattacaggcatccgccaccacgcccagctcatttttgtattttttagtagagacagggttttgccatgttggccaggctggtctccaactcctgacctcgtgatctgcccgcctcccaaagtgctgggattagaggcgtgagccaccgtgcccagctggctaagtcctttttaaataaacctcttggggaagatatattctagtggaaaaggaaggacattaagtaacaaaaaatatcctcaggctttgggtcttaacaaagcagtcattcttgaaaagccactttttatttctctattcctcattttctagagtaactcatcaagttcttttaaataaatgtgtctgttttaaataacagatggctggaaaaataccccagctgagaattgatcttttagttgttgattttagtataaaacagttacattgactgtgatgattgttatgttgggatttatatccttcagtttttttgtattagatttgcttttttactgtttattaatgctttccttttgtctgctttcctcctattaaaattttttaaaattattttccctctactggtttggccattatgcattctgttagactgaaattttaacacacatactctgattaattttacaaaagatgtatctgggttttagtaattttgtgaatcaaagaactgggaatttattatcatatcaaaaaacgtgaccactcagggttctgaaatacggatttattgttgttctgtgactctagtccgtttcgtagctacctgctaattgcattattattaatggttctggagaatgatccatcatagagatgtcaaggctggtataaatttactgaggaacaatttaatccatgcttcagcaccgcagactttttgttaacagatccacaattaaagtgaagctgctgccagttgttgaacttgagttagaaactgcaataagccacaggaaaagaagcaaaaataaacctcttttcagatgaaattgaaaaatatctattggaataacatgaattaaagacttgtcacttcatgaacttattgttctttttttcttttttgttatggagagagacacttctctagtctccatttcttggttactgtcaccaacagtggcagttttagataaaataatgtcgagggagaagaatactgaaacgtaaaaatgtggtggtggtagttttatttttaaaaaatatatatcctgtggaaatagttttcagttttagcttcactgtatccaccctcctagcattaattcagtacgcctaagtgaagttgctagctgctaaagaaatagttggagtgctattcagctgtgaggctaaaaatctcgaactaaaacatggaaattgtttttctaatttcatttgggtaaaaatgaattcccgtgaatacatgttagcaaagcaagcttccttttattatttctcataccacagatacaatatccagaaatgtgttgatgtgaaataaaatcaaatcaaggtgattatcatgtggacattggatcaggattctggaatgttcagtttgtgggttgctttgcatttctcacttggagatgcactcacaactttatacctctttgccttagttttttgcactttaaaaatgagaagtataatgatcttgagctcacatggttgtcagacagtgaagaattttgaaaaaggcaagtttttcatttaagtgcattacatattaagaaattcatatcaaacttttgaaaaacaagtttgacaaaaaagcaagtgatagtggctctacaaaatgtacttctgaactttctatatgatgtatttctataatatatagaagtatatagaaatattctataatatagaaatatataatcatatagaaaattcaaaagtacattttggagggagtctggggatatttttcagccactttcatgtataatctttctttcctagcccttcttttttccccttttaattcactcaactgtcctagaggacagtgacattttagaggaaatttattcaaaccacaagggaatatttacgaagagtttctttgcttgaaaaaaaaattatttctttgctttgatattttaaagaaattgatacttttaaagtttcttttaattttaaaatgatgtcaaacttacataaaagttccacaggtagtgtgagatacttccatgtgtactctttaccttgattcaccagtgttcatcttttgcttcattgactttatcattagttctgtctccctcgtacacaaactattttttctctgaaccgtttaagagttcctgtagactaacccttaactgtttcaacgcatacctcctaagaataaggacattttcttatataaccatagtacagtgataagaaacaaaactttttatatccagtccacaatctgaacttaaattttgtcagttgtcccaataataacttttgtagcatttctctcctccactgggtccaggatccatccacttgtattgtgtttaattattatgtcttaagtttcttttaatcttgaatcattcttcatccttttttctttcgtgaccttgatgtttttgatgagtacaggcaaattattttgtagaatgtgtcttaacagatttgtctgctgtttcttcataatagtattcaggtgtttatttgcttatttattcattaacgtttattatgtcctcttggattctcatacagtgttataaactattactgtcaacatttattctgatgctcaaattgttacaaatctggccagtaagagccccgtcagcttaaagaatgatgtcatcatcgttctttacatcatacatcatcttgtactttttctgctgcatccttggaatcagccagtactctaaggacccctggttctttttactggagagtggtgttcaggtcttggtgctagatgtgcttattgctaccagaatgtcataacttttaggtcttcttggagatcaaagtgaggggaaaatacacacaaataaatatgcatctgtctgttcatccatccatccatccatctagttgtccgtctatccatgaaaaaccatgactttatactgatatgttcaatttcagtctagtaccacagggttcattgcagtagtcctcctttccatatttgtaactccaccgcctaagaaacatggctttattattcttaatatacctacttatttgctcacttttaacaaaaaatatttaaaatttctaccctacagcaccatgaaaaagtaacctaatgactagagtttagtgtttgcttatggttctttgtgtcttaggctgggggtatgtagtcaaagtactgcattcagaagttacttgggatagttccttttttcctctcttcaatgttactgtgttctttatttgaaatacagtaaagttcatatgtttctgttgtattccttttaccattccttcaccaatgcttgttgattttatttatttggatatatgaaacagtatggtttcaaaaatgaaagatgtccccagaaacattatgactctaattctttcagtttctctgctctgtttatgcagctcccaccctagttcctgttacctataggtaactggtatcattagtttttggtttatccttcttgtatttcttttgcaaaaacaagcagattcatgtgttttcttttcccactctttcatacacaaaggtaacgtgtgtgtgtgtgtgtgtgtgtgtgtgtgtgtgtgtatatacattaagtttgcttttttcatcagttcataggaagcattctcattcatcctaacagcttattcagccagttttctaaatattggcatttcacttgtttccagtagtttgcgattcggaaacactgtagtggataacctagtgtatatatatgtttataatattggaggtgaatattttgggtaacttcctggaagtaatattgctagatcaaaaggtaaatgtaagtacttttgttagatttgtcaaattcccatccataaaggctgtaccagttttcatttgcacaagccaagttgtgagaggacctatttctccacagttttgtcaacagaatgtgttgtcaaatgttttaatttttgctgatctgaaacatgagaaatggtattgcagcgtagttgtcatttgcttttattatgtgttaagttgaagagttttcatgtgataaatacaatttttagatcttcatttgtgaattgtctgtgtcttttggctgttttttacatggtgtttatcttgtcttttaaacatatttggtatatatttttagtgttattggctttttaactgtgatacatgttgcagcaaatacttttttctagcttgtcgtgtattcttttttgattgggatataattcacataccataacattaatcctttaaaagtgtacaattcagtgatatttagcatattcacaagattgtacagcatcaccactagaaaatgttctaattctagagcattttcatcttcctaaaaagaaaccccatgcccactggcacccactctcctcaacccacaaatcccctgacagtcaccatactttcagtctctagggatttgactactgttttttatgtctggcttctttctcttagcatagtgttttcaacatatatgaatatgttacagatgcatcagtacaacatttgtttttatggcagaataatattatatggatataaaacattttctcatcagttggacatttataatgtttccactttttggctattaagaatgatgctgtcatgaacccttgtgtgcacgtttttgtgggacaaaattttcttttttttgcatataccttgaggtggaactatcgagtcatatgataaatttatgtttaaccttttgaggtactgccagactgttttccaaagcagttgtaccattttacaattttggcagtgcttgagagtttccatttctccacatctctaccaatacttgctgttgtctgtccttttgactataaccatcttattgggtgtgaaatggtatcttattgtgatttgatttgtgtttctcttaagactaaggatgttgagcatctcttcatgtgcatattggtcatttgtatgttttatttagagaaacgtcttctttaaatcctttgcccattttaaatattgagttgtttttattaagtttatatgttctggacactagactcttgtcagatatatgagctgcaaatattttctcccattctatgggttgtcttttcatgttcttgatgatgttctttgaaacacaaagttttgatgaggtccagcttaccagggtttttgtttttgcttttcttcatatctgagaagccactgcttaatccaagtttacaaagactaatgacgatgttttcttttaagagctttatagttttagcttttacatttaggttttaaatttactttgagttaattttgtgtaaagtgtgtggtaggtgtccagcttcattcttttgcatgtggatatccagagtcccatcactagtttttgaaacgactgttctttcctcattcaatattcttggcatccttgtccgtcaacaatcagatgcccaaaaatttatggatttgtcatttgtcttttgagattgcttatgattttttttggccatgctcaagtttgaatatttgtgtagctaaatttatcaacattttgcttatcttaattttgagctaaagaaagttttttcctacacttaagttatgggggaattcacccatgttttccccttataattctgtcattttcaaaatggctgttcttttgtctcagaaccatttattttattttattactttagaagcagggtctcattttgttgcccaggctggagtgcagtggcacaatcgtagctcactgcaacctcaaagtcctggactctggtgatcctcctacctcagcctcctgagtagccaggactacaggtgcatgccaccatgcccaagtagtttttaaaatttttaatagagatgaggttttgctatgttgcctaggctggtctcaaactcctgggctcaagcagtacccctgccttggcatccgagagggctgggattacacaggtgagtcaccatgcctggccagaatcatttattaaaaatccatttcactcagtgatttcaggtgccacctgtagcatatactaaatttgcatatgtatatgagtctatttttggacttcaaagtccgtttctctgtttatgtaataccatgatttttttaattaaaaattttattttgtgttagttttagattcatatgcagttgtaagaaataatacagagattttctgtagtctgtatccagttttccccagtggtaacatcttgaaaaacggtagtatggtatcaaaaccaggatattgacattgataacagtctacaggttttttgcagtttacttgaactcatttatgtatatatgtgtgtatttacttcggtgccattctgtcacatatataggttcaagtgttcaccaccgcagtcaaaacatagagcagtttcatcactgcaaggatcacttatgttgctcttttataaccgtacccacttcctctttcatcttccctagcctctggcaaccacagaaatgttctccatttctgtaattttgtcattttagtggcattagaaaagcagaattatacagtatacaatccttagggattggcttaaaacatcttttctcagtgcagtttcttggagatttactcaaattattgcatgtttattgttgagtagtagtgtatggtatggatggaccagtttgtataattgtttagtttttgaaggacaccggggttggttctgggtttatactcataaataaagctgctatgatcacaggtttttgtgtgaacataagtcttccacattcctctgagataaatgcttatgagggtgattgtattgaagtggccttgttttctggggtgacgctcagaattcttggtctcatagccaaggaaatcaaggacatggatacaccaagggtgaagtttagagcagaaatttaataggagaaagaaaaagaacagctctctgctgcagaaaggggtcccagaaaaagggttgccatcctgtagtgaaatacaggaatttttacagacaagctagtggggaggcagtatctgaacatagggtgtgaaaaaccagttaggatcaggtgtgtcatctgcatagggtgcaaatctctggaagcccctaccccaatcttttatcatacaggcaggtcctcagcctgagctactccatgttgcttatttctttcttactgtgcatgtgctcaaaaaggggaggtagaatccccatggtggacatgcctggccccagctagccctttctgtccatgcaactgctggcatcccccagtgcaagcttccaggttccttatctatgtttgcagtctgatcttccaggctactctttgttagaaaataagtaatttcttgggctgctttttgttagaagggaagttctgcgaaggatgctgtgccctcactatctgcctcaatagttttttctacctcctgtatcatgataatggcatgtttagttatataagaaactgcgaaagtgttttaattataggggcttttcagcatgttttaatatctggtagggccaatagctcctaatagcttttcaagtattttccaagtttttacacaaaacagttgtattatgccagtgatatgtctttgtctaatttatcctacttataggattgcagatggaacaagtagcattttctttgttttcccaactttagctcttgactatctttagtccaacttggctggcaaattgtcatttaagtatgtcgcatttgcttgcaccttttctgaatttctcaattattctttttaagaaactaaaattatgaaagtttttttcctctttttattcatttcttatctacttgaaataatgggacttacatatacatcagtgattctcaaatgttagtgggtaacagattcacctggaaggcttattaaagcacagattgctaggccttgccccagagactttaattcactaagtatggggtggggcctgactatttgcatttctgaagcaccaggtgatgctgaggctgctggcctgggaccacattttgaggactactaggctatattagtagaatggcttatggagtgtctctgagaagattgctgggtcttatgattgacattatatttgaatgattgtgtaggacagatgtcattatatctgtactgctaaagaaacaagatatatgatgctggtatctaacagacttttaaatcttagtactgaaaggagatagaaaagttcagcttttaagtcattcatttatttaatctttaatttattcatcagattttattgcttccaactacatttgctaggcagtgaaatggtttctgttttacacaatgaggaattttttttttaagaagagttaaatatattttctaaaattctatatttaagaatcagaaagttactggagattaggaagggtagtgtgtggcagggtgaggggaaggttatgaggcgataacacgacaaggtgactgtagtcaataataacttaattgtacattgaaaaataactaaaacagtataattagattgattgtatcacagaggataaatgcttgagtggatggatattctattttccatggtacgattatcactcattgcatgcttgtatcaaaacatctcatgtaccccatacatatacccatctattatgtacctacaaaactaaaaaaaattataaaagcaaaaaacaaaaacgaaaaaagcccttgactttcagaagcctctgactaacctttgcagtattgtgcctctgttctacacataattaactgtgttgaaactgagaattaaagctgaaatgtaatttcacaaacttaataaatggcctttataactgataatgacatcttcgttgccttgagacaacaaccaaggacttgatttccttgagataaggactttggttgaatcagtatgtctttaagtatttaatcttgtctcataataattgtgttacctcaacaaagattgtactcataccttgacaaatgaaaccataccagtaaattaattctatttaagtcagagtagaatcaactagcagttacccactgactaatatcagagcccagtgtgttacatgaaactaaattggaaaccgacctctggaactcaatgttttgttttgacctaaatctactctgcagtgtgaggtaaatacaattgtttaaagattcttaagctgtcgatgttgaatttgcttattttgtatttaattaaaaaggtgcatacagatatgtatgtagtgtggtttggcaatagttaaaattgggagcaggaaaggaaaattttagaaatcttggtttccaggcaaccaaacacacaatatcatatctgtgtaccacttgcttcatgttaagatgccctaaatgtaaataattgatggagcagagactaaaagaaccattatagtcagctgaattccaaggtccttgacctgagctcattaagctcaggttagagaatagggtggctgaattttcttagaaaaagagcccagataatatctggcatgtacatagatcttgaaaattagctggacttaagtaggcatttagttttcaagctttagtttagtgaatgtggggatcctgatctgtaatccttcaggaggcaaatgagctgcaacagagccatggtttctctccctctttctgggagccacccacccccttcacccaatacagaggacctaaggagtgattgattttataaaagatacagagtaacacactctgtatattcatcagaccgtgtaaataactaacttctagacctctcagatataaatacatctctttttacttcagaagctttccatgggtgatttcatccatgttcgtggttttaactcttgtgcttatatgaatgacttccaaatgcatacctccagcctcattctgtttcagaattagattttcgtacattcataggcccaactcaaaatgtctaaagtgaattaatctcttagctgtcttctcctccagagaagactactgcctgctctgctctgtcatgtcttgggtagtatttggcagtatcactcggctctttgatttcttgccctgttacccttacacgtggctgtttgccatggtctgtcaattctgcttcaatagtcctccctaataaatcttccctctcttctactcttagagtctctcaccttgactttttttttgtttgtttgtttgtttttgagacagtctcactttgtcacccaggctggaatgcagtggtgcgattatggctcactgcagccttgacctcctgggctcaagcaatcctcccacttcaaccttccaagtagctgggactacaggcacgcaccaccatgcctagtttttaattttttttttttttttatagaggcggggtttcatcatgttgccgaggctggtcccgaatgcaggctcaagcgatctgcctgcctcccaaagtgctgggattataggcatgagccaccacgcctggccttcactttgatcttgactcatctccctgtccctgatctttgcctgctcaagtccatcttctatacgcaaccatgattttctttagaaacacatttctgaccacattgttcccctttaaacacttggatgatgctttgtcaccagcaggataaagtctgagctctttgacttgacctactagccagccatgatctccttctccatcttgatgtcttgccattccccaaacataactttagaatacagcaattcagaactgcttttagttccctgaaaccaccataatgcttcacacaccctcacctgtgattgtgctgttctttcttactcacccttgagtctttattaattcttttgctttcaagactttgctctggcttttctagggtgcctcccttgatttcttttgctcacccatctgctgccatcccagattatgtcaattgactctaccctaaggtctccatagggcatcctgtgtctatctctatgatagatccttgcccactttattgaattcatctttaagctccttgaatggagggtctgtgttttatttctctttgtttccctctttccttgtgtggctcttgaaatcattatgaattgatctgagcacttccttatggaggcatgcagaattaacagcataattgtggcaagaaatgtctttgccttttctttttaatgcaaatgagagttagtaacatgttctttgtatttatcttgggtatccattgctgactaccagatcaccagatcaccccaaaactaagcagcttaaaacaataaacattttgtgtgtatgtgtgtgattttatttatttatttatttttttaagacggagtctctctctgttgcccaggctggagtgcagtggtgtgatctcagctcactgaaacctccgcctcacgagttcaagcgattcttttgcctgaacctccttagtagctgggactacaggtgtggcccaccatgcctggctaatttttgtttttttagtagggacagggtttcaccatatcgcccaggctgtgtcaaattcctgacctcaaacaatctgcccaccttggcctcccaaagtgctgggattacaggtgtgagcctgcccaaagcaatgaacatgttatttgttcatgattttgttggaaaatcatgggctcatgattgagttgggctcagctggatgtttcttctttttgtctttttaggggtcactcatgggtcctcattcatctggtcgcccagctgaaggtagaaggtctagaatgaccttactcacatctctggcaatttgttgctggctgtcagctctgcctccctctctcatccttaaggggactggccagggtttctttccatggcagtctcagagcagcaagagactaagggtgaaagttgcaaggtctttagaggcccaggcccgggaagtgtacagtggcagttcattaacattgtcttggccagtgcaagtgaccagaccagcccagattcaagggatggggagtagacttcatctagataggaggagccaccaggttacattgccaaggggtgtgcatacagggatgggaggaatgtgattgtttgttgctgtcagcacagtataccttactagaactgaattgacgtctctactttttgagcattttttgtacattgttgtggtatttctttgtggtagtcatctcacatgctttaaacttcgtatgtcttatttccttccttagtaggtcacattgggagctcatcttccccttcacttaggagacagtgcaataaacatttgtatctctcatagcacataccagatttttaaaatttggcgggttttaattcaggacttaaggggtgaattatcttattaaataaataactcaagtatacagggaagtgaaagacagtcatttacctaatgctctgaacatctttcttgagataaagtagtgctgtgaactgataaagttcacataaagctaaagaaattcctttatgtattaatattacaggcatttatgtaatatcagtatctgtctgaaaagaatgcattgattacaaaactctttaagttgtacagaagttatttttccctagaacttcaaaagtctttgctctgcaagggaggggagagtaaaaaaggtgccttaaggatgtagacatgctgtatccagcactgttatttgttgtcagaaatatactgataaacatgctaatgccaggccgggtgcagtggctcacgcctgtaatctcagcactctgagaggccgaggcgggaggatcacgaggtcaggagattgagaccatcctggctcacatggtgaaaccctgtgtctactaaaaatacaaaaattagctgggtgtggtggcgggtgcctgtaatcccagctactggggaggctgaggcaggagaatcacgtgaacccgggaggtggaggttgcagtgagctgagatcgcgccactgcactccagcctgggcgacagagcgagactccgtctcaaaaaaataaaaaaataaaaaaaatgctaatgcctttcttgcatattggatttggtctactgatgactttttttcctggagttcttagaagctgtgtgtaaccaaagggggctggagagtgagagaaagcaaaagatttggctagaagaagggagagaaatacattctggtttaggggctatgggtagacctaagtttttaccctgcattgtatctgaaaaacataaatccctgctgttaatcttaatatctaatcttagtctttagtgtctcttccttttcttttttccttcccttctcctcaacttttctacaaaaatatttatgcatctaaaatgggaagaattatttttgctcagactgtaaaaagtatatcacaggctgggcacggtggctcacgcatgtaatcccagcactttgggaggccaaggtgggtagatcatatgaggttaggagttcaagaccagcctagccaacagggtgaaaccctgtctctactgaaaatactaaaattagctgggcatggtagtgggcacctgtaatcccagctactctggaggctgaggcaggagaatcacttgaacccaggagttggaggttgcaatgagctgagattgcaccactgcactccagcctgggtgacagagcaagactctgtctcaaacaaagaaacaaacaaaaagtatatcacaaatattgttacatattcttctttaatacataattatgcatccctgaaagtggcattttgctacatagcctcaatatagttttcacaactcagttttgccctcttaaaacaagattgctggcaccatcttcactgatgaaagacttgtgtctaagaaggtctgagtcataacagatgcttctccatcttgctttctcatctttctctagtttctttttgtcctttttatctttttatattatttttctcttctccataatactgctttctaccctcttattggggtgtctgctctatgtgccaaatatgccataaattccttcatcttggcttccctcgggagagactaagagaagacactgcagaactaggtctgctcagaggagatcatggcctgccctcatgggaccatttggcgatgtcttcctccatcacgcctgcagtcactcctgtggacttagaggttgagcaagattttctgtcctgagagaacccacgttcatattctgacttggtctctgtgaagatttgaaaaacatttttttttcctgaaaagatacagctgtacccattgaagcaaacgtggaactctgttcattattttctcctttttattcattctcatgttcacattcactgtataatcttgtttgtggcttatctttgacttttatacatactacatagattggacaattttcctggtgatacggtactctcacattgtgaagggatggctcaatattaattttagagtggatgctttgaaatattatcaatgacaagattttagcattttataaccttcaaccaagcacttatttgggggtctgcaacattccccttatgcattaaatgaatgaatgattattttatacaactcacaccaaatctctttttttaaactcatgttttcacttttattttttgattacttgtaaaagaatgctattcttgatctactgttacctactgtttaaattgtatggtatatatatatatatatatttatactttaagttttagggtacatgtgcacaacgtgcaggtttgttacatatgtatacatgtgccatgttggtgtgctgcacccattaactcgtcatttgcattaggtatatctcctaatgctatccctcctacctccccccaccccacaacaggcccccgtgtgtgatgttccccttcctgtgtccaagtgttctcattgttcaattcccacctttgagtgagaaaatgcggtgtttggtttttgtccttgcgatagtttgctgagaatgatggtttccagcttcatccatgtccctacaaaggacatgaactcatcattttttatggctgcatagtattccatggtgtgtacgtgccacattttcttaatccagtctatcattattggacatttgggttggttccaagtctttgctattgtgaatagtgccgcagtaaacatatgtgtatgtgtgcatgtgtctttatagcagcatgatttatagtcctttgggtatatacccagtaatgggattgctgggtcaaatggtatttctagttctagatccctgaggaatcgccacactgacttccacaatggttgaactagtttacagtcccaccaacagtgtaaaagcgttcctatttctccacatcctctccagcacctgttgtttcctgactttttaatgatcgccattgtaactggtatgagatggtatctcattgtggttttgatttgcatttctctgatggtcagtgatgatgagcattttttcatgtgttttttggctgcataaatgtcttcttttgagaagtgtctgttcatatccttcgcccactttttgatggggttgtttttttcttgtaaatttgcttgagttcattgtagattgtggatattagccctttgtcagatgagtagattgcaaaaatgttctcccattctgtaggttgcctgttcactctgatggtattttcttttgctgtgcagaagctctttagtttaattagatcccatttgtcaattttgtcttttgttgccattgcttttggtgttttagacatgaagtccttgcccatgcccatgtcctgaatggtaaagcctgggttttcttctagggtttttatggttttaggtctaacatttaagtctttaatccatcttgaattgatttttgtataaggtgtaaggaagggatctagtttcggctttctccatatggctagccagttttcccagcaccatttattaaatagggaatcctttccccatttcttgtttttgtcagatttgtcaaagatcagactgttgtagatgtgtgatattatttctgaggcctctgttctgttccattggtctatatctctattttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatccataaattaccttgggcagtatggctattttcatgatattgattcttcctatccatgagcatggaatgttcttccatttgtttgtttcctcttttatttcgttgagcactggtttgtagttctccttgaagaggtccttcacatcccttgtaagttggattcctaggtattttattctctttgaagcaactttgaatgggagttcactcatgatttggctgtttgtctgtttttgctgtataagaatgcttgtgatttttgcacattgattttgtatcctgagactttgctgaacttgcttatcagcttaaggagattttgggctgaggcgatggggttttctagatatacaatcatgtcatctgcaaacagggacaatttgacttcctcttttcctaattgaataccctttatttctttctcctgcctgattgccctggccagaactttcaacactatgttgaataggagtggtgagagagggcatccttgtcttgtgcgagttttcaaagggaatgcttccaggttttgcccattcagtatgatattggctgtgggtttgtgataaatagctcttattattttgagatatgtcccatcaatacctaatttattgagagtttttagcatgaagggctgttgaattttgtcaaaggccttttctgcatctcttgagataatcatgtggtttttgtctttggttctgtttatatgctggattacgtttattgatttgcatatgttgaaccagccttgcatccctgggatgaagcccacttgatcgtggtggataagctttttgatgtgctgctggattcggtttgccagtattttattgaggatttttgcatcgatgttcatcagggatattggtctaaaattctctttttttgttgtgtctctgcccggctttggtatcaggatgatgctggcctcataaaatgagttagggaggattccctctttttctattgattcgaatagtttcagatggaatggtaccagctcctctttgtacctctggtagaattcggctgtgaatctgtctggtcctgggatttttttggttggcaagctattaattattgcctcaatttcagagcctgctattagtctgttcagggattcaacttcttcctggtttagtcttgggagggtgtatgtgtccaggaatttattcatttcttctagattttctagtttatttgtgtagaggtgtttatagtattctctgatggtagtttgtatttctgtgggattggtggtgatatcccctttatcattttttattgcgtctatttgattcttctctcttttcttctttattagtcttcctggtggtctatcaattttgttgatcttttcaaaaaaccagctcctggattcattgattttttgaagggttttttgtgtctctatctccttcagttcttctctgatcttagttatttcttgccttctgctagcttttgagtgtgtttgctgttgcttctctagttcttttaattgtgatgttagggtgtgaattttagatctttcctgctttctcttgtgggcatttagtgctataaatttccctgtacacactgctttaaatgtgtcccagagattctggtatgttgtgtctttgttctcgttggtttgaaagaacatctttatttctgccttcatttcgttatgtacccagtagtcattcaggagcaggttgttcagtttccgtgtagttgagcagttttgagtgagtttcttaatcctgagttctagtttgattttactgtggtctgagagacagtttgttgtaatttctgttcttttacatttgctgaggagagctttacttccaactatgtggtcaattttggaataagtacagaactcacaccaaatcttttaactacccatgcttctagaagctttcaaggaatcaaaaaggggctatattaaaatgggaaaaaataggaagaagcttagaaataattttaggaaaggtattacgtttaagcatagaactaagtaggaagaggtaagtggcaaaacaacaataacaacaacaaaagagtctaatcagtatgtggtggaagactactacagtgagtagtactttacagtgttaccaattaatgcttgtccttttttgttctctttttctttgttgtcattgtattttccgctgtctcttgatttatcagcaaaaatacaggcacatttctaaatttgtgttagggtttcctgtagcatggtcatatgtcaccagtgagtcctctgactctgaattaagaaaacatgggcttaatatgcagaacactgaaactggaccccttccttacaccttatacaaaagttaactcaagatgggttaaagacttaaatgtaaaaccccaaatcatgaaaaacctagaagaaaacctaggcagtgccattcaagacataggcatgggaaaagacttcatgacaaaaatgccaaaagcagttgcaacaaaagtcaaaattggcaaatggaggatctcattaaactaaagagctcttgcacagcaaaagaaactacagtcagagtgaataggcaaccaaagaataggagaaaatttttgtaatctacccatctgccaaaggtataatatccagaatttacaagaaatttaaacaaatttacaagaaaaaaccccatcaaaaagtaggcaaaggatatgaacagacacttctcaaaagaagacatgtggccaacaaacatatgaaaaaaagctcaacatcactgaaaaaaagctgaacatcagtgatcattagagaaatgcaaatcaaaactgcaatgagataccatctcacgccagtcagaatggcgattattaaaaagtcaagaaacaatagatgtgagcctgtggagaaatgggaacactttcacactgttggtgggaatgtaaattagttcaaccattttggaagacagtgtggcgattcctcaaggatctacaaccagaactaccgtttgacccagcaatcccattactagatatatacccaaaggattataaatcattctaccctaaagacacatgcatgcatatgttttttgcgtattattttcaatagcaaagtcatggaaccaacccaaatgcccatcagtggtagactggataaagcaaatgtggtacatgtacaccatggaatactatgcagctatgtgaaggaatgagatcagatcctttgcaggggcatggatgaagccagaagccatcatcctcagcaaactcacacaggaacagaaaatcaaacactacgtgttctcgtaagtgcgagttgaacatagagaacacctggacacagggaggggaaccaacatgcaccagggcctgttgtggagggaggcaaggggagggaacttagaggatgggtcaataggtgcagcagaccaccatggtacacatatacctatgtaacaaacctgcatattctgcgtatgtatcctggaagttaaagcaaaattaaaaaaaaaaaaaaggaaaacatgggcttaaataggacacaagatctattcctcctttgaaaaacccattaagtttggataaattctaagaggtagcattttaactagcatcctaagcacttcctcacatgctcatagtttgcaagttaacatgatgtatgtgtatttgtgtatttcaaactccggaagcttttgtattattgaaaccaaaactgacaagaaaccttctgtgaacatgcttctgctggggtgtagaaagctcacagagtgttgccttcatgcttacaatagtaaaaaatccagatagtatacaaaatgacttttcttggtctcatcagagaatttcggtcatagagcaactaactagcctgaaatctaaggaaaaggtatgagtttccaagtagacaggacaagacatttgcttaactggagtaaatgctgatgctgatgtcacataagctagtaagaaaaagactgagttatgttttaagtactaaaagctgaatgtatctcagcatgggacctgcagctgcaaggagaattcagttacatgcaggcagttctctacagacctcaccttgtgctcatggggaacactgggggcaaggcaagtgatggaagaatggcattcttatggaggcaagcagcaaccactgcaagaaaggcatgaagccctctggatccttctctaaccctgtttctcttgtggaacaaaagccttaagctcctgggggaagggcggcaaactctaggctcaggggacaggtggagacctatttcagctaggggaaaggaacaggaaaattgctgtacctttggaggagggtcaaagaaatattatccactgggactattagagatctcctaacattgtgggaggaggtagatcacttggaacgtcctacccctatacccaggcaaacggatcctgcctaagactgaggttgaaccagaacaagagaatacttcctctctacatacaccaggatgctaagctcagagtaagaaatgctgatggtctactgctaggggagtggggagaacatggagaaagacctccctaaggtacaggcacaaagggaagacctaaagctgagggtgaagcagacattgagaaaaacactgtggcaaaccagccccaactgaagaacagggtgacgccaaggacacatgaaacctgtgatgtgcagaggctaataagcctaaattcagctctcaactcctgactcctgactaaattgaatcaactccccacacttaagattagcaggatgcgagacatgttcatttccaggcacaaatactacatacctcagtctctatagttctgcacaagatggctggcttttaaccaaaaattactgagatgcacaaaaagtgaggtaaaacaacacacataaaagaaacaaagcaatcaatagaaccagactcagatatgaaccagatgttagaactatcagagaattttaaataactatgatcaatatgttaaaggttctaagtgggaaaagtgggtaatatgcatgtacagatggggaatttcagtagaaaaggtgagattacaaaaaagagtgaaatgaaaatgctagaaatgaaaaacttagtaacagagatgaacgatgcttttgatacctccttggtagaattgatgcagttaaagaaataatcagtatatttgaagattggtcagaagagatttatgggaaatctgaaacacaaagaaaaaagagggtgtgacaaaagacccaaaaatgttagagcccctaagagctttagtacaatatcaaaagttccagtgtatatgtaattagaatcccagaatgagaagtgagtcaatagtgtggtataaaatagtgcaatacaaaaaatatttgaagagatgatagtacagttttcccaaactaatgacacataccacataagaaatccaataagctcactaagcagaatgaataccctgcaacacacatacagtcagacatattgtattcacactgagaaaaaacaaaatttcaaagtcaaccagagaaaaagacacattatatacagaagaagaaagatgagtcaaagcagacttctcatcagaattaggtaaggttacagtgttaacagaataaactgtcaacccagattcctatgtccttcaaaatatccttcaaaatgaaagaaagcaaatataagtgatcttattactcttcatttcactgccaacatttaaaaatcaatggaaatgaagataaggctctggtctcaaccacattgatctgaactgacaactgcgataaataagcagtgtgtcttgatttatgaatttgtctgtgatgtttgagttttgtttaatcctaatacatggtatagctttggtggtttttaagggtggtgtacttggtacctatatcagccaaggttttctagagaaacagaaccagtggaatggacaggtgtgtgtgtgtttatgtctgtgggtatatgtatatttatgagtggatggaatcaagagatttatttcaaggaattggatcctgtgatcttgggaactgacaagtgcaaaattcataggacatgtttgcatgaaaacccctcaggcaggaattggtgctgcattcttgaggcagtttctacttcttcagggaaaatattaattcttgcttttgaggactttcggttgattggatgaggtccccccacattactgacaataatcttcttaaagttgctgaatgtagattttaagcatatctacaaaataccttcacaacagtacctagattaatgcttaattgaataactggatactattgcctagccaggttgacatataaaactaaccatcacaggatccattattagaattgtgggaagacctaggttttcttctagggtttttatggttttaggtctaacgtttaagtctttaatccatcttgaattgatttttgtataaggtgtgaggaagggatccagtttcagctttctacatatggctagccagttttcccagcaccatttattaaacagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagttcaggacgtaggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcattatccacaatagcaaagacttggaaccaacccaaatgtccaacaatgatagactggattgagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacagtgaaatcacatggacacaggaaggggaatatcacactctggggactgttgtggggtggggggaggggggagggttagcactgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaattgtgggaagatcgacagtggaatctttgcaaaacaatggaattgcaactgtgaactacattttgattgtttgtatttttagcggagtgataagaatgatcccagactgaagatgcacattaaataagctggtaatagtaagaatttaagatgtaaactagcattaaaaaattctaagcctttaaatatgctctctcacattaagtgtatgctttgatttttcttataatcatttcatcatctagaaccatttaaattttgagtttttttcaatccaatttcacttaagcagttacgttttcattgaaatcattggattagcagaattggtacaaggtattgaaagtttgcagttcactgtgacttcatctgcaagtgaacaagtattattttgggattttgtgagaacaggagagccttaaaagtcattgaagtacagtattgttgcagatattggaggaggagtatgctgaatggtaacactgagactgtttttgactctgtaacagggtacataggttcaatacaaacttttttaagtgcagcaaaaaaaatttcaattgtaaatacaattgtcaacatacagcatagtggagttaaaaaagcatgttcttcatagtatagtcctgaagttctaatgataaaaatcagaatgttaaaaacaaactataacatacatatagttgaactgaaaatcatgttccctatagaaaataatggtatttctttgtcctggtgataaagtttaagtcgaggatttgtctttgccccccgaaaacattattttgctgactctgataatcatacttgttaaaccagagagaaacaatgatggatgtgaatctcaaggcagtatggggaaagggtctcaaagaccacttattatctgaggcatacaatttagaaagtaattatcatatttgttaccatggcgaggattgctgcctacagccagttctgttatgtaacaaaattcatttaagagatgcctgacagtatgtttctgtaatgctctagtatttaaaaagtaagggcaaagattgtgtctcatagttcagtatcatagtagctctttttctagtatacaagttagccttctgctccctgctttcacctaagttcatcttttccagtctctgtctacttataaaattaaaatacctctgaacttgttttgaatttgttatgctacttagcaatgggtgcctcatgtcgaggtgtaccaagattatctggttctaaccattgagttcaattttatgggagactcagcatcacaatgtggcagcctttttggccaaattttcaaccactggaattgccttttggggagttattttctgtttacgtagtattttctatagcttgctttgatcaacggtgaaaaaaaatgtagtttgggatggaaaatgggtgaaaggagaatattagatataagagaagtaacgtactgtttaacaggtgaagctctggatacattatttataagcaggagaagacaaacgaaaataagacccagtgtgaaaaaaataacagagatcgtgagcacacctagtgctcagctctggtttccaataccatccttcagtaaaaggaaccagggcacctcggagaaatggctgattctagtatgggggcaggaagcatgcaagatgagcctggagcattttgtagtgcgagagaggaaaggggtgctaaagaataaaaactccagagaacatgctgatgggagtatgtcaaagggatacagaagccagctcaaagagctcctaatggccaaagacagaaaaatttgaacagaaaaataacatagtattggatcataacctgacgtatcaaataaatatctatgagttcatactgatggaagtaaatgatgggataaattaataaatgggggagaagacacatacttcctgtgcagaggaattgcaaattatgcactctgttctagcatacctgcccactctttaagtgtgacatgctcatagagacttcctcttgaagcatacagaatggagagggggtgcagtgggagagtcactttacagtggagaaacccacacacactaccccagccaggtgatcaaggtgtacgtcatcaacagtgataaatcatgttgatagtgtgttcccttaatatgatgtgatgaaaatggcacttcacctctgtggtcttcctcccttaaactcccacctctagtctcatcatgagaaagaaacaccagaaaacccccaacagagggtcatcctataatatacctgatcagtactcctcaaaactttcagggtcatcaaaaacaaagaaaagtctgagaaactgtcaaaccaagaggagtctaatgagatacgaaaactaaatatgtggcaccctgaatgagttcctgtaacagaaaaaaatggccactaggtaataaagaagcaaatctgaataaactgtgcactttagttcataataatatatcaatattgactcgtcaattgtaacaaatatgccatattaatgtacagtgctaataagaggggacatacacattttaaagcccagtgcagatgacccctccttttgagtgtcctcaccatagcctacaaggccccatgtgatttggccctttcatctctctttaattgcatgtcttagcccctcctccttagcactgtccctgctactctggcctggttgctgtcccttgaatatgcaaggttattcctgcctttcatttgccatttcctctgcctgaatcttcatgtatatcgtttatttcatttaggtctttgggcaaataccacctcattagaaaagcctcttctgaccttcctgattataatagtatctcctgcagtctataaccacaaaacttgtgttctttgtcttcataatactcagttactgaaattatttatttattttaacttcttatcccactagaattaggcacatgaattcggggactttgttaattctgtttgttcctctgtctgtagcaactagaacaactccaggcaagtggtaggtagcactgagtaaatatcatgtgaatgaaagaattctcaaattgtgccccttagtttcctctgaatgcttaaccgcacattctgtgtgactcttggaaagattgttctctgctgtgtgttatctttttgtgcctgtatgagactttgtttcccttctggattgccaaaactgcagcagttgtatacctctgatttatgtctacacccccacaatatctagctaggtgcctggcaaaaagaagtgactgctcagtagcgtttatgggataaacatgtgtttctgctttggacctgtccttttactgcattcagcattcccccgggcgaggcctcaggcactgcataaaaagttgaatatgtctgactttgtttttatggactcctccaagctttatctccctatccactatctgaacttcgtgctgcagctcccttgattttgacctctttggctttggtcttggtttcccccacatcacatgtcctctttagacttgacaacatcactcccatttttaaaaacaaggccctgacctagacatcccataggatctcgcctcattctgctcaaaaattatgttgatgaggcccaccaagctcctgtggccagctaagcccaagacaggtgttaggacctgtgagtggaagcccagtggtagaaatgtgcactgtggcttgcatgtggcaatctacctaatgggagaattactctctctccattctttcctagcccgtcacatttattaagaataacatgaaaagtgccgggtactaggggcacctatgtgaataaaatacaaaggctgaagaactcatagtggaaacacatggtctccatatcatgagaatcattatttatcctctagaaggccagggaatttgttcatgaagcttaacccagagtcctcttgtctacttagaagatcttgccagaatgggttacagacatagtgattagctggaagtaaacagacttctgcaacctagccttcaaaaaccttactaccgaagtgtggcaaatattatacttttaaataatttcttccagtggagaaaagggcatgctttgtgaaacagagacttctgaaacctcttattaccaataagaaccttagcatgctagggtaaagttaatgatgaattggtctcggcaggtgccacaggctagattttctgccatttagtttttgtgtttctcacttgccaaggggtgactgagtgtttttcattgtttatttcctgttccagttgttgctttatagctttttccagttttcttctttctctttgagacataaattggtcttttaattcctactaaccctaattctacttttattttatctatcagaaaatattgccacagttatcaataaaaacattggaaagatgtgttttgtgtgtctcttttaaatttgttggacagataatagaaaattagatagtaatatattgcttagaaaaacgtacttaggacatttcttgctaaccttaattttttgggcggcctacaaacaaatccctatctaattgatttttgtcagggtttataacgttctaagcctgatcttcagttgatttgcgtatgactcccacatgttgaaaccaaaacactcagtttattgaacatatgaaataagactggatttttaaaaatctgcaaattgagttgctttcttctagctctcaaaaaattgatgggatttgcagtcagagaagattttacactaacatagttggtattttattaaaagctaatttgtactattcactaacaatatagattatagatttccttatttttcctggaactttgctctttatcttgtcagtatttgatttggactttaaaattagtggttttgtacacttttgacagttattacaaagtactatatattccacataaactgcctgatgttctttgagagtacatactgaaaagtttttttcagccaacagaagaaatggaagacgaggacctaatttgacaatatctataaaaattacaaatgcaatctatttctcagaattcatttctgaagtattctttcatatgtgtggcatgacctgtgtgcacatttattaaatacaacatttttgaaatcgtaaagtgttggaaagagaccaaacaagtatatattaatagaagatagactaagggatggtacatctatatagtggaatatgcagatgttaaaaaagtagagggtgcttgctatgtatggatatgggggacagcaaggtgcagaatatgcttatctgagcttttgagtaagaaggagtggtatacaatggtattcttatttgcttttttttttttgcctgaagaaaccctataaagatatttaagaaactattacatgtgcttgcttgtaaatattacttggagaagccaggtgtggtgactcacacctgtaatttcagcacttttgagaggccaaggtgggtggatcatttgaggtcaagagttcgagaccagcctggccaatatggtaaaaccccatctctactaaaaatacaaaaattagctgggtctggtggtgcatgcctgtagtcccagctactgggaggctgaggcaggagaatagcttaaagacaagagacggaggttacagtgagctgagattgtgccaccgacctctagcctgggcaacagaggagactccatctcaaaaaaaaaaattacttggagaaagtagggcagctaggaggggcagaggtggataagaaatatttttcactgtatactttttattactgtattagttggttttcacactgctgataaagacatgcttgaaactaggaacaaagagaggtttaattggacttacggttccacttggctggggaggccccagaatcatggtgggaggtaaaaggcacttctaacatggtggtggcaagagaaaaatgaggaagaagcaaaagtggaaacccctgataaacccatcagatctcatgagacttattcactatcatgagaatagcaaggggagagaccagctattcagttacctccccctgggtccctcccacaacacatgggaattctgagagataaattcaagttgagatttggatggggacacagccaaaccatatcaaatagtgttttggttttttagccatgccactgtattgtccattgaaaataaaactttttttaagtattggaaacttgcatgtatactaatattgatagtgggttttggaaatttactgagtgtctgtttttgagcagaaaacgttatgtttggacacatggatcagggtcctccttttgagacttttggttgctggtgattttttctccagtggcaagtacttgagcatttcttctgcaacagaaaccctaccatttaggaggcttaatggatgctcttttggttgcattagatggatgaagaaacaaagatgaactaaatatccaacttctactttctaggagttgccattacttctgtgtaaaatagggatagaaagtttttgttttattttgtttacttctgtgtaaaatagggatagaatgtttttgttttattttgtttgcagaaatgcgaatggtgtaaagcttcttcaaatatggacacacacatacacacacacatataaaaagaaaggctgcctttattctgccattttatacaagaatctttctacacataaaactggacagcaaaattgctacctgaaaatttgtaattcttttcctagatgatatttttcaagaaccaaagttgctaagaactccagttctctgctggatgaatcaagcgagcagtgaacgaaatgcctggcaaggcttttgatgggagaggagtctcattttgctttcaggatagacactgaacatcagtacatttgtaatcgtggtaaccacccctgtcttggttagagctttcatggtaataatttaatttctattgataaaagaatttattactgaatgtatagtggagaagaggaagcttattaatgatctgaatttatgtgaagtgtacgctatattttattttcctactttcttccatgcctaataatatttttcaagatttttagtggcagtgcttctctcgtttttctagttggaaactttcatattattcagaaagaaaaaatcctggtaaggaaattggagaccaattttctgtattagtctgttcttatactgctataaagaagtacctgagactggtaatttatgaagaaaagaggcttaattgactcacagttccacaggctgtccaggaagcttgtcttggggggccttaggaaacttaaaaccatggcagaaggtgaaccggaagcaagcacatcttcacaatggcggagcaggagagagagaaagagagagcaaatcttggaatatactaagagtctggtgttgattgcctattttttaatgctaataagtaagtgttctttttctctgggggatttcttaactgttctattgtaaaagcaactactataattgccttttataatacccagatcgctggatttgctatatactagacttgatgtacctgaagctgctaacaggattgcctgtcatttagctttcagaattcaatttataaaatgtcattatttttccccttccactgcaatactagagctgaagacagacagggaaaagcaagcaaatatttgagagtgtgaatggtataagttgagggtatgaatgttggaaatgaacatattcacctctaaataaagtgagagaaaccgctattctttctaaattttccatgtgccagtaaaatgggaatggtgatttccttaaggtattgctctggagaatttaaataattgagttaaatgtcaaacttcacatttagagagcttactaaaaccttcacaagtgggggcttacagactagagttttatttttatttttattttttctgtagggaatggagtaggggaggcagtggcacacttaggtgataccttgcacagcagtcacaatgttgaaatttgaagaaatctagtgaaaattataaaattttcactagacatgaataaatcattatgaaagaatataaaaatagccagagatcactagaggggaaagaggcactgcaaaagttactggagggaatacaagagaagaaaataattagaaaacagtcagtaagaaatgtcatcccattctgtcccctggctgctttttgtggctttgttcagtgggtgaaaattctggagtgtttattggtgtcttgtagcataagatgaaatatcttatcaagatattttcattttctcaaagtgaaatgcgatccctttaacttcttaggatgacaggtacatgtggaagcatcagagaggaacttgggatcccacgagctagcctctgcttcatacacagtggagtagatgcctgaggttgtcagcaaatattgaagatttttatttccagggggttagaaacttcacgtagcttctctgctctgcacacataaggagtaagtggattattttccctgagtcagtaaggttttcggtgtcacataatctcaggggaacaaatgcaattgcttagatctcaatatactcctcagatggcaactttgaggaggtaaccaggaggtatctgcactccctctgtgctcgcctggggccttctgactttctctgtaaaaagccctttctgtattgatgctcccgggtggtagtgggttggatggccattacataatcacaacctctttttttcagtcagggtagctattatgcagagagctaggagtggattacttcttggcaggaataagcacagaaaaatctatccagatttttttaaaaatggaaacattgtgaaaaaaatcttgatgtctctgaaattggaggatggtattttatctgaggaacatgggtagggaatgttggggtcatttcttagctctgaccttagtaagtcatagaggcctttttatactgatgttgcatttttaaaaggcatcttgacatgatgggagaaaaacagcagaccaaaagaaggcagacctgatagttctagttcaggctgtgttgttgtctgagttgtcctgcaagctgatacaaatcacaacttccccgagcctctcttttctcatcccttcagtgaaggccctctgtaatacccaagtcctttccagttctgaagtctgttcaaagtgggggcagctggaggactcagggaggtccacactaaagaggactttttttttccttttttaaagagaacatttttaaaatctagctttataactcaaggatattttaaatacagataactattacatttgtattttgtaatgaatatttcagatttatgtttgtgccttgaagctaattgactgtgaagaaaacggttttataaacaaagccaaagagaaagtattcctggatgtattacagcagacaaataatcactttactactatggtatattagtccattctcacactgctatgaagaaatacctgagatggagtaatttatgaacagaagaggtttaattgactcacagttccacatggctggggaggtctcaggaaacttacaggcctggcaaaaggtgaaggggaagaaaggcaccttcttcacagggcggtaggaaggagaagtgccgagcaaagggggaaaagccccttaaaaaaccatcagatctcatgaaaactcactcactataatgaaaacagcatgggggaactgcccacatgattccattacctcctactgggtccctcccgtgacacatggggattatgggaactacaattgaagatgagatttgggtggggacacagccaaaccatatcacatagctttggattatcccttccttttttcgatttttcatagcccattttttgtggatgctaaaaccaaaattgctctccacatgcatagcatatccataaccctcttaccttccatcactttctgggacttgttcttattttagagtgacttttaaagactgaacatgcagaagcctcattgcctcttagaaataaaggatgcccttctgggaggatgtactaagtccagtgttggaaccttgatactgtcctgggctgacatttcctctttaagaatcagctccctcacaccacagggtattagagaggccacatgggctgtgaaaaccgggcactcagggctggatagattgattgctaacaaacatatagtctgctttcttcagaattagtagctggctttgcaccttcaacttgagcatgagctcaaatgcatttcttttttttttttttaaggcggagtctcactttttcacccaggctggagtgcagtgacatgatctcggctcactgcaaactccgcctcccgggttcaagggattcttctgcctcagccacctgagtagttgggattacaggtgcacgccaccatgcctggctaatttttgtatttttagtagagacagggtttcaccatgctggtcaggctgatctccaactcctgacctcgtgatccgcccaccttggcctcccaaagtgctggtattacaggtgtgagccaccgtgcctggcctcaaatgcatttctatacaggtccagtcagagtagtggccagtcccactcatgtgttcaaaatataacctgaggaatgcaaagcaacatgtttagtcttttgtcttaataattcctctattagcaacttcattagacatccactagtacataactttgtcactgaaaccatatcattgccccccgaatagccttctagactcctaaccttggaatgcaccaaggaatatttaaactgtctcatagttttgcagaagcagaaaatgctaggattgtaaccctgatgatcagttctccctgatgacttggcctgtgttgcgcctactaaattcttcttgtcttctcctttgctctattgtcatgatattggttgaagggaattagtaaatcagactggcattgaatctctgggagctagaaaatgggctaagatttagatggcatattcactttctgcgttccgtttgtctgtgtgcttgttcttattcattcctaattttttcctgtagctagtcttttaggattttggtgtcaaccttacatataattgcctgggtacttcctgaggtgatcctgctgattttagaagaagtgaaagggaatattacatatggtagtagaaggagtcctggataggaagactttgcagtcctggcttcaagtccagatgcaggcagtcacttgtcactttggtcaacatcttaaggcctccaggcttcagttaccttgtctaaaacaaggcaccttctgcctctgaatttctgactcataaaatggtccaagccatattgtcagtgattagtgcttttaatatcagcttcatacagaggtagctttccaggctgctctaacttttggattacataacagagatagagtgcctgatggatggatatctcggtatctggcatgttatggtgagtgggagacagccagaagaaaatccttggaaagtatttttttaaatctgtgtgaatatgtttatattgggatggttctgaattctaggttttagataaactaagaaaattggatgtaatatgaagagataaaattccatgagctgaagttgatgagtaatatacaactaagagaggagaaaaggaaataagagattaaatgagatagagaaaaataatgctgggcaggccatttaataaattctctgactttgtttctgcttatgcagaagaggtggactaaattatacctgaactcctctgttctgtgaaggtcacaagtacagatgtttctaaccttgaagggaagtaaggtgtttattcatttttttcttttagcttttgttctttccctaaagatagagaatatgcaaattattaaaaaatcaaatacaggccaggcgcgatggctcatgcctgtaatcccagctctttgggaggccaaggcgggtggctcatgaagtcaggagactgagaccatcctggccaacatggtgaaaccccgtctctactaaaatacaaaaaactagccaggcatggtggtgcgtgcctgcagtctcagctacttgggaggctgaggcaggggaatcgcttgaacctcagaggcagaggttgcagtgagccgagatcatgccactgcgctccagctaggtgacagagtgagactctgtctcaaaaaaaaaaaaaaaaaaaaaaatcaaatacagaaagacatgggggaggaaaagccaaaattcggtgaaatattcctctctgtataaaaccatgattgagtcactgtcagtcatttggtaaagatactattagacttctgtgcaagcagcatgaactgttgcatagcattcaaggtgaaggaaacaagcagtcacagcttatatttttccaaactaaattaaatccaactgaaatgtatacttgccagactgacaggaatttcaatatcaccctccagggatattctctcctgtgcctagtttgtcagccccctaaccccaatccccacacgtgtgtacagtctagaaaggaatttcgctgaaatctgctttcaagcagagaagagccttaccatccaccaatctcctgctgccatccctggcctgccctcagccttactaccatgtggcaccactattgagcactagcccctcttggctgtccagtagtgcttgcttttgatactgtgaaatatcatgagcttgagctcccagcaaagaccacgtgcctctttgaacaagggcagctctattagttcagtgcatcatccattttctgtgttacataatatatcattgatggcatgtgccatcatttattcagccagtcatctcatggtgaatgcatagatcagcattatttataaagtgtcacgatgaacactttacatgtatctttggccacctatctgtgtttttagagctaacactcaggagttatgttgctgtatcaaaaggtttacctgttaagttttgacccctattgcaagtttgcattctggaatagatgcaccagtttacattcctgagagtgcattggagtgcacttccttgtcacgcttgctgatgatctctgtgcaagaagaaaatagttctggctaccacaatctcagaagaagaacatatggtcatacacatggcaacattatctctagagaacttgggttcctctggtattcaggatccatctgctagggatttattatttttcttgtttcccctctctaagttggtgttgaattggtcatgttgacccacttaaattcagaggatgagctattttatttatctcatgttctcttaccatatttgaaggaatggccagatttttctcagccttccaaccctttcactgtgttttgtcgtgtatgtaggatttacccagtagcaaaactgtaaattcagggtcttcaagctaaaacttcctaaagcaataccctaagactcagttgtgaactgaaaaatctgtgggactctagaggagcggaagatctgccccttggcctcttggttccctggattcctgtggttaggttagctggaactaattgctgaatatttgtttctttctgaagttaaccagttattttcttatcttttgttctttagccagattcatttgtctttctgactttttcatgatttttctgtattttacccttattctttagaaatgtttctctattctgtgcttgtgattgatttctaacgtctcctagaagttacaaagggcctgggttaaaatcctgtcagcaataacgccatatggtttcctagatgctctgcacactaaagaaaacacttattctgatattttaatcaaactctgaggacttaaacatatggtataaagaatgctagttaatagctttttgtgttattttaatggcaaaaactgcaattatgtttgcaccaacctaaatagaaccatatcagagtagcagaagaactcatctcaaagcctgtcttagagaggtggatggacctgtgcactgtgtttcatcatgctaatatggaatgtgcctgcctttgggcaactcatttcatagtgggccttaatcccaattggtaaaatgaactataacctttcatcattccatagattcagcttaaagtgggcccacagaagaagagagggtagagagtgaaaatggagtcacaaacccagcagagaatcctccctctggtttctgaataaacattgtatacacagaagaaatcagtacgcagaaccttcccagaggaatcagactgactacaaaagttgaaaatctcttgctacaaaatacttagaaatgatggataaaacaaaacaaaaatgttttcattcatagcaaaagtaaccagaaagtgttatcaggagcctaaaatgaagagggaaaccgaagacctgagctgcttcaggaggagtagtgaggggagaggtggtagcaggtagtgggtgagggtaggacttgagtatatcgtgtatcatttggggcctctttgtggggagagattggaagtgagtcacaagcatgagtatagaaattggggaacaggtagtaaaataattaccgtcattcgatgatatgattgtatacctagaaaactttatgggagcaattgaaacaacatgacgaacaataagcatgttcattttaacatacagaaatattagcatatgggaatagcctacatagatgcgaacagccaccaattagaagatatcgtggaaggaaagatctcatttgcagtagcattaaacaaagataaaattcctagctataaatgatataatttttctatttaaaaaataaatataacacatgtatgatttttcctagaaaaagacatgagaaacagaaaagcataccatgttctttttatgattgaaaagacttagcatcataaaggagtcagctttctctaagttaaactgtaaatgtaatgtgatacttatacaaaagataatatttttagtaagataagcctattataaatttatggaaaaatagtaaagtatagcccaggaaaatataaggaaggataataaggaaaactagccctaatatatatttaaaaacattaaaaaatctttgatatttaacatagtgtattactagttcatgaagaaacagattaatagtttaacataagatacaagtgtatttcaaatcactaaaacaaaatagataataaatggttttgggaaagatggatagtctgcttggaaaaaaggttggatccataattcacatcttggatccataattcacattggcaggaccaggaaaattttccagtggaataaataaagatttaaatgttaatgaatgaaatcataaaaatcacttgaagaaaccagtgaagaaatttgaaagtagttttgatctgatggaagcttttctaattatgatcccaaacccagaaactataaaggaaagaatcaggatatatgtaccgatataaagaggagaaatgttgcacagcaaaaaaaaacacccatgagctgggtcacgaaaaaatttaaacagatggaaaagcaaggagcaaaacatagtgaaccctcttgtttccatctcccaatttcaaccatttcaaactcatgactgaatttctttattttgaaggtaatccttgcttatcatatcattgcatctaaaacaacctgcatgtgaatataaaagagtccttttttccctcaacacattaaaatgccattattacaattaggaaattagtgattccctaatattcatgatgatttttaaggcataggaaaaatgagtcttccagtaagtaaataatgtccaccgaaatatctaaaaggcacaatctgtgatttcagaaatggtttttttaaagagattaatatactgcagaaatttctattaaactaaatttagacatgcttccccctttcagtgttccaaatgccctgaatctgttaatgccttgctgtcagctggttatgccacttgattatgcttttgttaatcctggatcttgctctgacctgaaagaagcccattactttatcctgccttaaaaatcgcttaggactgcgacagatgatggcccagcagtctctaataaatccctcaagatggggacacatcagacattgtcaggaccctcaagctcttgaaggaggattcaacagagatgaaatgtggaggtagtagtagcctgggtgttgccagaatttcccaccctttatcaaatgaaaatgagctgcattatttgggtagggaatgattttaaggattgtatggctcggggaaaaaaaacaataaaaatattttataaataactagcttgagtgaatctcttttcataaaaatatttaagatgcatgtgatgtcaataatgagtgatgttgaattttgatgtaataatcacaagtttgaatattaaaattagtgtgtttagaataacatggcagtttcatttccaaaagttgaggaggagggactcctccttaactcattctgtgaggtcagcatcatcctgataccaaaacctggcagagtcacaatgaaaaaagaaaaacatcagtccagtatccttgatgatgaacatagatgcaaaaatcctcaggaaaatactagcaaaccaaatccagtagcacatcaaaaagctaatccactatgatcaagtagtcgttatccctgggatgcaaggttggttcaacatatgcaaatcaatatatgtgattcgtcacatacacagaactaaagacaaaaaccacatgatcatctcaatagacgcagaaaaggcttttaatacaattcagcatccgttcatgttaaaaacccttgacaaactagacatcaaaggaatatacctcaaaataataagagccatttatgacaagcccacagccagcatcatactgaatgatgaaagcattcccctggaaaactggaagaagacaaggatgccctctttcaccactcctattctacatagtattggaagtcctagccagagcagtcagcaagaggtataaaaagcattcagataggcagagaggaagtcaaactatctgtctttgtagaccatatggttctatacctagaaaatcccatagtctctgccagaaagctccttgatctgataaataacttcagtgaaatttcaggatacaaaattaatgtacaaaaatcagtggcatttctgtacaccaacatcatccaagctgagagccaaaccaagaacacactcccattcacaatagccacaaaaagaataaaacaactaggaaaacagctaaccagggaggtgaaagatatctacaatgagaattacaaaacactgctcaaagaaatcggagataactcaaagaaatggaaaatattttatgctcacagataggaagaatcaatattgttaaaacagttatactctccaaagcaatttacagatttaatgccattcctatcaaattaccaatgacattcttcacagaattagaaaaaaaaaatattagaactcctatggaatcaaaaagcctgaatagacaaggctaagctaaaaagacaaagctggaggcatcgcattacctgacttcaaattatgctacaggctatggtaaccaaaacagtatggtactggtagaaaacagacacacataccaatggaacagaataaagagcctagaaataaagccacacacttaacaaccatctgatttttgataaagttgacaaaaagaagcaatgggggaaagtactccttattcagtaaatgttgctgggataactggctagccaatatgcagaagattgaaactataccccttccttacatcatctaaaaaattaacaccagatggattaaagacttaaatgtaaaacctaaaactgtaaaaatcctggaaggataacctaggacatgctgctgtggacataggacttggcaaagatttcatgacgaaaatgccaaaagtaattgcaacaaaaacaaaaattgacaaaatagagatcttctgcacagcaaacagacaatctacagaatgggagaaaatatttgcaaactatgcatgcaacaaaggtctaatatccagaatttataaggaacttaaatttacaaacaaaaaaaaaccccattaaaaaatgcacaaaagacataagcagacacttttcaaaagaaagcatacatgtggccaacaagcatataaaaacatgctcaacatcactgatcattagaaaaatgcagatcaaaatgacaatgagatactatctcacaccagtcagaatgactgttatcaaaaagtcagacaataacagatgttggcaagattgcagagaaaagagaatgcttatacactgctgctggaaatgtaaattagtttagccattgtggaaagcagtgtggcaatttcttaaagaacttcaaacggaattaccactcaacccagcaatcccatattgggtatattcctaaaggaatataaatcattctaccataaaggcacatgtatgcatatgttcagcacagcagtattcacagtagtaaagacatagaatcaacctaaatggacttgatatagaaaatatgtatcatatgtaccatattcaggccacttaaattgacgtagattcaacctaagtcgactggataaagaaaatgtggtttatatacaccacggagtactacgcagctgtgaaaaagaatgaaatcatgtcctttgcagcaacatgcatggagctggaggccgttattctgagtgaactaacacaggaacagaaaacaaaatacagtatgttcaggtataagtgggagctaaacattcagtacacatggacacaaagaagggaaccatagacattgggacctactcgagggtagagagtgggaggagggtgagggtcgtaaaactacctgttacgtactgtgcctatcacctgggtaacaaaatacaccaaatgctcatgacatgcaatttacccatgtaacaaacctgcatgtgtaccccatagtgctaaaataaaaatgaagaacttggtagttccatccaatttgttttaaaaaatgtttaataaaaaaaattttggagacatagggctaaaaactgatcaaagtaatatatagaaagtattagtcgatgatatcaaagtaatgtcgatatatctaatgtaagagatcaaagtaatatattctaaataaaacttagatttgagtcatttgagagtttaccccttttattctggagtggcaaagggacatgcccaaggccactaagtagggcctgaatcccatgtcatgatcccagtgcctttttcctttccatgtgatcatacttcttcctttcatacctttaagtcaattatcttccttccttagaatgtgtgttgaagttttgaataaagcataatagacatgaatgtatttttatgctttcctaatttaagctgtttttctccacattgcctgtgatgctagcacctcttcatgaactttcctgtcctctcagttgtaccaggcttttgattctgccagatgcagcgggagagcaattgctcttcctaaagaaatccatagctggctttattttcctcttatcttttcttgccatggtaaacttttatggtcatttatctctgtcataaaaatgaatgttgtacgtgtaatctttcctgtcttaaattatatgacatatactgttcatgtctttgttctagtttcttttatgtaaatgggcattttggtttatgaagaaagatttgtatcttatttttttcctcctggctttagacatcttataggtgagtcccttagagttttggatcttccttgcaggtccctctattcctgatatctaagactaatcttataccattaaaatgaataatgacccttaaaaaatggaatcctcttctcacgtaggagagtcaggagaggctagaaaaagttgctgtagggttttacctcaacaaaatagtaagcatttgaaaggcaattcaagcagtgtgctttggccagagaaatgtagcatttcagagtaaaagggatttttaggcaatttgtatatatatatgcacttgacatataaagcccttacactgctaaccagtggtcagccaatccttgcttaacccatgctgaagaccagaaaatcaggagagcagcctacagtaatggggggaacttgtgcttttaatcaggcaaatttctgtatcctgactgcaacacacacatgttgtgaccttgggcaagacccttgactctctgattctccatttccttgttgtggtctcattagagaattaaatgacatatcaactaccactattctcatctatcacatctgagctgaaatatcttccactggctctcatgtctttcttctaaatcttcctcttggggtcatacagaacacggttgtaatctcactagctatcttctaggtgtgtttaatttcaagtctcaactctctctagggctgtccattatcttttatgtgtttgaaagctgtgcaatcaaaggacaatggagacagaacattggtaagccaatgtcaccttctagcattctctgtgatctacctgtattttactgtgctgtactaactttgtgctatgcaactgtgctgtactaactttgtgctatgcaacagtcactttgtgaacttgtggtatttgtgaacaggagctcaaattaaatattccatttcagtcattaactgatgtgaaaaactcttccttttctggatgaaactatagatatgtttgggcaaaggagagtgaaagttgatattgataccagacactttacagctattagaccttacacctaaatccttatgtctaagatttaaagcacggtcccttacataagcctgtttcatttgctaccgataataaaaatcctgtcctaacacagacaagtgaaaaagtaacctcacatgcatattctgtttcacactcatcttgtgtatttactcttcacgtgtctcccaaatccaaataaaaggtgagacctagagagacacatgttcacacttgtcctcttagaagcatgtagattttatgcatgatgtccccattattgtaaatggagtgcacaaagataattcagcaagtccttatctctcagtgtctcaattatgaatagtttttgattcagtgttgccctgagggcctctgaggtgggtagagaaaccgtctgtctccagattctggactgttcccaaggtcttggcttctttcttcccatcgtggtcattgctgttcccaggttctgtgcctgcttctggacatcctcatcactgtccccactcctttcatttttcccttcatttttctacagtctcactcgtatttgtgtttggttttgatagtgagactgaattttgtttctgcttaaatgattatcacgctttatatatttcattttttgattttgactcttagcattctttcatgtcagatgtttctagagaaactctactttgcgtaatttagggaccccagagtagagcaattccagtttgaaaatattctaattttggcttttaaaaacatgtgaagtgtgaggatgaaaccattagagcttgactttcttagaaatttgtcaagtatatatttaacaaatatatacgattgcgttatactttatttataaactaaatgttctttaaccatgaacacctggtcaggtgtctctagtggctttaagtaaagaccacttcatttaccctcatgtggctaagataatgcctcttgttgtgcttcaggtttgttatgtgaaagcagtccacttctgagattagtttaaaatgttctatttaaaggctgtttgcatggccccatttaagaaattaggctatgcaaatccaacctgattacgagattcagttttaaagaaatttgaagtgcatttgagactctttgttaccatcgatcttagattttactggaatgaaaccactgagcttcaggcttgttaggtttcacttaagaattccatttccagcatcaatgttattacctttcattctgagtcctaagtgaccaagctattatttttctccctgttcagcaattgattttgttgccttgatatacttttatttgtcagtttatttcctgctgccatgattcttactcctatcaagacattagtttttgtttctaatgtgggtaaaatgtttaggccagaggttctgctgatctatgattctctagattctgcaggttgaagtgtttcccagggcttgcttatttggggaccatgaagaatccatttggcctgaaaaaagcttggtttatttgtatactacttgtaagataagtcagtcctttacaatatcctgtcgtggatggaatagaccactcatgaatagaaaacagagtgtattaaagcctttaatcaagaaatcctaccaaattcctaatcgcagatgtaagagcatatttcttgtgtagcaagtccatgaaaccaaagggctgatccatacataaatgtgtgatacccctcagcagagagagatgctccagatattaggctgtttttggtgctgtctctaacatgcaagtgggctgtgtatcattggtctcttttcctccgatgtgcctagtagagcatcctaaaggagcttacaactgaagatgaaaactagcatgtgaataattacatgttacatataaagaaaacgtttctcattatattaacataaatattatatatgtgtgtgtatatatagtttaacttatttgtattacacacacacacacacacacacacacacacacgtttaacctgtattctgtctcccctgttactttgcttattttagaatatggcaatattttaatattttggacagccaaactgacatttattcaatatattgagttcctagtatgttccaggcactgtggaagggtgctgaagacacaaagaggagtaaaaatatgcatccttttcttaaatagttggaagcctagtgagggagatagaaatatataccattaacaatagagtgagggcagtacccctagaggccctataagtacaaagtgctttgaatccttagaggaaggagtggtccttatgattggagtggaattgtctgggaaggacttgctatgttgaagagtctgagtttcaccctaaaatcagttagggaactgatatggtttggctgtgtccccacccaaatctcatcttgaattgtagttaccattcaattgtgagtgagttctcacaagatctcatggtttaaaaagaggctttcctcccttttgctctgcatttcttcttgctgctgccatgtgaagaaggatgtgtttgcatccctttctgtcatgactgtaagtttcctgaggcctccccagccctgcagaactgagtcaattaaacctctttcctttataaattatccagtcttgggtatgtccttataacagcatgagaacggactaatacagggaccattaaggaattttaagccttggagtgttatggtcaggtattccttctagaaagttgatactgtggactgcaatttaggaatgagaagctagaggaatttttcaacaaattaaaacaatgaattactatatgatgcaggaattctacttctagatgtagactcaaaagaactgaaagcagagacttgagcagatatttgtacatccatgttcacagcaacattattcatgatagtcaaaaggtggaaaaacccaaatgtggataaacaaaatgtggtatatatatgtgcaatggcatatcgttaaaaccttaacaagggataaaattttgacatatcctacaatagggataaaccttatagacattataccaagtgaaataagccaatcctcatctttgaagtgtgataataatagtacagctctctcctcttatctgcaaggggtatgttccaaaatccccaatgtatgcctgaaactgggtattactgaatgctgtatataaattagatacagtaggagattcacaacaataactaaagtagaacaattataacagtatacttaataaaagatatatgattgtgcacattcattctctgtctctcgctctctcagaatgactgtgggtaactgaaaccatggaaagtgagatcacagataatggggaaaaaattgtgtctatttaataaaatgacagggtggtggccctgaggaataaattggctaactcatgtaaggtgcttcaaaggatgcctgacacagtaactcctcagtaaatgtgagctgctactgaagtacttttgttaccactactaccattagtgtttttttatttgaagaactaacttaaatatatgacatattaatcttgtttccttgactttgatgggatgtcttatttttaatagctttattgtggcattcttcactacagtaactgtacttatttaaagcatatagcatgataagttttgacatatatatacatctgtgaattgatcactgaaatccagaaagcgaacagaatccattactttctcaacagaacccaatgctttctcaaatcccttggtaattcctccatttccccagacgaccaatgttattctttctcttaccatagattagtttgagttttctagagttttggatacctgtaatcatataatattgtattcctttttgtctgacttctttcaatcggcataattgttttgagactccatgtttttgtgtatataaagttaattcctttatattgccaaatagtattccattgcatgaatataccacagtttgtttatccataagcacctgttgatggatgttgggttgttttcagctttggagaattataaataaacctgctatgaatattcttgtacaagacatattcttttaatggatgtatgttttctttagggtaaatctaagaatggaatagctggattatgtggtagatgtatgtttaacttttaaaaacagtactcaacagttctacaaagtggttgttctattttacaagccagcaacagtgtactagagtttctgttgctctacaccctcactaatacttggcatggcagactttttagttttttccactctgataggtgtgcagtggtatgtagttgtagtttttaattggcatttccttaatgaccaatgatgttgagcgtctttttatgtgctttttttgctattcctattttctttgatgatgtatctgttcaaatctgttcctcatttctctattgggtgattttcttattgtttctttagatttgagaattatttacatactgtggatacaaattctttatcatagatatgcttgtaaatattttctccacatctatggcttgactattttcctaacagtgtcttctggggagcagaatattttaattttgataaaaatctagttcatctaatttttcacttgtgatttataatcttggagacatctctaaaaaaaactttgccgaacccaagtttacaaagattttttcctatcttttctttcagaagtttcatagttaggtattataggtagacctgtgatcagtttgtgctaattttgtatattactgaaggtgtggattgaatgttttttgtttctgcatatgaacatccaatttctctagcatcatttgttgaaaactctggtctttcttcactgtattgcctttctatctctgcaaacaattatttgtcctacatatctaagtttgtttctagattatttattctgtagcagtgatctatttgtcttttctgatgccaatacctccttgattacagtagctttatgataagtcttgaaatcacattcatctaagttgttttgtccatctatgtccttcacagtgttttcaaatggatttagaatcagttaatcaatctgttggtctatctgtatatccatccatccatccaaccacccacccacccacccacccactcactcatccatctcactagctataaccttgattacaatgtccaatagaaatagtaagcgtgaacatccttgtgaacattcttgccgtgttcctgatcatagagaaaaagcattcagtctttcaccattaaggatgatgttagctatacatttttcttataggccctttttaaagtttaagggcattcctttcccttcttagtgtgctgggtttttttttttaaatcaaaagtagatgttagattttgtcacatgctgttgagatgatgatgtagttttcctttttagttttttaaatgtgttgattgatgttttgagtgttaagctaactctatattcctcggataaactccacttatccctctaaaatttgtagaatctgtagtgatatcctctatcatttgtaatattgataatttatgtattcttttcctgtgataagttttcctagagatttatcaattttattgatcttctcaaataacatgcttttggcatcattgacttttctgtactgtttttctattttttatttcactgattttttggctttgagctttattatttcctttcttctgcttgctttggtttaatttgcttttccttttcagtttgttaaggtcattcgttttgagacttttattcttttctaacacagatgttaggtggtataaatttcttcttgagtactgtggtagtgtcattccacaaattccatgttgtattttcattcagctcaaaatgcattctaattttcttttgatttctttattaaccagtggattatttagaagtgcattattaactttataaatatttggagattttccagagatctgcttttttatttctgatgtaattccattgtggttagagaaaatacgttatagaacttgaatccttttaaatgtattgagaattattttatggtcaagaatattgcctgtcttgtatacgtttcatgtacacttcagaataatttatattttgtcatcgttggatggagtcttttataaatgttaataaagtcagtgtggttgataggatagttctagtctactatgtatctgacaattttctgtccatttgttttaattattgagaaaagggtactgaaatcctcaactttaatttaggattttgtctgttttacttgtatttctgtgtttttgcttcatgtattggaagaaataatattgggacataaatactaaggattgttatatcatcttgattaattgagccctttattagtatgaaatgatggttttgatccctagaaatagtccttactatggtgtattttttacttgtgttgacttgtgttactgtgtgtgtctttttccattctattaccttttttcctaacctattagtatctttgtgtttaaagtgtttgtaggtttgtagtaagcaaatatcgttgggtcttcatcttttatccaatctgaaaatctctgccttttttatggatgtttagaatatttacattttaatatgattattcatatctttaggtttaaaccagtcatcttgttatttgctttctatttgtttaatctgttatttattcatttcctttgtttttccctgcctttttttggattgagtattttaatgattctgatttatcttccttgatcttatattgttcatagctatttgtcctgctactttagtggttggtagtgcctagatggtctataacattgatctttaacatcacagtttaagtgatatttagtacttcacttattgcatacaaaccttagagcagtatacttcatttctgtctctcttggcctttatgttactgttgtcgtatatatattttacttttagctatattataaatccctgagtacatagttgttgtttttgtttgaatagtcagttatcttttaataggttttaacaacaaaaaaactcacatatataacctgtaacattttctatgcttttaatttctcatgtagatccagattttcatctggtatcatttgttttttgcttgaaggactttctttaatatttctttctcagtggttgttgagtgatgaattattccagcttttatatgtctgaaagtaagtctttatgttgcctgtgtttttggaaggtgttttcacaggatatagaattcttggtagacatgttttgttcttttagtgctttaaagatgttatcaacagtctttttgttttgtattgcatatgcagtattcatagctctcatcctttgtatataatatgtctttttttctctagctggtatttaagatttttttccttatcactggttttgagtgtttgattatgatttctttcttttcttttttttttttttagatgggttctcactttgttgctcaggctggtcacaaaattgctttgttgtccaggctggttatgaatatgatttcctttgatgtaatttgcctagtgtttcttgtgtttaggattcattgagcttcttggattcatcagtttgttgttttactgaagtttggacattttcagccattactttttcaaaattttttttgtctctctccaattcttctctccctcatgaacttcacttactcttctgttaactcactcgatattgtcctatatctcactgattattttctttctttttttgattcattttctccatgtgtttcatttttggattgattttattgctaggctttaaatttcactaatcatttttcctgcaagacctcccgtggttaataccatccagcatattatttatctcagacattgtatttttttatgtctgggaattatacctcatagttatgtgtatatataagcagctgttcctcaactcataatgggcatcgcattatgtccagataaacctatcataagttgaaaatatcgtaaattgataatgcatttcatacacctaatataccaaacattatagcttagcctagcctaccttaaacatgctcagaacccttacattagcctgtagatgagcaagttcatctaacacaaagcctattttgtaagaaagtggtgaatatctcatgcagtttattgaatactgtactgaaagtgaaaagaagattggttgtgtgggtgttcaaagtattatttgtactgaatgtgtatcacctttgcactgttgtaaatttgaaaaatcttaagttgaactatcataaattgaggactgtctatgtttgtacgtgtgtatgtatatattctacatctctatttaactttttgaacaaatggaaagtaattataattattttaatatccttgtcaaacaattgtatcatctgtggcattctgagttggacttaattggttgctttttgtcatttggatcttttattttttgcttctttgcaatgcctaataatctttagttgtacgatattgtgaattttacttgacttagggggctggatgttttaatttttctataacagttcttggtctttgttctgggacacagctaaattacatggaaacagttttattcttttgggtcttgcttttaatatttgctaggagggaccagagcatcatttggtttatagctaaagcgccttgctttgcgctactgagatgagacctctgaattctctactcaattccaggtcaattataaggttttccagtatgtgcagtgggaataggcactcttcctggccccatggcagtgtgctgagtactgttccctctactgtttttggatggttcttttctcagtcttggttagtttcctcacatgcatgtgttgatcagaactctactgaataagggaaacattttatagatatcttgggttctctctcagtgcagctctattcactctggtatgctgtcctgaaaatgctagtcaccttggtggtctcagattctgatctctcttcactccattcgcctatgttctctctctttgcattgtgacctggaaaatctctcaaagcagtaaactgggagagttgtagggctcacctcatttgtttcctctcagtcagggatctctgtctttcatttcttgacactcattcttaaaaatggttgtttcttatatagatagattcatacatacatatggttgattggttggttggtttcaggcaggaggttaaacctagtccctctcactccattttgcccagaactgatggcctgctttttatttcgtcagaacctggtagctatctatatctttaaaggcgttcattatggtccagtgggaacagcaatataaagctgaaggtctcatcctatttctaccaattaccagctgtctcaagggacagacttgtggagtctcctattcggaaggtcatgtggctgatcatccagtgccgcataaatcgctttctgtacattctctcttttatgctgtcacatgttgggcagctctcccttttgaagaacacatttcgtattttgggtatttctcatcattcgaaacatctttttcatattacctgaaatcggtcttttactaacctccatccaaatttgtctagcaaagtcatatgaaattaatcttttttcccacacagtagccccactcttatttgagggcttttgccctcttccttcccaagtcatctcccagagtaaaaaccttttgatctctgtgagcttcagttgtctcatctataaaatgtgctatttattttaaaaaggattcctgtatctgtgagtgcctcctttactgagtcagataccatgccagatgctcaggatgcagaagagaatatgccctctctgccttccagggactcagacaaagcgggggaagagaagttaaatgatacagcgcacagataaaattgctaacagaagtatgccaggcatgctgggcaagtcataggattttatagatgaaattaatggaagtatgtgaaatgtactctatgtgctgtaaaggactgtatgtttgattatgtttgatattatttagtagtagtcaaagatgtactagcagctgctccatacccattatttttttctggagtctgttatgctttgaccttttcggtgttaaggttctgtgtgaatcctctgggttccacataattaataagttttagtgtgtgccaacagggggtggaaacatgacagtaagttcattttcttcctgctgttgcaggttatttgggcttggctcttgtaaaagacaacttgtacccagtgaattctcacatgaattcaaatcttgtaagctaggaatactgtaaatctctactgatgcttgactgagtaggactttacaactccagatggcagttgtaatactttagcatttaccatacagagaaatagaaaacaattttctgaagaaagcagtgacaaaattccaatatcatggttttgtagcactagttcatgccatcctccctcacacagtgttagaacttcttatcgtgatttatcaagcatttcattacattgccaacgatatgaaaaacaaaattaagaactgctgtatactggtgtggcatggtgctgaagtcaggctttgggaaagtacacaatgtggcagcatttcttaaaggcctggagaccgtgttaaaaatgcagattctggccaggtgcagtggctcactcctgtaattgccacactttgggacgccaaggcgggtggattgcttgagcccaggagtttgagatcagcctgggcaacatggtgaaatcccatctctaccaaaacaaccccacaaaaattagctgggcatggtggcacacacttgtagtcccactgactcagggggctgagatggaaggatcacctgagcctgggggagatcaaggctgaagttagttgtgatcatgccactgcactccagcctgggtgacagagtgagaccctgtctgaaaagaaaatgctaactcccaggccccacctccaaatattcttatttagcagttcaagaaagtgggggctgcattgtacttttaattagtttctggatgattctggttcaggtgggtcctgctttgaggaacactggtggagggagtgaccatgtgatataaggagaatcgattttccttcttcttctgcgtgtgaccttgtatttattctgccatccactataacttctgagggtttactttttatcaggaatttaaatcctaaggtgtcataaagatgagttaaaatggttctgttcttgaagtatcttcagtgtgacctgtctggtttagtcagggtagctgtctgatcttgaatgggttacttttaagctcactgcatataattggaataatatggtctacctaatcttcaggagggttgttgtgaaaaccaattgaatgtcaagtgccttgcagtagtcatagcaaatactacttagtcctctcttagcattaattgtgccaatattacttctttccaaagcggttcaggtatctaaataagattctgaactctaacacttcaaacattgtaaagtgatacatgtgagttaactatttatagactgtttctaggaactgccaggcctaattccagtcaatgttttcatgatctgccaaattcagagcagcttataaatatgaagaagggacagaatcttgtctagagtataaagttaagctattggagtcaggtacatcatgtccttctcagtacctttgaaagtttttggctgggcacaatggctcatgcctgtaatcccaacactttgggaggccaacgtgggaggatagcttgattgagcccagcagtttgatcccagcctgggcaacataacaagaccctgtctctaccaaaaaataaaaaaaatttatcttggcatggtggcatgcacctgtggtcctggctatttgggaggctgaggtgggaggatcccttgagcccagaagttagaagctgcagtgagctatgattgcatcactgtactctagtctgggtaacgaagtgagaccctgtcttgaaaaaaaaaaaaaaaagttgtaatgcccttgtgctactggtatttaaaatgtaatactgtgtgaagaatcatttccacacttgatttcatgtatcacctgtgtatatataataataaactataaattatatattatttttgataagtagaatttctttttatttctgtttactaattaaaaaaaacctcctctttatttttgatgtgttgaatatcctgtttataaagttgtagttgaccaaaacaaatacacaaaatcatcagtgacaaagtagtattaaattttatcaataggaagaaagatgtttactttattttgcttgattctcaaattttaattttagcaacatcccctctcccaaataaatttagtaccggagacacgatgcgtcaaagaagttgtcccaaaagagaattaactgcatcatcttatgcctctttacagacaggaggggacaaaagaagaaagttacttttctaacatgctttcgatacttagattgttaaaagaaaaaccttaggcaaattaaatttaacagagttcgactgagcaaagaatgattcgcaaatcaggcagcccccgaaccaaaatacgttgaaagagctttggcctgccttgtggttgaggaagatttatgaacagaaaagggaaagtgaagtacagaaaacagaaatgaggtaccgagacagctggattggttacaactcagcatctgccttatttggacatggtttgaacagttggcagcgcttattggctgaaccctggtgattggcccaagagttggttacagtctgtttgcacatctagttaggttacagttcactacctgctaagaaacctttaggctgaacctaaattatataaggaggcagttttaggctaagctcaatttaacaaggtgaaataagatataaggaaacgtaagaaaaatgaaggacttaccactcagttttctaaatttaacttttcagaaagcctaatggtcttggtattgaagatgcatacctatctaaactggtggttcttgacttatgagccatgatgtgcttttaggtgagccaccaaaatttgatgaatgtggacaattatcgtttgctgcagtggtcactacagtggctttccagaggaaacattttgattggattgagtggtagtgtgttgtggagcagggtacgacttgtggcacataagacatgggaagccttatagactggttaacaaaacgaggtcagtgtttcaggccacatctgctctgctttctgaactctcgcactctcctctggctagttcctgcctgcttggtcctgagtctctttgtggccctctagattggcagcttggctaaactgactgcttggcttttgattttgtttttggctcttagaagtggacccacccactccaatgtgattgagaaaattaacatcgaaatggccacatccaggggtttctatggaacttgaccatttcagggtttatttcaggattacaaaagtaatatgtatttattgggaaaagtataaacgaacaaaaggaaatttaaacaatctatattctctcaccagagatagttttgatatataaggacttagttttctgttaatcttttttatatgtatattttaacaggatcatactaatgtaagcctgatttcttttaactttactacatataataaatatattttccatcattttaaatggttgctgtgtgttccattaaatgaatgtaccataccatattttacttaaccagtatagtttttctggtaatttttttggaaaatttctctttaatttcccattaccattccacctaaagaaaaaaagtatatttttatgggcagctatctatgcatgcacttaccatacatgttcctcactatatatttgtagctttgaatccctggttctcaggccttaagagttggactgagccatactactggcttttctggttctccagtttgaagagaggccttcccagcctccgtaacacatgagccaattcccctaataaataccctctcatttatctgtatgtgtatatctcctattggttctgtttctctggagaaccctaatataaccactaataggaaaattaggacaatgagatgggggttagttctggagagaacccagtggaggtgtccgcagtgaggtgaggtgaggttgatagttaacgctggtgcctgagacacatgtatgattttcatcacagtagcgaaggattcactctctctacgttgctatatccacttgtaagtacaatttgtaaactctactttggaggaatctgaaggtggtgaggaagtgaaagacctgcccaaagtgacatacccagaaagtggcaggattgatacccaggaagtgtggctttttgggcttcctgtctttaagttaacctcagatctgttctttgcctgccaagagaaggtaaatatgattatgaaaatcttctgtttagtaagctttactggtctctacttttagacaaaatgtcagttgtctgtatatgcagtaccaatatattgcacatacagaaaacttgcatatactgacatgtagttaatgtctcaatactcaagagaaaatattttctccatgcaatggtgaacattcatttactgttggaaatagtcactgcatgtttgcactctaaaccttttgtgattgagtgtggcaatgagtgtgcagtaaaatttttttttcttatttttttattttattttatcattattatactttaagttttagggtacatgtgcacagtgtgcaggttagttacatatgtattcctgtgccatgctggtgtgctgcacctattaaaatcatgctgcagtaaattttttttttaaaaagaattcctctatttaccaaatagctcatcggagtttacatacctctggatcacttcccttcagcatctgataaggcttatgcatacattgtcacttattttcttcataaattagccattttcttctgtcagtaatttatgtccatatctgactataacaactaggattccagtaggatgtggcagatccaggtgagagatgcatatccagggcaccctaaatggaattagctggttctttgtgtcagctcattatctcagcttcactgctgatcctttctctcacagatgccttgaatctaaatcacagtgcctgcttagtaattttacttaaattgtaaaagatgactagcactgtacagtcaaagcacatttaaaacacactcacagtttgttttctgtgacagaaaacaaaacagaaaaatgttttccagatgccagtgcaagcttattgcattggtgtagataaatggtctttgtggattttatttgcttcatatttgtacaaagctttcataatgtactgtcacattctcaccttaagtattttttatgttttttatattagtgtgcatggagccttctaaaatttcttctatgttcactatttttaccaaacttcaatatattatattttcagttaaaaaattagaatgaataagttctctggttgttttatgtaattaatatcacattatttttgccttcagtatcatgtacatggtacatgtttatgagctgttattaataatttagcaacttctttctaaacaaatgattttatacatctttcatatatgaacctaaatacagagcagttcactgccaggtgtggttgagaaatgtatctcaataatttgttgagatgaaatctgttaacttctcctaaactttcaaactgtgtaacaggagggattgcctctatttaacctttaatggaaaggtcggtttcagataaagtcttttgacaaacaacatcttttcttcatgactctgtctcagaatttccttgctaccactttgatcttcttcgtctatttgcctgaggatttctgctacctatgaagacttgcctccattgatttttgtgttttttttctctctcccagagtgaaaaggtacatgcctttcctgatttgcactttgaatgtgtcatcctagtgtcatctggcctccattgttacagataagaagtcatctgttcatcttattgtgatgccatcattacataatgaaattcataatttttctcttattgatttcaagagtttatctttcaacgttttgaagtgtctggtgtggttctctttgagttttttgtacttgtaattcattgagcttctttgaagtatagattagcatttttcatcagtttggaaaatttttagctatgatttctttgaatattctttgtacttctttctgtctctcatctccttcttgtattttgattatgtgttggtttgctaactgctatcccccatttctgaagccctgtttactttttcttctttatttcctctctgttctttggatcatctcatctgccttcatgtatcatcaggtttgttgattcattcttttgcccatgcaaatgaagtgcttagcccttcttgtgaatttttcatgcaaatttttatactcttcaagagtcccatttgactcttttagaaaataatttgtgtttgtatttatatcctctatttgataagacattgtcatcatgccttactttacttccgtaggcatggttttcccttagttctttggacatatttaaaatgactactgccgagccatatctgctaattccaacatctgggccctgaaaaggaagtgtctgttgcctgttttgcacatcccccctccccccgtgtatgtgtcacattttcctgggggtgtgtgtgtggatatgtgtgtgcatgcacatgcatgtgtgtgtatgtgtttgaatgtctcataattccttgttgaaacctgtacattttagatactatggtaactctggatattgatcctctccctcttctagggaaagtttcttgaagttgttgtttgctcatttgtttatttgtttagtgacttggctttactaattatttgaagaatatttttctcactctgtgtggcccctgatgtccctgctcaaatttgtttctttgtgtttatctgttagtgtgggttcgtaggagtcacccctgggtctgcctaaatcatttattgatcaatatttgtgcttaagctggcttagccagttggatgtatgcgtggctttcacggttcagggaatttatacttttgtcctgagttccacaaggctctagtagataagtggttctttctccattctctcctgagagggtgcagcatggacatccatacagtcttccagaccatgataggtgaatgagattttattttattttaactcccttcctaggagtcacccctgggatagagtagcttaatgttcagcaagtatttggtctaaggttgtgcttaagcccctcaagttagtaaggcttttgcattttgctgatggatctgtgtacgacttgggaaattttttcaagtctgttccacattccactcgatttactcctgagtagaaataaaagaggtgtgcattccagggcatgtgcttagccttctttgtctctaggggtgagtgtgattccaagagcactcttctttggtgtctctcagtttccttggtccaccgtttcacttattgttactgttatcatgaagctaccaggccctgcataactgtgtgccaccaaaatctccattgtttttgacaatgctcttaggcgtgaacttctcccctctttgttcccaataaagtcagtctcctcagtcagcaaggcagaaggggagctccctctgtcctcagggcatgccatttctcctgcacagaatctctgtggcactgagtcagagttgtggtgatggtggctctggtctttgtagcctgcctctcttcgtgtggaatgtctaccctgtgagtgagctggggttggggttttaagggccccagtattctcagactttgctcttggcacacagccttgctgcacaaatgggaactgaatggggaaaggagacagagtcctcttagcagcacctgccaagaattgtgcttccacaacacatggctgggggttgaataggcagcgagaggcactggcagcctgcccctttcaggtgaaactctagccctagactaggagctggggagagtgggaacccccgtgttcttggccatatcttcccatagcaaagtttccatcacagagctggcagtaggggtgtagggagggtatgggagcaagtcattgctccagtgccacagattcttgccattcttaccaagatttagtatattttcttgaagagatgtttcttcacttgctgtatgcccttaggaaaatttccagaaactttaaatgtttctttagtttgttttaagtaattttcaccagttaaataaatggtggttgcaccaagagaggatctgctaatctcacactgctattccagaagactccccttcttggcgtggttttttaaggcttttctccagcagagtgacatttagcttatctgatgggctaatccttcattgtcattgaatgtgttcatcaggctgcgacctcttatatctttgtgttccctgtctccagtaatatgaatgctacttcatagtaagtactcaataaacgtctgaatgaatgaatagatactacatttttaaagtgatgtgttgatttttattcacaaggagtgatgcaaacagtgtggactttgggcactgtagggctttgctggctgtggaagtaggttttgactctgctgacccagcataatcatagtgagctcgaatgtttaaaaatagaaggggtatgaagaactactacacgacacacgaataagaagagacaacccaatagcagaacaaacaacagtagcagcaacaacaaaaaatagatgtgtgatatgcctaggcaggctataaaataggaagcagagaggatcaattagcattaaagatattccacctatcaggaatatgacatttaaaacaatgatgtatcataaacttataatcatcagatttgcaaaaattaaaaagtctgacaaagtattggggaagatgtggagaaacagaaattttggtaaactgcagataggactataagttggtataactccttcggggaggaatgcagcagtaacaaaataggttgaatattatatagtcacacactagacacagtaattatactacaaggcatagattccagggaaaactgtcactcatgagcagcaggagacattaatagagagatgcttgttgctgcactttttgtaatagtgaaaatcataaaacaacccaaataggtatcagtggggaaatggagaagtaaatgttaatatagacttacagtggaacacgatgcagcagttaagatgaatagtctgcctctacagagagcaacatatataagtttgatgggtaacaagttacagaaggttgtataaggttgtatgcggtatagtattttatactgtttatgtaagttaaaatacagcaaataagtttttgttgtttatggataccatagcacaggtgtcaactatgtaaagtgtgtaggctgtttttgaacagctcacaagctaagaatgacgtttacattttaaaagtgtaaaaacaaccaaaacatgttacatagactccacctgaccctcaagttttaaaatatttctatttgctcctttactaaaaaagttttctggtttctgcagtacagatgatctgtgtgcccagggccatgccctccatgccctccagcccaagcttggtagacagctccctgaaggccacctctgactttcctgccccaggagttattcttgtgccttggaacttcagttcttcctgggggcagcctgaaacatcagggattaacacactggaggcaaccacagccactgggaatgtgaatcagtggatgacgatttccatatcttcctcttcaaccaaggagcagtgctgaggcatgttcttcatggtccctcacagggacccagcagaattgagccattttgcctaacttggtgaccggctccagaacatgccctttactgaccttccctttccctgccccacccctctcttctggctccttccctctgtttgctggaaccatcacccagataatctgctgtcccttcatcctcattctaggctctgctttggaggactccagactaagacagacatgtgggcagtaaaagaataaaactgccattgggaaggagactggttatctcagggaagacaggaagcataaaaggggttttcattgtatttgttacatgttatttctttatttgaaaatatctgcaataaatatggcaaaatgtttgctttttaaaagctgggtatttacatttttgagtttgaaataatgtaacagatttctatgcgaatctagtcttcctccttgacttttcattctttaggaacctgactcttgtggtgcttaaaatctggtttctaccttggcacattcatcatatcctgaggaaaattgatttactatgagaataaaggaagggtgtatgtatttaactaatagaaaagatgaagtaccacagcaattaaatcaaaagtggcttttcctccattattttgtgcttcataatataacttactcttccagcagaatggtggtggtatctaaaaccttctacttacagatactcttctgaattttatttttaaatttttaaaattatttatgtatgtatgtatttatttttattatactttaagttctgggatacatgtgcagaacgtgcaggtttgttacataggtatacatgtgccatggtggtctgctgcacccatcagcctgtcatctacattaggtatttctcctaatgctatccctccccttgctcccgaccccagacaagccccagtgtgtgatgttccccttcctgtgcccatatgttctcactgttcagctcccacttattagtgagaacatgcagtgtttggttttctgttctagtgttggtttgctgagaatgatggtttccatcctcatccatgtctctgcaaaggacatgaactcattattttttatggctgcatagtattccatggtgtatatgtgccacattttctttatccagtctatcattgatgggcatttgggttggttccaagtctttgttactgtgaatactgtggcaataaatatacatgtgcatgtgtctttatggtagaatgatttataatacttttggtatatactccgtaatgggattgctgggtcaaatagtatttttacttctagatccttggggacttgtcacactttccacaatgacaaatttatactccaactaacagtgtaaaagtgttcttgtttctccatatcctctccagcatctgttgtttcctgacttttaatgatcattattgtaactggcatgagctggtatctcactgtggttttgatttgcatttctctaatgaccggtgatgatgagctttttttcatatgtttgttggccgcataaatgtcatcttttgaaaagtgtctgtttaaatccttcgcccactttttgatggggatttttttttcttgtaaatttgtttaagttccttgtagattctggatattagccctttgtcagatggatagattgcaaaaattttcccccattccgtaggttgcctgttcattctgatagtttcttttgctctacagaagctcttcagtttaattagatcccatttgtcaattttggcttttgttgccattgcttttggtgttttagtcatgaagtctttgcccatgcctatgtcctgaatggtattgcctaggttttcttctaggatttttatggttttaggtctgacgtttaaatctttaatccatcttgaattaatttttgtataaggtgtaaggaaggggcccagtttcagttgtctgcatatgggtagccagttttcccaacaccattgactaaataggtaattctttccccattgcttgtttttgtcaggtttgtcaaagatcagatagttgtagatgtgtagtgttatttctgaggtctctgttctgttcattggtctatatatctgttttggtatgagtaccatgctgttttggttacggtagccttgtactatagtttgaagtcatgtggcatgatgcctccagctttgttgtttttgcttaggattgtcttggctatacgggctctttttttggttccatatgacatttaaagtagttttttctaattctgtgaagaaagtcaatggcagcttgatgggaatagcactgaatctgtaaattactttgggcaatatggccgttttcatgatactgattcttcctatccatgagcatggaatgttttcccatttgtttgtgtcctctcttatttccttgagcagtgtcatgtacttctctttgaagaggtccttcacatcccttgtaagttggattcctaggctttttattctctttgtagcaattgtgaatgggagtttactcatgattgggctcactgtctattattggtgtatgggaatgtttttgattttttgcacattgatttttttaatcctgagactgctgaagttgcttatcagcttaaggagtttttgggctgagatgatgggattttctaaatatccagtcatgtcgtttgcaggcagagacagtttgaattcgtctcttcctgtttgaatacactttatttctttctcttgcctgattgtcttggccagcacttccaatactatgttgaataggagtggtgagagagggcatccttatcttgtgccggttttcaaagtgaatgctgccagctttttgcccattcaatatgatattggctgtgggtttgtcataaatagctcttattattttgagataggttcaatcaatacctggtttattaagtgttttagcatgaaggagtgttgaattttacaaaggccttttctgcatctattgaagatactctcctaaattttaaataacaggtcaaacatgatctaagttgctctaaatatgacgtgaattgatggtaattcaacaaagtgcaaaattttcaggaaactatagttctttgggaaatttcacttagacttcagaaaattaaatctcactgaagatttcaatatgctgtgtaaggagaggaaccaaaacaaaaggacaaaaacagttttttaaataagtgcacacttaggcttacttagagaacgggatgtttttattagcagatttgggacttgaggcatgcaaaactttcagagagagccatatgttcttatgcatgccagccttgcgacagtcacgattctgtggttctgcagatgaaagcaaaacgttgtatagtccttgtggcaggaatgataccttttcctaaagcagcgtcctttggttatgccaagctgttatttggctgagtggctttgcactaaatatatctagagcgatgttttaaaattataaatcttatgtttctccctgctatggactgaatgtttgtgttcccccaaatatacgttgaagccctaacccctaatgtgatggtatttggagatggggcccttgggaggtgtttaaagttatatgagttcgtgagggtagaaccctgctgatggaatttgtgcccttaaaagaagaggaagaggaaaagggagggaggtggggggaggtagggaagagagagagagagaaagagagagagagagacagacagagagagagagagagcatctttctctctccacacaaccacagaggaaggtttatgtgaggacacagtgagaaggcaaaggcagcgtcatgcaagccaggaattgagcgttcaccaaaaaccaaccatgttggcactcttatcttgggcttctagttctagaaccacaagaaggtaaaattctattgtttaagcttacccggtctctggtattttgttatgacagcccaagctgactgatagactccctcatcgctgttaggatggaagccttagtttagtccaaaggggcttgcaggttctggcttttgccagtgtcttcagcttcatctcaagtgctctctccctccctctctgatttgcatcggtgctggtctcttggaggagctatgctttccctatttaccccctgggcttttggacatcctcctcacagtatcctcagtgccggacatacaaaagacattcagtgactatttttaaatgaacaagtggtagaaattagaaggtagtcaggttctgacctgtgatggcagaggaggagatactgtgatagggaaacaagcatataaaaaaggcaacacatttgactgttgtgtctgatcatgactgttttaaatgacatgagtgttgagtaggccaactcactttcactctttttttggacttcatcatattctcaacaacaatcataacagcacattaatattaccctttaaaaaataacctgtttaaggtagtactgttggagatggtgaccggagttgttgctaattactctttttttctgtaactgccttttgccctcaaggtttgccactggaagaggcatatctggtgggaaagaggaaaagacaaatgcatggtggttcaggggaatgatatcaaagagaattaattagaaattggaagttaaaggaaggataagcagatcaaattagtatagaggttggtatactgttccactgcctccttgtctgttaatgtattctggagcatatatcaggcctacattaggcactgggaaagagggatgaacaagatcaaaatcactgccttgcaggaactcagaaagtttgtagaggcattcatataaacaacgatagtttaaaatactgtctaacaagtgctgaatggttaggcacaggggccatgggagcacagaggggtttggaagtcttcatggggaatggtataattggcctagtgataatatgattcaataggcctataggcaaaggaaggagattatggatttattattgaaggacagtaaaacctaattgattttaatcaattcttgttcatttccaagaaaatgttcaccaacagcttttagcaatataaacagttatgagaagcaaattttaaaaaatttaaaagatttttgcacactgaagttgcatattgattatagccaacccaaatagatcctttcctgggaacagaagtttgactgggtttggaatcagggtacctgggtttcagtcctctctctgtaacacctggctgtctgaccatagcatacctggtcacttcactccccacgtccttggcagttcttactgctgctgccttccccactcttcagcacaagtgtgtacccgtgggatgatatcttcccatcaaatcataagtttaattctacagtgattcttttttgatgggtggtcagacctcctctttcctacaaccctcaccccatgtcagaaatataatccttcattttgccaaagcaaaacgaagttagactgcatatgctaatgaatgtgtttatttccctctcacattctctttttttaaattttttttatttttttcatttttttattattatactttaagttttagggtacatgtgcacaatgtgcaggttagttacatatgtatacatgtgacatgctggtgtgctgcacccactaacttgtcatctagcattaggtatatctcccaatgctatccctacccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgttataaagacacatgcacacatgtgtttattgcggcactattcacaatagcaaagacttggaaccaatccaaatgtccaacaatgatagactggattaagaaaatgcggcacatatacaccatggaatactatgcagctataaaaaatgatgagttcatgtcctttgtagggacatggatgaaattggaaatcatcattctcagtaaactatcgcaagaacaaaaaaaccaaacactgcatattctcactgataggtgggaattgaacaatgagaacacatggcctctcacattctcttacttaacctctgcttgccagcttagtgaaccagtgtactaaagaactctggtaacatgagttgatttgataagaaaacttaatataggtcccttctagaaaatgcactctcagtagagaattgcattttgaaatataaatctcaagttcatcactccagttcatcactccataacaggtgcccgcaggcacattattttgcttttcaagatcatctggaatgatgccatttagactaattgccctcaaccctttaatttacctggatttttggaaagtatctttgtttcctcattcagccacatgtttgtctgaggtagaagcattttggaagtttacagtcaccacatccatgagttttcatgtgatgtcaccttgttcttaggtaacaggacaaatattgatgctcatagattgacactaatctcttgcattggtaaagtactttacaattgacaaagcacttactcaattatactgtacagtcttcacataatttcgtgtataactgtcctgtgaggtagcttttagttatccatatattagaaaagttaagaggtaagacattttgcccacagttttcaacctagtaagtagcacacaatgtccattaacagttgaatgaataaacaaaatatggattatccatacaatgaaatattattcagccataaaaggaatgaagcagtgatacatgtcacaacatgaggaaccttgaaaacataatgctatgtgaaacaagccagagacaaaacaccacataattatattatttcatttatataaaatgtccatagtaggtaaatccatagagacagaagtatatgtgtggttaccaaggttggaatggagttgggggaaggagcctgggcagtgaaggctgtaaaaaaattctttttggtatgatgaaagcagtgtaatatttgagtatggtgatgattacataactctgtaaatacactaaaaatcactggattgtgtactttaaacgggtgaactttatgggatataaatgatatctttacaaagtaatgcattcttctttcccctacattccagaactaaaggacaagtaacttcaaaagtgctgcctccgggctcccttcctggtacctattctgcttcacttttgccacatcatgagaaggggtaaccagtctcttaagtcttttctttctaaatattcctctgtctcttcctctcaggtctcacttgaacaactaaaggggcagcctcctagaatcctggtattcactacctaccactcactggcagatgttgacattagcacattactaagcctaagcagaattaagagaaaaggaagccattagtgccaggttggaatcctgcaataggacttagcacctgtcctcagtttaatgtatgagtataagcaccctgaatctatagaaaatccagaaatgtccattatttataaaatgctccctgtatatttgtgtttgtgcatgtgtgagatttgtatttatgtaagagtatgacatatagctacagttgacccttgaacaatacttacttgaactgtggggtccacttatacatgaattttttttttcaaccaaacgtgggtggaatatagaatattcatgggatgtgagccctgcctatgcagaggaccaactttttgtatatgtgggttctacagggccaactgagggacttgagcatataagattttggtagacacaggggttctaggttctagaaccaatcccctgcatacactgagggacaactctgttggcacagagttgattgaggcagtaggaaatgggaagataaagctggcagctctttccacacatggaaagcataataggaaagaagggcttaagttagcaggtaggtggtgtgggattcagggacattactctgcgtatatgtttcatctattgcagcagcctttcctgttacatacttataccctgtgggggcagtggacaagtacagttctgatacctgagactgtgcgaagaaagcaagccaggaatttgtgtgataggggagactccacaatttctcgtttgattcagcataagcctgcattgttggggtatctccaggaagtcagccccagtgcaggcagcagacctcacggcatagggtggaagcaaagtggagcatctgtcagtgcatagccttcttaagcaatgatgagctgcttagcattcaggacattcagcccaagattataaatgaaatgtgtttgtgtgtttatatgtgtgtgtatgtatgtatggatatgtatgtctgccctgtcactggaaggctttttaaattttttgatttagatcatagaatttctagagatactaattttcaaattttatacctcagacaggaatccatctttctgagttttgtgtagttatatttttggtcctaatttgtcagtaaacaggacttttatttcctccatagagaagtcagtgatttttctgtctggggtgtcttcttgcatgccccctggttgtccatccactttcatgactacctctgcagtctcttcatatctctttcttattgttacctaaggtaaagcttacgatttattattgtatctgtgagcatggtgccagtagcttcctttggcttaggaaggaagaacatttatctcaggatagagcttcactgccacatttggtgacataaaatgctatatggagaactgactatactgaggtgtgaaatacatgtaggaagtctctcaaatacattcagatatccatcggcttgcagtttgtccctgatgttggctttctgtgaagctgaagtgcctaccttgaatggatggaaaaaaactgtccgagtctttgtgccctgtagccgtcaattactgtacttttcatgagcattgcctgtggttccaaatgatatttctataggcagaaagtgagatggaagagggaaatattgtacacaaaaatatgaggatgtgaacagagcaggactgttcacaatagcaaagacttggaaccaacccaaatgcccatcaatgatagattggataaagaaaatgtggcacatatacaccatggaatactatgcagccataaaaaaggatgagttcatgtcctttgcggggacatagccgaagctggaaaccatcattctcagcaaactaacacaggaacagaaaacaaaacaccacatgttctcactcataagtgggagttgaacaatgagaacacatggacacagagaggggaacatcacacactggcgcctgtcagggggtggggggctaggggagggatagcattaggagaaatacctaatgtagatgacaggttgatgggtgcagcaaaccaccatggcacatgtatacctatgtaacaaacctgcatgttctgcacatgtatcccagaacttaaaatataattttaaaaaataagaaaaaaagtaaatgaataaataaatagaatttatctgagaaaaaaatatgaggatgtagttcctattatctgattcctagtgtcctttggatcatgcttattttgtctctaagcccattgtattaacctacatcacatatacgcagtttgcactgctggaagctatcaggctctgtaatactgactctgaaatgattgtttcagccgcaccctactgctacctccttgcccgtcctctgagcttgcttatactcattagggaaacttctttgactgttatgacctctttctttcctgattatccctttactttctgttttttggttttggtcgttttcgttggttctttccctgcctcgtctttaattgttggtgatgctcagggttccttccttgactcagctgtactctggagatgcatgttctccctgagcagtcgcctttgagctctggcaacacactctcctgtgcatatgccacatgttttgcttgtttgctttttgtcatgtaggaacttctgtgtaataaagcttcttccctaatcccatgtctgttcatctggcttacttactcctttcagaatcagcccagcctacaggaagcttttcccagcctactcttctctctcaactatgttctaattgtccatgagggtattctgtactttggttaatgtatgtacaccattgtattgaaatgatttgtttatatatacagtcatctaaacaaaactgcaggttcccagacagcatgtgcctgttttatttgcatttaaaaccttcagtgcttgcaaagtcccaggtatatagtaggcattcaatttgagtgctgctatattcattccatttggtggatttaatcttaagatgtttttgtctctttttttctgaagaatggaacttgcaccaaaataaccctaatctgaaaaaaaaatgtgtcatggcattttctttttaagcaccttgcatagtactttctcttttcctccctttcctaatatatggtctgcctgtgttgtactataaatagtactgcagcaggtagaaattgtagcagttagggttctccagagaaacagaatggtgagacatggatatacatacatacatacttatatatacacacacacatatacatacatatatacatatgtgtgtgtatatacatacatatatacataagtgtgtgtgtatatacatacatatatatatagagagagagagagagagaattttatttcaaggaattgcctcatgtgattttatatatatatatatagagagagagagagagagagagagagagagagataattttatttcaaggaattgcctcatgtgattatgtttgacaagtcagaactttgcaggtcaggtcagcaggcttggaaactcttgctcagaagctgatgcttcagtctagaggcagaattccttcttcctcagagtcagctcagctttgttcttagggcttttccattgattggatgaggcccacccacattatgaaggataatcttctttacttgaagtcaacagattgtagatgttaaccattttcacaaaacagcttcacagctattgcattagtttgattgaataagtggatactgtagacttgcgaagttgatgcatgcaactcaccgtcacagaaataagcatgaaatttgtagttgtaacgtatcttagaactcttctgattacccaggtccaccctgttgtggctccattttgtggatgaggaaacaggcccagggtagtttgtagtttcaattcacaaaactggttagtagaaaggggctagccagaaattttctcttaacaaatgagaaatcctgattgacttgctttggccttgtcaacagagtcatcaggcattaggttctagaccacttattaaccagctcagaaatcccaaagtaattattagcacttttttcttctctttatgagttgcttttttttttctcaaggggatttatgactagctttaaatagaattcgaaaaactactacatgtcataaatctgacctcaagtcttagagtctgttattagcagatactgtctttttatattttctgtaacttcaatggcttattgcagtggactatgaaaatgtataaaattttttcctattgccagggatgggaaactatggaaatgtcatccctgcttgctgaactgccctcttaaattgccccttatctgatgatgaactaaattatttgggggagttgaaaaatagagaaatgccagttattttttattcagcacattgtatatactcaaaacattttctgtaaggcaaaaacaggaaaccttgcaaacgaaactgtgggtaatatgtagttataaaccatctttccaggaaggagctgaaagctctgcatgatccctctattataaatttttccaactccttttgaaggatgttaagtaatttgccccatagtctatgggaatttttcacctcggggaaatggggctgagaaagttattacttttaaccccagtgaaccacaccagaaacagttacagcatcatacaaatcaatttctgcattttccataaagtgtttggcaaggaacaaaataggctggaagctgggaaaaaggccaagtacttaactcactcaaactcattttaaagtttttagctctagatattcaaagaaaatcagtgttcatcctgttgaattcatgggaacatcattgttttttatattatataaaaggaaactttccaattttcttaaatatacaattttttgatagtgagaaataaaattaactcaatttagatagacaaaatgcctttactcattttctaagaaaatcttaaatttccggataggaaaataaatatatattttttgaaatccattttcaaaacatcatggcatttaagcattccaacttaatgacagctgagaaagactgctgtgagacatatactgcgtaaagtgaatccaccctgtctattatacatggggataccaccatctggaaaaacaagatctatgtatatttagccaaataccaaaagaatactgctgaaatttcactctcctgtttccctctaagtatttgatatgtcatcaagtattgtattgtattgtattgtattgtattttttaaatgttttggtactttactaaataacaaagaacttttgcacagagtcagaggatggtcttttatttattatcagaggtgatgcctttctataaatattgagaatacagtagtgtcctacagggatagctatttcgtctttctaaagagcttgtgcattaagtaatgttgttctttaataatgcacttaaattacatttagatttttttgctaaatgtgtgaaatcagtttaaaattccatctttcatttaagactgcttattaaggaataataatcccttatttaaattatgatttttgacagttgacaaagtgcttttacacatattttctcatctaattctaaaaacagatctagtgttagatgatgttggttttcattcctgaggtgaagaaattgaggcagcaagagtttaggcattttctttttcacgcaactattaggtgacatttccaagactggaattcatgtgtcttgactctaaatccaatttttaaaaacccttgcctaaagtggctctcatttactgaattgtcaacggtattctttgtacatataaataaattattttatggattgccccataatgcagattaggcaggataatttatgaattctgatttctactcttaaaacctatgcatacttaatttatagaatgttaattaaagtaattctgttttaatatgagtaaaattatggtgatttttcaaaaaagtattttggaaaagtattatgtttattttctatcaaatgtatgtgggtatacacacaaaaacacatttgcctacatatgtgtgtgtttatatatgcaaatatgtgcatatgcatataaactaaaatacatgtatttagacggtagcaagattaagaaaataattaggtcattaatactaattgcagttgtaatgaaagttgtatagtggatgaatgcagaatagttaaaatgaagatagaattttctttagccttggctgtaagtaaaatgtaatacatcacacagtttgttgaattttcttactctttccctgtttttgatagagtaaaagatatactttggagtggagattaaactcttaagagatacagaccaatgccgactcatagttaagggtccttatttaacttacatgcaatttttggttttagaataattcattgagatatatattttctgctctgctcttcaagcgctatgttaattactgaagtctcagacattttcaaataaaagaacctgtgatatatgatctcttccattaacagcttacaattcatatgagcaaatatgcttagcagttttactcaacgagtagttcgttccaggtaatccaacagatgatgtctcattaagagtacagaggaagtccgataacttccagctcagatggggagtcacagatgatggagaaggtgtcatctgggtgggcgtttttggcaattggtagaatttgaagagtagaaaaggaaatagtttcaggtacaaagcaaagggaacaaacagcacatttggtggatggtaaggaaacctggctttgcatcatgaatagtggctgaacaaaatcagggaaattaagaggtaaataaactggcagtgtgggaggtatgaataaatttggtcttaagtctattgaatttcactgatgatgcggttttcaaggagacctttttaaatggcagtttggaggcacagtggttggctcttaagcatttagtaaatgaaatgcaatgctgggaagaatcagagccacccctagaggatggaatgtcttctgcgtagaggtgacagctaactgggggaggatgagtcattattggaaagcaggacaacatcctttgggctgagaacagtggccatttatttaagctgtcgctggctggtggtcctctttgacatttttcttatttggtatatggaaaaaatatagcataagacatccactactgcaggcttaaaattaagacttttaatttaaaacgtgagttgattgtattatttattttcttttttgaaatttgagctgtttgaaataccatcccagagtgaggtgagcagtcttatttgccttgatttatgctacctctaagtcatcttaacattagtattcacaaaactacattgcagtgaaattcaacaaatctttactgaatacctcttatgaggaagacgataaagaataagaggaaaatgagatttttagtttgtttggaatacagagtgtatgggaagtataatagattagaagtataaagtctcaatgctgtactaaatgggcaccattaaaggttttgaaccatcaatgtttttaggtttttaaatggtacaggagagttgtttttaggagttgtttttagttttttggatgatacagggggacatattggttcacttgttctgtttgattcgcatatcttttgcttttaaataggtgaacagtttctcaaatggcaaatatgttagtcaaagtatactaagtggcatcagataacattcagtactgtgaagtgtcaattttagatatcacctcagtggaaaaataatagcatcaaataaacagtaccaggtaaggagaaacagagctcttcattattggccagatggactcaacaagcctgtgttcctcaccttgatccttatgcataaaacaaaaggaagttttaataacatttaaagaaaaggaagaaaaaatgtttgccatactcctaaggaatgagtcagttgttacatagtctgctgttaaattcggggccttgatatatttagctcctttgtgacttggaaaaatagcccagagaacaatatagatgttatttttaatattactttttcccccaggaatctaattacgtaagaaattttttatatcaaccaaccattcaggccagtataagtgtatcagtacataactgctaataacatcattcgctatatttggtgaactgtctctctcagcagctcaaatgtcagtttttatagagaagaggaaagctctctcttgttcgcattctcattgaggcactcctccctccttcttcctttccctctcttcttccctctctcttttgtgaacacacacacacacacacacacacacacaccccaaatagttaaagccaatggattgatgatttgaccccgttgtgttatcaagactagttctgaattactaatggccagtgggatccaagtatctcatttgatagagtgatgcagctactgtggtgctatgctgtggatggatgcaagaagaggggaaattaaaatcactctatatttaacagtataggattgaaagtgtgatgtaggcccttgtgcttttgataagggaaatggtttattcactagagttggtcaaaatgtgattaacacagggttaccaggattctctattaatgaaagcatctctcagctatatatttccttgtgtgtctgttttttaaatgaaattaaatatcacaggtcacaggtcacatgaaggggtctatctataatgattctctttgacaacaaatggaattttggaatatagtgagtttcctgacattggagacagccatgtagaatggagacaacaattgatttggggttttgtagaaaatattttttattgtgtgggaattcagctagattagagtttcctagcccaaatttaatggtaaaccatgtacttgaaaaataagacaagaggggactgacatgtgagccagaactgttgtcactgagcaaaatgagagatagggaatcagtgtgacagtaaaaattggtttggtgatagggacaatattaataacctttaagaccccctctattcatgagtttctgtaacttaaacctgaatatgctcgtcaactcactggcacttgaaatttttttttttttttgagtctgagtctcacctgtcacccaggctggagtgcagtggcacgatcacggctcactgtggcctcaacctcctgagctcaagcaattctttcacctcagcctccagagtatctgggaccacaggtgcacactaccatgttcaactaatttatttttatttttgtagagacagagtcttactacgttgcccaggctggtctcggaaatcctgggctcaagcgatcctcctgcctcaggctcccaaaatgctaggattacaggtgtgagccactgtgcctggcctagtaggttcttaactgaattctaacccccgcacccaatttctagtttgctaaaaacccttaagaatgcaggatgcaggccaagaagctggcttgccaaacaaggtcacagttggtacaggcttcaggttaggtggtattgatgtcagaaaaatcctaaatctgtgaagactgctgaaataggggatcatcagtcagcatcactcagggcacaagttaagtgagagggctgatatcaaggattaagagttaaggcagtgggtacacctctagccttgtgagtctaatggaacttcagacggaggcatccagcaccacggacagctcttcagagctgttgggtggatgtaaaaactcctaggggtttttcctggaaaaactgcttctaattcttcctagctaaagatgtctactatacacaagtatcggactttatgcaaccctctcttttctcatcttcaatgtagtaataataaatgttctatatagttctctgggtacacatattaaatgataaattgaaagtatgtgtcagtgatacaaatttaataacctttcactttgaatcattgccctttatctacctaagattgtattatgtcaaggaaaattgccagcttcttcttaaagtatgaaataacagttaaataaactgatgggagaaactgtggtatggtaaacagatatacactttattggtgagagataggaactaggatttattgtataccatgtaggttcagacatatgctcttataattcttatgccatttaattttcataaccgctctgtgtacctatcaaggaatggaggggtcagtccatgtcatgctcttccactgcgccatatttctcctatttctactgatgggatggaatgggtgacatctggtatgcagggccagagtgatgatagaattccaacttgtggctgtcctaagagtggtctcttctgagtgttttcccgatggcaggaagtgggagtgaaggacagatagagggggtaagcaacacagctcaggtcccccaacaaggagatatcagagcattcctggccaggagatggagcagggtatccaggggccctttggaatgaggtaaaccaggttgttgctgagcttactgtgggttggtcatggtaggaatcttctcaaagaccctcaacctagctgctattgaaggaaatgaaaaaccatactttgatatctgtgtgcgataactttatgtaatacagtgacaacttagggaaaagcatctatctttacaattagggtattttaaagggaatgaaaaggtcttcgtgccattaacatttagtatttgtgtctttgataaaaccagagtatcttttgtgtgatccgtttgtatttaatttgaatcattatttcagaatataaaagtgtatctaatttttttattttattttttgagacagagtctcgctgtcgcccaggctggagtgcagtggtgggatctccgctcactgcaggctccgccccgctgggttcacaccattctcctgcctcagcctcctgagtagctgggactacaggtgcccgccaccacgcccagctaatttttttgtatttttggtagagacggggtttcaccgtgttagccaggatggtctcaatctcctgacctcgtgatccacccgcctcggcctcccaaagtgctgggattacaggtgtgagtcactgcgcccggccctaattttttatgaacatgaattttacatgtggttagtgactgtttgcatttgttatttgacaaacataaaatgtatcataatggaaaatgatcaagtagcaaagaaatgccttcaacagctttctatatgttttggcttatgtacttaaggatgtagacagctttatgagacagactatactatacaagtacttttgtctgaagattagctgggctgagactttttttcttttcataacagtttgatagatgtttgtgattatctgttcaatagcccatttaggactaggttgaagaagcagcagttttctgcataggtagcatttgagatccattatcagagggaaatgattattgtatgatgctgttgtcccttagaactttcaagaggaaaatgttaggattaggtagttatataatgatttgtttgatagaaggagcactgaggttgaaatcagaagatacaaatttgaatgcttgcttctatacccaccagatgcatagcctttagtaagtttttcagaccctcagagccacagtttgctgctataaaaatgagactctccacctaagtcagggaatggttgtgagattacattagatgacatttgtgaaagtgcttaaaatttctaacacattttttaaagaaactgtttataataattctcctttgtggttattttctacagaaagtgagtgagaaggttggaggagctgaaggaaccaagctagatgatgacttcaaagagatggaaagggtaagccttcactactgcctagtgttccctttgacataaaaatgtctaccataattagaggagaagagaaaacgggagagggcaactgttttccactggtctctgagaatactacattttgttatttaaaactacttttcatgtatattttaaaacataaaatgtaaaatattctgtcttccctttgtactgtcctgaggacaaaacctcagtgaaggtgaaaggtcacgatgaactttttctggtgggtttcatcatcattttaaaaaaataaggacagtgttgagctgatgtttgaattagggtgagatgcgtagaaaagaagctgcagaatgacatcccaaatgtttttgggagagtttaagtcactttctggctttaaggaccttccttactggatgattggccagaggcagccatgtatagtggagagaatacagttttagagcttgtccaaccttggcccaaactccccttcctgccatgtgtcacaaaagtccatctattgatcagagcctctttttaaaattttattattattattgttattatttttttgagatggagtcttgctctgttgcccaagctggagtgcagtggcatgatcttggctcactgcaacctccgtctcctgggttcaagcgatctcctgcctcagctccctgagtatctgggattacaggcacgcaccaccacgtctggctaattattgtattttttgtagagatggggttttaccatgctggccaggctggtctcgaactcctaacctcaggtggtccgcctgcctcagcctcccaaagtgctgaggttccaggcatgaaccactgcacccagcagagcccctttttaagtgaatgtaaaatgagaagactaatactcatttgggggattttagttaaggcttaaaaataatgtagattatttagctttctgcttaaaaggtaggttctcagcaagtgagggtagaagtgatgaacaaaacatctcattttatttttcttgggacatgagccatattttcgcttttacttttcttttactttaacgctcttcagaacaggtgatatttaggcttatgattaaaagtgtgtgttacattgtgcacagaaacattttaggtcttaagtgggtggtgggtaatggatctgagagtagcaatcctgtacttgaacagaagaggatgttgcaaactatggtacctagaaaccacatttaaacattgtaaagaatattgcttttgtacttcgttgtaacaaagcaattttttaatattctgattttgattctaccagaagttttttagggactggatattgttttagtctacatcagatccaacaggctgcctcagttttgctgtttttactatgtttgcatgaagagtcaaacaaaaaattcctaggtattcattagtgtagtgtgagaaattaaaaaaaaaatcctaggtactttctaccttgtctttttagtttttctcttggtgagtttattgatgaattcaataaatattttctttgtgtcttccatgaaccaggaggtaggatatagacaaggttcctgagtgcatgaagttcgtagtctagtggggagggcaaacttggggcaagtaatgaccagcgtggcgaggaggaaaactaatggagctacagaagcccagcacagaggaaactcacccatactgcattgtcaaggagaaccttcctgatagttaagtgaagatgggaaagagttagcagagcctggtaaaggaaacagcatgcaagcaggcaagagggaacggttgagttcctgaaaaaaaaagataagttgccaagaggcagggtcttgtgaaatcagactgcatagtattgatccagctggtcattctggctaagttcttgagatagacctcactgatggatacccagtggtgaggagattttatactggaattctgagtcccagccttcagaagtctggaaaaccagactcttacagctgaggcctggcacctacttcctccaactggaccaaagtctgcattggttcctatttctcatctctggatggttctaaataccacctgatcctcaaccaaagctggtagccactaatatccatagttctggaaataatattttacccattcatcttctacagcatctgagactccaggaactgacacacatttccagaaatgtcttgtctttgactcttctactgcccataaaattggagttcctcacgcttcatttgaacagcccatgggttaatccgcctctgtcttcacccagtcttgcttgatccctccttgtactttgatgctcctccttccccctcacccctggagagcatttatagtttgccacgtggccaatgtcatgtcattaatgaaagattaggcaggtatttaggaatttggaactaagtaccaggaatcagaatttgacacttccttttagcatctgccaggactaaagggaataagctaggcagctcactgtctaaagtgagacaagctaacttcctgtttcttaaatgagactaaaaagaacaggaaatttggagaactgagtagaatttatcactgagcaactaattagacctttggagatttattttggtgagaaatatatgccagttttgcaaagtaattgaaataaaagagaatcctccaagcattttactttaggcaaataccaacagaccttcctctgagtatgaaagtaaggtataaggattatttctcctaatttatagaaatgtttctgaaacttttatttcaaaatatagatactcctgcagcaaagtaaacatctgattgactgaagaacacactcatggctctttacttgggtttatacctgaataaattgagagatttaggtttcagtgcagtgtggcaattgttttactctttttgattctgtatatcttttgtttctgtctctattgcaaattttgcaccctccactcatgctaaatttacatgaatagtataagatttctgtggtaattgaaaagcacttgctttggatttagactctcaaatcttttctcgcctgttaattgattattcacacaaatgtttgagctcagtgttcccaagcagacagaagaattgcctttccatagtttgttttctgctcgtcaggcatttggggtagagagacctttgctcatctgtattctcggaggtgcaattagataacaaaatgaaataaattagaggtttgcttcaagcagcattactgggagagagaagtgggttttcctaggggtgtttctctaatcagccgccccagccactctgtggctgagatgcagtaaaatcatcatgtgtgtcccttagctctgcagccctcctctccctgagctgattggatagaatcctgcggctgtgctgtctctgtaggatccctgcccatcattatttctctcctaagtgccttgcatggaattctttttgttttcattttaaatgctgtctgttgcttacaagctttgttaaacacaggctaaatgtcttactctggtgcaacattggaggatttgttctttgaaaagctataggattttttgttaagaggaagttcggaaatttgaagaacctctggttccttctcaaattttcctcagttgctgcaatgattgtgtagttttttgttgtgtgtacagttacattcattaatttacttggaaagtgcctccatgttaaggcagtatccctgccttcaaggggcttccagttttgatttttaaaaaattgtacgtaaatcagtaccttacagaacatagtgcttggtgtcctggggaggtttcccatggaatattcaggctgggtacatcaggcttcctagaagagagagggcgtctgagctaaatcctgaacatgtctcttgtccctgattatgtggttaattcagaattctaagctgaggaatatagtatctgttttgcagcctgaaaattattgtgggaaatcccttctgttgaacccagaagatgtcctagggatagaaacatgtctataggccctttaataaaaatgggattctttttaaggagcaactttgagttttaagaagagcaagttgttgagaaagaatgccatttcatatgagagtaagagaggattattggcagattcaggtgtggagaaagtccaataggaaaatgtccatggtcattatcttcatacactcagtcactgggtggagaggggttcaatttttctatccagcccaagtggtagagctagaattaatgagtagaaaccatggggagatagattctggctcaatataagaaaaacttttggctatcaaagctgggtttttggtgtgtgtgtttttgtgtgtgcgtgtgtgtgtgtgtgtgtgtgtgtgtgttttgcctcagcaatgactgaattccctatcactgcccatgtttgaccccctcgttcccaccgcccatgttggaacacacactgacctgctagttccctcccatcatgtgaggcacaccagtcatctcttgtgagttttgtggttagtaatttgttactaataatgtcactttttaatgatgtcactcttacttggattccagtgatctctctcaaatggggagagaaaggagtagagtttcagctggaatgctctgagcaacacgtatccctgagtgcacccataatgtctccttcatggtgtgatgggaaaggaggaggcgtggagcattgtgctaagacacacccccccggtgtggggatgtaagaagggccagagctccaaacaagatgagctttgaagacatctttttccttagtctgaaattcaatgatgacaagcttcctctgagttacatgtttgcaatatatagttccaagcttatattcattaaaggtaatgaccaagaagattaacagcaaaaaaaatacattggagcaatcacagcattctaataaccttgtttatttttgttttttaacacgttgtttgtcagttgggctttctgaaaacataagataatgctttaaatcaaagcagcttggggacagatggattaactcttctgagtcagcaggggactattaaaaacatcactcttggacctgcctgtatctcgctgccagacagaccttcccaggacacggttttcatcatgtctctgtgattgtttattgagctgttcttgttcaggagtctcagtactttaagtgggtgtgtatgcattattaatagttgtagtttcttaacttcagtgacagaaaagttaagaatttgaaaatattttagtttttcatatgcctttttaatatttcttttatgttaccactgtgagttacccattttcaagtgggtgtgtaattcatctacttatttatctaatttatttatttacttacttatgtggagattgaggtctcactctattgtccaggctggagtgtagtagctcagtcatagctcactatcacctcaaacttctgggctcaagtgattctcctgcctcagcctctcaagtagctaggactaccagcacacaccaccatgcctgcctaatttttattatttatttgatatttgaggtccaatttctttctttttttaaacttgtatcttaacttcaggggtacacgtgcaggtttgttacataggtagacacgtgtcatgggagtttattgtacagatgattttatcacccaggtattaagcctagtactcattagttatttttcccgattgtctccctcctcccaccctccaccctccaataggtcccagtgtgtgttgttcccctctgtgcgttcttgtgttctcatcatttttgtcccacttataagtgagaacatgtggtatttggttgtctcttcctgcattagtttgctaaagataatggcctccaggttcatccatgtccctgcaaagaacctgctctctctcttttatggctgcatagtattccatggtgtatacgtagcacattttctttatccagtctctcactgatgggcatttgggttgattccatgtctttgctattacgaatagtgctgcagtgaacacatgtgtgcatgtgtctttataatagaacaatttatattcctttgggtgtatatccactaatgggattgctgggtcaaatggtatttctgtctttaggattttgaggaatcaccacactatcttccacaatggttgaactaatttacactcctaccaacagtgtataagcattcctttttctccacaaccttgtcagcatctgttgttttttgactttttatctcattgtggttttgatttgtgtttctgtaatgatcagtgatgttgagtgttttctcatatgtttcttggccacataaatgtcttcttttgaaaagtattcatgtcctttgtccactttttaatggggttgtttgctttttttcttgtaaatttctttaagttccttatagatgctggatattagacctttgttggatacatagcttgcaaaaattttctctcattctatagcttgtctttttactccgttggtagtttcttttgctgtgcaaaaactctttggtataattagatcccatttgttaattttcgccttggttgcaattgcttttggtgtcttcctcatgaaatttttgcccatgcctatgtcctcaatggtattttgcctaggttgtctttcagggtttttatgattcggagtttatacatttaagtctttaatccatcttgagttaatttttgtatatggtgtaaggaaggggtccagtttcaatcttctgcatatggctagccagttatcctagcaccatttattgaatagggaatcttttccccattgtttgatttttgtcagatttgtcaaagaccagataactgtaggtgtgcagttttatttctgagatctctattctattctgttggtttatgtgtctgtttttgtaccagtaccatgctgttttggttattgtagccctgtagtatagtttgaagttggatagcatgatgactccagcttcgttctttttgcataggattgccttggctattcaggctcttttctgtttccatatgaattttaaagtactttttcctagttctgctaagaatcttaatggtagtctaataggaatagcattgaattcataaactgctttgagcagtatggccattttgatgatattgagtcttcctatccatgagcatggaacgtttttccatttgtttgtatcatctctgatttctttcagcagtgtttgtagttcttcttgtaaagaacttttggccgggtgcagtgactcacgcctgtaatcccagcactttgggaggctgaggtgggcagatcatgaggtcaggagatcgagaccatcctggctaacatggtgaaaccctgactctactaaatatacaaaaaattagctgggtatggtggcaggcgcctgtagtcccagctactcgggaggctgaggcaggagaatggcttgaacccaggaggtggagcttgcagtgagccgagatcacgccactgtactccagcctgggcggcagagtgagactctgtctcaaaaaaataaaataaataaataactttcacctccctggttagctgtattcctaggtattttattatttttgtggcaattgtgaaggagattgttcctgagttggctcttggcttgactgttcttggtgtataggaatgctagtgatttttgaacattgattttgtatcctgagactttgctgacattctttatcagcttaagaatctttttggctgagactgtggggttttctggacataggatcatgccgtctgcaaacatggatagcttgacttcctctcttcctacttggatgtgctttatttctttctcttgcctaattggcctggtcaggacttccaatactatgttaaataggaggggtgagagagggcatccttgtcttgtgccggttttcaggggaaatgcttccagcttttgcccattcagtatgatgttggatatgggtttgtcatatatggcacttattgttttgaggtgcattcccttaatacctagctcattgggactttataacatgaatgaatgttgaattttattgaaaaccttttgtacatctattgagataatcatgtgtttttcttctttagttctgtttatgtgatgaatcatatttattgatttgcatatgttgaaccaaccttgcatcccagggataaagcctacttgataatggtggataagctttttgacatgcctctggatttggtttgccagcattgtattgaggatttgcatcagtgttcatcaaggaccttggcctgaagttttcttttttgttgtatctttgtggctaattttaaaatcttttgtatagatggggtctcactttttcccaggctagtcttgaactcctggccttaagcaatcctcctatcttggcctcccaaagcactggggtaacagacatgggccaccatgactgactgaatttatttatatattaatgatcactaaactcacaaagtgttggtgctccctttaaggtgtctatgtttttcttaaacttttgctctgctacagcatctggtataatgtggtatctaatagtatgaaatcatatctttcagtccttttgttgctccacaaacaacgccacgctgttcacgagtccttacacctaagttcaggaaataccaacttttcttcagggaagaaaggtaatattcccatgtctctggaagagtaaccccattctagtcatttccatgccttctattctttagtatcttgtctctaaagactgagacagctggtgaaataatcagtatcatctatagattcagcatggcattattattagtgaagctagcacctagcacaggaatcaagatttttttgtaagtgctttaggtttttggggccagagggtctctgtggtctcttacaactccttgccaatgctgtcaaaacacaaaagcgtccattgacagcgtttaaatgaataagtatggctgttttccaacaaaactttatctaaggatgctgaaatgtgaatttgaaatttgaataattattttgtgcagtaaaatagtagtctcatttcaaattttttcaaccatttaaagaagtagaaatggaagtttttattacctaaaaaacatgcctgtatctgtatatatttacagtttcactttcttttttttatttttattttttattatactttaagttctagagtatgtgtacatgtgcacagcttgcaggtttgttacatatgtatacatgtgccatgttggtgtgctgcacccattaactcgtcatttacattaggtatatctcctaatgctatccctcccccctccccccaccccacggcaggcccccatgtgtgatgttccccttcctgtgtccaagtgttctcattgttcatttcccacctatgagtgagaacttgcggtgtttggttttttgtccttgcaatagtttgctgagaatgatggtttccagcttcatccacgtccctacaaaggacatgaactcatcattttttatggctgcatagtattccatggtgtatatgtgccacagtttcttaatccagtctatcattgatggacatttgggttggttccaagtctttgctgttgtgaatagtgccgcaataaacatacgtgtgcatgtgtctttatagcagcatgatttataatcctttgggtatatacccagtaatgggatggctgggtcaaatggtatttctagttctagatccctgaggaattgccacactgtcttccacaatggttgaaccagtttacattcccaccaacagtgtaaaagtgttcctatttctccacatcctctccagcacctgttgtttcctgactttttaatgattaccattctaactggtgtgagatggtatctcattgtggttttcatttgcatttctctgatggccagtgatgatgagcatttttccatatgtctgttggctgcataaatgtcttcttttgagaagtgtctgttcctatcctttgccccctttttgaagacttaaatgttagacctaagaccataaaaaccctagaagaaaacctagacaataccattcaggacataggcatgggcaaggcattagacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctattcatctgacaaagagctaatatccagaatctacaaagaactcaaacaaatttacaagaaaaaaacaaccccatcaaaaagtgggcgaaggatatgaacagtttcactttctttaaacagccttccctaatggctcctcacaccaatcccaggcaaggttagttgaagacggaggctcaggagcttataagatgagaaattcttgtaatttaggatgcatcaaaacttactttcaaatagtaattggaaattttggacattgagaaaaataacagttacatgtcataagttcaaagttaaactgtactgttctcaaatggcaataagctcaattctgggagcttatgggaattgctagttataataagttacttaagtggaaatcttctttatgctaagttaatcaggcctgttactaagagaatatgtacttggatattaccagcttaggtatataaataactcttctgccaagtgcataacaaggcacattcaggggtctcatggggttatggccctcagcttgtctctggctgacacagtgtagtttagcaaaagagtcctgggcattattatggaggaccgaggtggagagaagttagaaattagtcagcctcctactggcagatgacttcagaatgtgactaatcattggaccattcagttcttctggtacttttttaaagaaagcctctgattaatggccttgggaactacttttctcctcataacacacttaaagagctcctttcccttctctaggccacaggtgtggacatttaataaattaaagcgttaaacagaatgctcccctggtctcttcctcttatgtccatgaagtctatcaagtaattatctgtaagaatgcagccatgcctggtgcagtgactcatgcctgtaatcccagcactttggaaggccaaggcggatggatcacttgaggccaggagttcgagaccagcctgaccaacatggcaaaaccccgtctctaccaaaaaatacaaaaattagccaggcatggtggtgcgtgcctctagtcccagcttcttgggaagctggggagggagaatcgcttgaacctgggaggaggaggttgcggtgagctgagattgctctactgcactccagcctgggggagagagtaagaccctgtctcaaaaaaaaaaaaaaaaaaaaaaaaaaaaaaaattgcagtcagtagcaagggcctaggaatggatttgccaaaagtgggtccctctttagtataattcctgataatgaaataaaaatgtaactgtattgaataaagttgttttcagaggtggtggatttcaagcgaaggttattttatgttgtagtcaaaagggtttaggtagaacttgctctgtaatgatgcctggactaggtaaccaaaagtgttgaaggagtctgcctcaatgggcacaaagtcggtaaacatctgggtgggatgagctctttctttagacaagtcacaagggacactggaatagtttttattcctacttctcttttaagatggagtcctgccctggggaccaaatgtaataatctaatattggtatccccagggtctctgggtcttccctgagaccactggcttcagccaagctagtggtgtctgtttacactacatgagtggttgggctccctacacagagcttaaaagggaagggggttctgtagccaaaatgagaaactagctttcacagccttccttgctcacctccctgtgggccaggtgggatagacactgcaggtaccagtctctgtagggaaacccgtgaaactgagggcctgtggttcagcagatcagcattgcagagcctcccttccagagaggcccaggatggaatagtcttgtggatgaagcttccacagactttgagaagtttcaaaataaaaacagaatatgggatggcaggtaccttcctgctgatgctgtttcaccggctactgccaggtccccagccccatcttagggagggaacaaagcatattccagctctgacttggcctctctttcagattgggagatgcctctgttgcctgtctttttaggaagagcttttgctttcaagaagtataggatggtcattaagaacacacacactggaactagaactggggaagtttcttaacccctctgtatctgttttctcatatacattacagagtttgtgagcattgagtgtgtaaagatatttatagtccttagaacagtttctgacaaacagaagacagcttatggtgatgattgttataattattaaggacagagatgggggaaccttagaaattggtcagccccttaacagcagatgacatcaggatatcaaacagccattggaaaatttaattcctatggcactcttttttagaaaccttggctttttgaatgattttccttctcatcataactacaggatatttagacacatttgtcatctaattccttaattcccatcacataggcagcaggagatctacatttgtacttctatcacacatgtaccatggagtttcagcatatttgttccatacacacctttgatccatttccctggcataagacattctatgacttgagtacatagtggttgtttggaattttgctaatactaggaccttcacatatggcttcacaagttgtgtactgcacaactccagggggctactgagcatttttaagctaatcactacctggtacacactcaatcttaaagatctttgaaatttgaatcaatcaaaaggatatttatacaagatttatatgtagacaggcacatttgaaattgcatccttctaaagataattttatatcattataacttcacaagaaaaaatttgttttcctctgttgatcctagtaatagcaaacacacacagtaatatgactgccatggaatgaaaaattattaagtattgaaaaactgaactgaaagataaaatcttttaatgtgtggattatggaaaaggaggaggcttactttatgcaaggctgatattatataccggtatatattatataccggtatatattggtatatactgatattatactggtatatactgatattatatactggtatatattatataccactaggtacagcaggttatggaaaagtttctcatagttgaagggggagccttttaacaaacagaaaatttctccagtggacttaattgatacctaaatttctacattaaaatttaatcactttcatttatacctatgtcatatattacatgtacataccttgaataggaggatgcatttattctcattagtcatttaccatgtagggcgaataggaggcccacagatgctgataagaaaaggatttcttggagaaagacagagagcactgcagtgagcaccttccatgacctctttcaagtggggagaggggcctgacaaagagaacacggtgagatgctgaaggcaaacactgaccattccaaatttagaaatttagaggatagaacaaatttggaggatagactctagcatcaagatttttgtttagcattaaccaaaagttcaaggacagactagaagtctttgctcaagattttatatttttaggatgttcttagaagttaaataaaaagctccccacttcttgaataagcagagttgatgctgcatgattctttcttgagggcagcaaaatctgcctccatgcctgacccactgtaggcatccaataaatgcctctgggacaaaatatgtttcattttattcaccttattttcaccagaaggtaatgaattatattttgaaacaaattttaggaaactacaagcttcttctttggataaacgggctttccacatcttggcagaccactgctgagtacagtgtcagcatgacttccagccgcgtctcagcctccctcacctactgcgggacttgtccggggctctgttgcataccccgccattgtatacagactcaaccaaaaaccggtattctaaagctcatcatttttgtcatttagagcacttattttctcatttcagaaagtggatgtcaccagcagggctgtgatggaaataatgactaaaacaattgaataccttcaacccaatccaggtaaggcatcatcttatatgtttaaaggatccctcgaggtaacttttagtttctctttgatagacattttaagtttggtgtgtttcttcttttggtgttgcttcctcggtccacttttctgagaggttagcgacttcatggatagcacattttaactggggagaagggctttttaaagctcacattgaagtaactggaagatctgtggtattttatctgactgtggtatatttaacaaataatgtatgcaaacagttcaggtgacacataatatcagagtagctataaactgttatcagtttgaactttcaagagatggtaagaaggaaaattaggatagtttaaggtaagatataatgattcccagaagatgtgaaaaagtagggaggtgaatcgttttcatgaaacacagagggtttcttcatagggcatcaccaaagtcttcagagcgttgatcttgattctgattcttctccaagcacatcacagatcagcattggttcctgctaacttgttatactctaagaaaaagaagtggtaatagagataacggagctatatgttgataagaggaccaggcagagttggggcagtttcggtaggcactaggtatagcaaagcaaagcaaagcaaagcagcctacctgatagacctcctcattaccattcctgtgtgtcagtttctaaccacagggcatggaaacgggaagtgaggctggttgtatttaagtgagatgtgtgaatatttggaataccccttaatcttgaggctagtttctttgcaagtttcaggttggggttccgtgtattttatggtcctagagaggatggtgcagacaactgcttcagccccaatgagtttggatactgagcaatagtggacaagtgatcaaaaaaaaaaaaaaaagggggcgggtgtgggctgagaggaagcaggtgtgtgctgtactaagtgctggctccttttctatgccccctgctgctggctgcagcttccttccatccttattcacctatgaccagcccagctgctattctgaggatgagcagactatgtaggaataactttctggatatttgttgctgttgtttttgttcataaaacacattagaaatgagcttatgtgagggaggaaaatatggaagaaaatgtgataagctataggaaccaggaatttaactgacagtggtctagatacattttcaaatgcttagcaaatttgtcaaagcactgcaaaaatcaggtttcttatttttacccagaaccttcttggtaaccactgtttttcacagagatgcaaagatctcttggatgcacatttattccttactgtttaaaccactgtcataggtcaagttctgaaagagaactgctcgccctgcttccccgcaagaaatcattatataggggcaagaagttttggtctttatctttgcctagaaccttgaagtactccatgatttcctgggattttcacgagttgtacttgtaactcatggttgtagggctaagagaaaggcagtgggaggaggaatatagtatttattgagcactgatgcattttcaatgcagtgctaggtatatgaggcattgtctcatctttaaaagtaaccatttttctccatataaagtaaaaacagttgaagaatttctagtatgaaaatagactaaaaattcattgtaacacaaattatcagtgggagctcatcagttttcctgagtataatggaactgtgctctgttgtaggtaggtgtggtgggttgcatagtgtgtctccccaaattcaggtccatccagaactaaacttataaggaatgtgaccttatgtggaaataatccttgcagatgtaagtagtgatgtaggatcttgagatgaactcttcctagatttagggtggcccctagaaccagtgatgggtgtccttatgagaagaggagaggacacagagaaacacaggaaagaaggccacgtgaagaatgagaagaggttgaagttacacgtcacgagcaaaggaatgccaggagccaccaccacaagctggaagacatgaggaaggattctctcagagcctccagagggaaccaactttgccgacaccttgatttcagacttccggtatgctgaactgtgagggaatcaattcttttctttgaggctgcccagtttgtggtcatttgaaatgacagctctagaaaactaatccagtacgctagcctcattttattcaggaaaaaacaagggtcagagaatttaaggaactttcccattcatacacctaggaagggatgaagacaagattggaactcaggtctgactacctcctaagtctctgcacttcacgttgcacgatcctgcctctgagaagggtaggctccatttcatttaggtgtgaagggtccttccctttcagagagtaccagagaaattcagaaaggaaattgtgggattaaggcttatttttattttaataaaaaacatcaaaggaggaggtaattgagaagatctgaatgtttagaaatgacatttttaatacaatattgcatgtgctaattggctgccaatataatggttttgtgactatttgagagttgaatggacatctgccactaagaacaatgaaggccattacaggcaattcgaggttggtttcagaaaaacagttatgtatgggcaggccacatacatatatgagtaagtactacccagaagagtccagaacaaaacgaaaattttgtgtaatcattccacagaatttaaacaacctgcatttaattgtttacaacaggtacaatttcatccctccaccagcttcttgccctgagagtagacactggccatagagcccagaccaggtaactggtaaagttgagagttaggcagacacccagagagacagtccttgggcacaggagagcacaaagaatgttcccaaactcgtgcagtttgctaaatactttgcccactcagcctttcagtgaaccctagagctgggccaaccagtgtggatactgaatgctggttctgaataagcaagatatggcctgggttaggacagggcctgatgccaagtaacacatttacatggacaggccaggggaatcagtaggatttgatgcttcgagggtactttgggagtacatctgtattagattactgctcccgggtgcttgctggctttcacatcttgggtacatggacaggccaggggaatcagtaggatttgatgcttcgagggtactttgggagtacatctgtattagattactgctcccgggtgcttgctggctttcacatcttgggtacatggacaggccagggcaatcagtaagatttgatgcttcaagggtactttgggagtacatctgtattagattactgctcccgggtgcttgctggctttcacgtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatcttgggtacatggacaggccagggcaatcagtaggatttgatgcttcgagggtactttgggagtacatctgtattagattactgctcccgggtgcttgctggctttcacatcttgggttcatggacaggccaggggaatcagtaggatttgatgcttcgagggtactttgggagtacatctgtattagattactgctcccgggtgcttgctggctttcacgtcttgggggtgtggagcttacacatgttttctattcttaaaactcagttcctattgaagtgatgaccaaagtgattttgtttagcttttaagaatacatggctatgctctgtgaaggtcctacatccactcttgcccatctccagaatgatattttaaaaagcaaatttggtcatattatgtaaaacccttccatggcttttcatgcctttaggattaactttcatttttaacatggcttaaggggccctccctgcatggtcagcctgccctttctccaacaccttgctaggctaacagctccctcgggtccagcgtaaaggtcacttattagccttccttggctccaaccacattaggttcccctgtcactgtccctcttgtaatcccagctgcttttcagtggggcacatgccatacttgtggttttgtttttcatctgccgtgagttcagcactgtgcctgtcttattcaccaccacatccccagcccccagctcagttccaggcagccaacaggcactgggatattggaataaatgaattatgaagcacagttgactgtcagtgtctaatgtactaaaacttctctaatacaaaaagtaggaggaaaaattcttccttttccctaaatcatcagatactcatatgtaaccaacatttgtcacatgcatttacttttatgcaaagagcaattctagatgctgtggggcagaaatgagaccaagactggaggcttgtcctctggaacctcacagtcttagtgtaagttacacacagtctgaggagaggagcccagaaggcttcacagctaattcctcctggaaaatgcagctaactgatgagatgtggaagtgtgagcgggatcacaggcttaaacgtctgccctgtgagggtgggctttcgagaacgcaggacagacagctgtaaagtcatccaagcttgaactgcaatagcataaaccagtacacattcctaaaatgcttaaataagatataatttgaatatagaaagtactgtgcacaaattccattctactggttgtaagtgcctattcttatgatatctgtgagcaaaaatcactgaagaagatataactcagttttctttacatattctgatgccttacgggggagcaaaaactgaatcgatgttgtccaatagaaataggatgcaagccacatatgtaattttgaattttctagaaaccacattatacaagtaaagagaaagatgaaattgtctttaataatatattttatttaacccattatagccaaaatattaaccactattaaaaattattgagatattctatgttttttttcatactctggatttcggtctgtattttatacttacagcacatttcaatttggactagccacatttcaggtgctcagcagcccgctgtggccagtggtgcccgtaatagacggtacagcactagatagtttgcctttctgttcgatatatgtttcatgtttacctccttggttttatgttttatcagtgggtttttcttttcaatagagaaatggattcttgatttagaattaggatatatttaggctctggattttttaaaaaaaattctgaaagtctgtttcatgacacttgaatggaattgtagacagttggactgtggaccttttccagacttagcatccttgttatgagagaggccttttcagtttgcactgagaagttactcttaccctgatgtgataatctaatacaaatttccaaactgcttacataaaaagcagcttgaatgtgaaaaatgttgtacacagtaggggtttgtttctctatggaaatgcttttcccttgaatgcctatatggtctagatttttccagcatttctgagatttgggtatcaaattggggtcattcgatgtctatttagaattttttaataatttcaaatctcatttgtgaaatattgcctgtggaaataaaagctagctgtattagtttcaaaatgtaccattagtccctggaaagatactctattaaaattagtgtacttcttttcccacaggctgtgctcttaatcatgtccttccaaagatgaataaatacagtgattatatttggtgactgtggaactgaaaatgaatacatgtattacttggcattcatgtagacaaatccttggtctcacaacacactgaatttactgttttttcctggaggacaggatagcttgtattcatctttgcatcttttagagtccttagcattatgcctggtacattgtttgctctcagtatgtctggtgaataggtgtatgaatgaatatatccatccttcacttaaagaataagggatgtgtgctgagtctagtagccagagcttttccatttccacatcctggcaatgaaaaataatcaaaatgcataaaggacagattacaaaagcagttgtgaggaaaatgttgttaagcttcaaaggaatagggtatttcaaggataaatatattaagaaagaaaacttaagtcaggtgatgggtgatataattcatatactaatgtattgaaaggctggagggtttctacttctacatctttggggaaaatattgaaaataggttcctgaaatatgtgagacactgtaagtgatttagacttttaagtcagctagaactggtggaataatgatattctttacttgtgtgtctaaacaatgaatgctaaagccagatcttgcttaaaagattcttaatcagggctgggcacagtagctcacgcctataatcccagcactttgggaggccgaggtgggcggatcacgagatcaggggatagagaccatcctggctaacacagtgaaactctgtctctactaaaaatacaaaaaagtagctgctcttggtggtgggcacctgtaatcccagctacttgggaggctgaggcaggagaatggcatgaacctgggaggcggagcttgcagtgagccaggatcatgccactgcactgcagcctgggcgacagagcgggactctgtctcaaaaaaaaaaaaaaaaaaaaacaccagattcttaatcataacaaatatagtatacatttaaaatgcatgtgtacatgtatattgagaattaagttaatggcacctcacgtgaatagtccctaaatactataaataaataccatacctaaatcctcagcatggcctttaagatccagcatgtggtggcccctgtgctttctgtctctcctagttccttctccctcttgttcactctgtggcctttagtttcttcaattcctcaagttctttgctgtatcaggagtttgtagcggctgtttccccttctcctggtagaatatgggccctcatctgccccttcttcgacaactgtcttctcaccatccctcctgtctcagcttatgtatctcgactctgagtggtgtcttctgagggccaagtcgaaatcatttctactccagttttatattttcatgctacctttatatcacatgagttcccctcaacaaatctcttgagaagttcctcacttagaataaaattgaaagcacttatgtgggttacaaagtcctgaggatctgagctcattccttatgttcctggctgtctccatctcgctccttctgagctagccttcctcaaacacacaggcactattgttcatggggcctggccagcccctttgcttcaatcacttcctctccatgtcttctcaaagccttcgctggggtctctgctcaaatgtcacctaatttgtgcagctttcctgaccatcttgtttaaaacatcagcccttctaacttcctaagccttttcttgttttacttttcttcagagcatttagcaccacttcagatgtacatttacttgttaaagtgttgcttgtcactgctaccgaaatgcagtgacgcagtgacttgagcacaggattgtttgtacactgcaaagagcccaattctattcttttattgcacttttcataatatttactttatgcaacttatgatttgttcactatactgcctttttccattattactctcctattttacattcttcacatagcagccagttccatccattaaagatgtaattcacatcttgtcactcctctgcttgtaactctccactggcttccattgcactgagaattatcctcagacttgttcctgcctcggggtctttgcacaggtgtttcttctgcctggaacactcttctccagctcctgttaatgtctgctgctcctcatcactccaccttcagtcagatgccgtctccctgtacagtcctttcctgcccccacccctattgaaaatagtttctcctcatccctctcatacctccttatattatttcctatcaacatttggaattatcttctaatttatctttttgtttattgttttcacatcactcccatttctcatatagaacgtaatctccagaagggtagaatcttgtctgtcttatttactattcgtaataatggaagtagtgccctcagtaaatatttattgaatgaatgctgttcatctcttccagtatattgtaaacatagtcattgaagacaaggactatgtctcttttactcctttatatatacccagttcctagcacagagtttggtgctagcgattgattaatttgcttaatgaatgaatcaaatcatgtgaagcatacataagctccatcttacgggagtagctaacttttcaggtaagtgtcgtggtctgcagacttttacagatcagtatcagagctgttctctgtgtaatatctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaagtatacaacagaacagccagaatctttattcagatattactatctccaaggcacattctgttttcaaaacaaaatgtcttatgctacaaagtcttaaactacaaagatacctccaggcttggtaagtgtggcaagtgtactctagggtgacttgtacaggttcacacccttatataatcccttcccgttgggtgtagatggaacctgtgacttgctgctaaccaataaatatggcaaaggtaatggaatcaactactcaccactcccttgatagtgattacattatatggccaaatcgatggtgcatcactcccatgaccaagtcacattatgtgagacagtcttagcagactaatacgagagacattcccttccttgtctagaagaagcacactgccatgttatgacagcccaaggagaggaccacatgtcaaggaactgggggtagtctctagaacctaagggtggccactggccaacagccagcgggaagccagagctctcaatcacactgccacagagaagtgaacagcccggactcaggaagacagcaacccacgtgagcctggatgcagacttctcccctctctggcctccacatggcaaagcagtctgactctacattgtttgcagcctggcgagaccctgagcataggactcaatttaggcatgcccagacttacttgcagaaactgtgaggtaatgtgtgttgtttgaagccactgagtttgtggtactttgttattctatgtagaaaactaatacagtgtggctgttcccagccagagctcctatttcaagcatacaactgtctgctggggccatcaggctatttgccctgtggctttaggctccttggataccttacattgaagtaggaggtagattgggaacacctgtcactgtcttttcagcttaagatgaggtctcctgaaccccccagggagtataggtcagtccagttccaccaaagactgaagatatctttgtgttttgaaacatgatagcaaagaacacttggcacagtgcctgacacttagtagggactcaagaaatattatgcaccttcctttcctggggtactgcagctcaacctagggcatctcagatgctaacccagcagttcctccctgggcaaggtctttagaaatcccactgcaggacccttcttacaataaggatatattatttaccaccaccctctatttgctctgaaaacctgagaaagcaaaggctgatgatgttagtacactgagggttgtgtatttttcagatttcacaaactgttttatgcccctgagggggacagttgcctgctttgccagggcactctgtgagacctgtgttggcaccttgcagcacccaatcttgaggtgggagatgtttgctgccccatgtcacaagttcttagggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactacaaaagaaacaacatagatgtgagtatatttacctaagttctcattacagtataactctttctgtcattttgtaattgttagtgtgcaaaacagcagagcacattggtatcagtgcagagagcatcagagggccacgtttcagacttgtagatgctctgagacttcacctaagaaaaccaggccataatatgcaataatcacatgttgccaaaatgaaatgcatgctaagatgctatttattacataaattttgttggaagtattaagccccaaatcttatttagtgtgatttgaggatttatactcatcttacaattgtaatctctatattagacttcacaaatttagttaaaataatttagaattaatttttcttatttttcatagtaaaacatgcataacatgaaattatcttaactatttttaagtatacatttcactggtattaaatacattcataatgttgcgtaatcaccaccaccatccatctccataactctttttgtcttgtaaaagtaaaactctatccccattaagtaataactccccctttcctacttcagccgctggctaccaccattctactttctggctctatgattttaattattctaatcacttcatgtaagtggaatcacatagcatttgtcttttttgtgacggctttatttcacttggcataatgtcccaaggtttacttatgtaatagtgtatataagaattgccttcctttttaaggctgaatagtattctgttgtgtgtaaatagtgcaatttttatatagattcacctgttgatagacaactgagttgctttcacattttagctattgtgaataatgcttctatgaccatgagtatacaaatatcactctgaaactctgctttcaattattttgggtagatatccagaaatggaattgctggaacttaagggaattctattttttatttctgaggtaccactgtgctctcttccacagcattttactttctcaccaacagtgcacaagggttcgagttactctacatccttgctaacgcttgttattttctggttttttgatgtttaccatccttatgagtgtgaggtggtatctcattgtagttttgatttgtaatgacctaatgattagtgaagttaaccacctttttatgtgctttttagccatttgtatgtcttctttggggaaatgtcaattcaagccttcgctcatttattaatccagttgtttgggttttttgttgcgttttaggagttctgtacatatcagatatgatttacaaatattttcccccattctgtgggttgcctttttactcagtttctagtgtcttttgatgcacacaatttcttaactttcgtgaagtccaattgtgtaattttttttgttgttgcatatgcctttggtatcatatccaggaattcattgccacatccagtgtcatgaagcttttgcctgtgttttcttctaagagttctagagttttagatcttacagctagctctttaatgtatttggagttaatttttgtatatagtattagaaaaaggtccaaattcatttttttgcatatagatccatttttcccagcaccattggttgaaaagactattatttctcgtgagtggtcttggtacctttgtcaaaaatcatttgaccgtgtatgcaagagtttatttctgggccctctgctctgttcccttggcctacatgtctgtctttatgacagtaccacactgtattaccatagctttgtagtgagttttcaaatcaggaggtgtgagtcttctagctttgtttttttaagattctttttgctatttggagtcccttgagattccatatgaattttagggtgggatttccatttctacaaaaaatgttactgagactttgatagggattgcattgaatctttagattgctttgaataatgttgacatcttaataatattaagtcttcgagttcatgaacatgggatgtatttccatttatatatgtcttttaaaatttctttcagcagtgtttggtagttttcattgttgaagtcttttacctccttggttaaattaattcctgagtattttattctttttgatactattgtaaatggaattaaccttttaatttccttttcagattgttcgttgtcagtgtatagaaatgcaactgatttttgtgtgttgactttgtgtcctgctactttgttgaattcatttattagttctgacagctttttgtgggaaatctttagagatttctatatgtaagatcatgtcatctgaaaatagataattttacttgtttacatccaatttggattcctttttcttaccaaattgccctggccagaactttcagtactgtgttgaatagatgtggtcacagtgggcatcattgtctcgttactgatcttagagtaaaagctttcagtctttcaccatttagtatgatgttcattgtgaggttttcatatatgacttgtaccatgttgaggtaatttcttcctattcctagcttattgtttttatcatgaaaaggtgttgaacttagtcaacacttattcctgcatcaattgagatgatcgtgtgtgtggtttttttttttactctattttgttaatgtgaggtattagatggacccatttttgtatattgaaccatatgcttgtatttcaggaacaaataccacttggtcatggggtataatttttaaaatatgctgttgaatttgctttgctagcattttgttgagaattttcacaacaatgatcgtaagagatattggtctgtagttgtcttgtagtgtctttgtctggctttgctatcaagataatgctgtcctcatagaatgagcaggaaattttccttcttcaattttttggaaaagtttgaggagagttggtgttagttcttcaaatatttggtagaagtcactggtgaagccatcagatcctaggcttgtttttgttgggagatttttgattactgattcaatcttcttactaatgataggtctgttcagattttctatttctttgtgagttagtcttggtaggttttgtgtttctaagagtttgtccatttcatttaggttatacagttcattgttgtgcagttgttcatagtactcttaataatcttatttacttgtgtagatcagaatgaatatccccactttttatttctgattttagtaatttgtgtcttttctctctgtttttttctagttcagctagctaaatgtttgtcaattttgttgatcttttccaagaacaaacttttaattttttccatcaattaaagacatccttggctcttgataggtgatgaaggggcaagtgtatttttagctgttggttgccatttcaacgaaatagccgtcaactgtaattttctccaaaagtgggaaaatagagaaaaaaactaacatttttctgtacttcattttccatctgtaaaatggagaaacaaaacccatctgttgtgttttgcaaggctggatgatgtgtacgcattatatatgtagtagataacttctgaaattatagttataggatgaaatctggttatggtcttcagtttttcaggtatttcagggctctttctaagtttctggaccagatagtagcaattaatgaatactactacaaattattcggcatttgtcctgctcaagatctctgctcctttgggtaatgaggcttggtttctataagacagatagggatgacaaaggaattaggtcactaaaagcagtgaaagacttcagaaaccatgtttcatgtctttggtcttccctgatggatgctaaagccattaggtttcccccaacagtcagaacacaaagatgtgacttggagtactgtggccacctgttctgcccaagtgcatcagctgtgttcatcaactcacaccaagggtgggggttggattctcttcttccctgttgtgatagacagatgccctgtcattatgtttttatgtgaaatttcacagtgaaagaaggaagccactcttgagaatacagcaatttaaatcaggttgtaatttttaaaaagtgatttacaaaaggtctttcccaaaatactgccatcataatcatctagggtggggagaaaaatagggtgcggagggcagaatcacccctcatccttgctcttccagcagggaacactcattttcacacccttgtgcctctgcagccccaccctttgttgaggtttgtgctgggcatgtacgttccacagagtctgctggtttccagtgtgacagaaatctcatttgtgataaaccttgattttgaattgtagtaaatgaaactttaaaaaaagcagacattaaaactccctgtttttttccctaggaaaaggagcattccatcttctggcatcactgtccttgggactaaacccccttagaaaacaccgcttttgcctagccctcagaggcttggtcccctgacattttacacttttccagaaaaagaatctcaggggctttcctacaaatgtctgtcacaacctcaacaacctcacaacctcaagtctgtcctattttagagacacacacacaaaaatgctataaaggaagtattaatacttgtttagagagattatcaggaacattgtacttaacagtgagaaatctgaataatgtgtatatgagtgtgttatgttattctttgtactttgcattttcaaaatgtcccatctttttttttttttttaagccaagaagtatgataatacttacctggccaccacagatgagaattgaagtgcaataaaacttgccacaagctgggaggaaccagcagtgtgctgctacaggcttaacaaccatctttctggaagaaaaaccttgatttgtagcatgagccagtttctgtgtctcacatggccattttcaagctaccagtgtgacatcactgaactgtgacttggaaaaagaggctcacacttggctcccctgagcagtgctggcctaactccagcacaccactggattgaactgccaagaaagagtagctcccacggatagggaggaagcaaatgctctgtaaatacctgtagacagaggcagggagacctttgtagaatggagagtgttagggaccttcctcttctttatttgggaaaatcttagattacatattcattggttgatctcatgcttgtgtgcttatggaaataaagcatttagtcagtaaaatattgttacccaaggactcaataaccatgcagtcaataaactgtatatatttttagaggcttctttcaaacataactttttaagatgactttattcaaaaagagtaaacccaggtggaatatttataaagataaaagcttcagaaatccatgtgaaatgaaaattatgtaataattggtttgctcacaaatatagtaattcagatagttttaaaaaattactttgatttaaagtttgttaaaataatcaagtttaaaaagaaagtatatgggttgagtgatatccctcccaaattcatttcattttcccccggaacctcagaatttgatctatgtcagctcaggctgccataacaaaatatcataaataatagaaatttattttcttgcagttctggaggttatatagtccaagatcaagttgcttgaccatgttttaatttctgatgagggctctcttcctggctggtagttagacgccttctcactatgtcctcatgtaaccttttcgtggtgcatgtgtgtggagggagagagattgttctctctcttcctctcttataaggttaccaatcctactggattaggactttgacctcctgacttcctttaattacttcctaaaagcactatctcaaaatacaattacattgggtattggggtttcagcatatgaatttggggaggacaaatagcagtcttcttaccttttttacattcatcacttaccaactctattcctttagcgtaggttgggctctcatccctatctttagttttatactagaggcagactagatatttatagcagaacccaccaactctaagaactttcctcttgtccatgacaatctgggagtgccatatttatacatttcagtatacctcttggttaacatacttccataacacaatttaccatactggtcatagcctccattttattgaatagttccataagtgccaggcacggtgctggatactctaaaacatcatttgtaatcctcacaataaacccagcaaggtagctttgattttctccattctgtagatgaagaaatccattcatttttttcagttatcttccacgtttactctaaggcagttctgagccctgggcatgtatgagtgaatgaggcaggcaaagcccctgccctcatggagcctatactctggaaggatgagactgatagagaataatacctaatgtcagatgtgatcagtgcagtgaattaaaatgaagagtaagagggggagagagtgaccgggtccaggaagttctcatgtatatgagaacaataaagtgccatgttggctgggggaggtcagagaggcaagagcagataggaccttgtcaccattgttgggactttgattcctaccctgaatgacgtgggaacacattaaagtgctttggggagaagagtgatgtgatctaaattacactaaataggactgtccttactcttctattgagagtagattatagggggcaagcgtggaagcagggaggccagcaggagcttattttaataatccaggctgtagatggtagtagcttagaccagagtgagaaacagtctgatcctagatgtgttttgaatgtagagctgaccgaatttgctgactaattgcatattaggcaagagagacatcaaagataactatgaagtctagtgcctgagcaagtggaagaatgaatggagttgtattcattaatattgagagtactataggaggagcaggtttgggatgatgatggaaaatctggagtttagtttgaatatgttaagtttgagaggcctacacatcctagtacagtcaagtaggtattagaatgccttagtctgtaatacagtgtaaagggctagcctgcagagatacatgagaatcatcagcttgccaactcaaggaggtgatacaattggccagacctgataagaggtgggacttcagggcccaggcttgcttgcttatatccccaaggccccttggacacatgcttggtggcctaacccactggatagtccaaatcatcaagatagagatggggtccttaaatctatggttttaaaatgttttctgagtaattctgatatgcatcaggttgaccaccactagtaaaagcctttagacaaggattttgttttttggagacttaggggtttccatctgaaactttgagtcccacaggaaatttgacggaatgggaaagagaatgggtttgggagtggctcagacctgagcctgaatccaatcttttcctgttagtaactatgagagctcggataggctttccaggctctctgaggttccatatcctttctttatagatgcagcccatccctctttctgcaaataggagtaattgaaccaaacccacagagttgtgaagattaaggtaaattgtttgtataaagctcctggcttagagtagacaccaattaaaagctaatctcacctgccacatataaaaccactggaagaaaactgttcttgaattttgtttcatcttcatttgggggcaattatcttctgcttctttctgttatctaatggcctagccttcaagatttcagatgttgtcagataagttggttttctttaccccccaccaccatcctttgagcccaagaccgatttgcttggttgtctgctatacaaccacatggatattgttagactttgtgtttctgcagttgaagtacttacacacttccactctaaaatcttctctttgtcctgtgttctttatctcacatttgtatcatcacctcccacgttttcagtctagagacgaacacagtggttctcaaccttggctgcacattagaatcgcctttgggattttaaaaactgccgtgtccagaccacatgccaaaccaattacatcagaatgtttaggagtgaaatttctgaatttgttattgatctgtaacatacaaaaagtacaacacatatatcataagtatattgctcaatgaactattataaacttctgtttaaaggtacatggttcaagaaactgaacattgtcaacatcccaaaacctccttccacagatcctagctgcccttacctttaatactatacatttttatctgtcttgtaactgaaatatgatcatagaacatgtattcttttgatctggcttattttgttcatctttctatttgtcctacttctttcattctcattgctctgtagaattcccttgtgagaacatagcacagtttacttgtccattttctccactgatgagcatttaggtgtttgcattttctagatattttgaatagcacagttttttttttaaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccatagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttcaactagtttacagtcccaccaacagtgtaaaagtgttcctatttctccacatcctctccagcacctgttgtttcctgactttttaatgattgccattctaactggtgtgagaggatatctcatagtggttttgatttgcatttctctgatggccagtgatgatgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgctttgtacatgtctgttatgcatgtacacatttctgatggatatacacctagaagtggagttactgggttgcagggtatgtgtctattcagctttagtaaacactaccaaattgttgtccagaattttctaccaatttatcctcctaccagcagtatttgagagttctggttgttccaaactctgaacacttgatctatctctgttttgtatactttactcagattctccaggtacctagaatggcctttcccaggtctctccctttacggttcactctttcagaaagcccagctcgagcatcatctgttcattagccttcccagccttactctttcaggtggaatttgttactgtgtcttctgcagtgtaaatattaatacattacagcctcacccacactctgcctcacagcagtgagtgagcactctgactctccacctggataataagctttttaagagcagaggctgcacctcacttctttcagagtccccctagacatagcacttgcacattataggtgcttcatgaatatttcttttgctcactttatcacagagaaaatcttttaaaaatagatttttggtaaatgactatattcaaccaggcagtgaaacttcacatttcttctgtatagggaatgcataattgtttccagtgtaacctccttattgattttaatcaatttaatcttttttaaactccttggtgtgggactcgtgatttggtgtaggactcatgatttagcttgggaactctctttttcggggaaaataagagccttttttctgattctgtgagagcacgtgatcactttttgtcatcctcacatagagcagattttcatggcataatttaagaaggaagtgcttccaaagagccagattcctaagggaagattggagtgaatgatggtaaaccatatagctttttagcctacctgagaagtggaactgtactcttctgtactttacgaaatggagtcaggagaaatgaaaagactcagtggtagccttggaatccttaacatttaattagtgtgaaggaaaagcaggcctggtgccaaggagacctgctctcaaaccatcctatgagaccacagagtgagtggtgtgatcagattgtatcagcagcctctagtgccattccaaagcacagtgggcggtcatggtacttctgaacaggaaagctttacctaagggtttgaaaaaatgatgtatacagaagcattttataaaaaattaaaatgtttaaatgaagtaattcagtacacagtggggaagagcaaggaaaaactggaagccacaggcacctctgcatctttctgtcaccctctctaacgcacgccagccttcatagtattagggctgctgcttcaacttcacctcccaaatcttgcgcaacctcactttggaccaattctgatttttgtccatggaaacacgcaaggaagggactctgggcagtgcagttctctgtgcaaccaagttgtcagtagagcattccagaacacacacacagacaggggagcctggaaggaggaaagaaagaatattttccccagtatccagtgcctgttgtgttgtctgtgctggtttttgctgtttatcattgaacactgataacagtcttacaaatgagagatttctcagggattcacagctaactagcaagatttatagcctggatttttagctatgtctgtatgtgctcaaagctaatgttcattttaatggactctgctgttttccatggaaagcaagacctagtggttttcctgtttgtttgtttggattaggaaataaaaactaagatttagcagaagtactgagtttacagcatcctcagctagttgccacactagataagtagctgtaggacagaccaggcagtgactcacatggacactgcttttaggtcagaggaaaataactcaggcagggctagcagagcttccattttattctcagcagagcttagatctccctttggctgttcccagaattagaaagctcgtcagggatgctacagattatgctttagagttgggagttaagactgagcctcaactgcccccatttgtcttccttaaaagacagcataaattttaaggtcaaaaaagaaactactcattttagcagaggacaaaacagtggagcccttttgggaataggtcagccttttatggtcatcctaattttgcttcctgctgttttaattcacccaatacatttccttctgggaatcacctagaagtagattcatgggtttgaaggagaggagttaggtatgtttagaagagaagggacacagatctctaagggcacatacaacttggtaaagcaatccaggttgagagtatataataggaatttgagtgctttaaatttgtattttccaggctcactctcagtttcttaaagtactgcttcaaacaatcatttaaagataattatgttaacatttaaagatggttaatttggaggtctgatgatatttttaataacacagaagtttcattaacccaagattcttaatatgtaataaatttgtgaatgaacttaaaagctagtctcttcagatatgtgaattaataggctttttttaatcatttgaagtagataagctagtagaaaatggctttcttcctccttcttatgaaaatatagaacatatccaagatactcttagtaaaagaataaagctcttcataattgaacaacattcaaaatgatgtgtttgaaaatcagccacagtgtattaaactgtttagaattacttacctggagacagcccttaatagagccaagatataagcacttaccacatccagcttttataaaaggaatgcatccttaaatgtaaaatggcctgaataggatttgtagggattaactcatgtgtggtttcattactctgtttctcctttccttctattcattctgtgtgttttaggtgttgtttattttatttgcactgttttcattttattcgtgctgtcattcttcagtgtccccctagtaccatgatatcagccatgataatatttatcatacttgttgccactgtttatcttactcctcactatattgtgagcaccttgagggctgggactgtgtccttcctggatctcagatatgactcactgcagaaaataatgatattgttcccttaaaaatgattctgtggcattttctctttttaaaaaagagacaggctcttgctgtgtcacccagagtggagtggcaccatcatagctcactaccgcctcaaactcctggccttgagcaatctttccacgtcagcttccctagtaattgagactacaggtgggcaccaccatgccctgctaacttttaaatttttctgtagaaatggggtcttgctatgttgccttgctggtctcaaactcctggcctcaaatgatcctcctgctttgggcaccaaaggtgctgggattataggcataagccaccacacttagcctgcattttctatttttcaaacttaacatatgatcccttttatatgaaaaagcaaataagaaatgaattttatattttttccagtcaccaccagcctttacatgtgctgttagcctaactgctacatactgtttggatctaaacttaaagatacttccctccaggaatcctttgcgatgcccctccccaactgatgaggacagtgccgcatatctgggactctcctcaatcccccatcaaggcacttggcatatttacttcactctaattaattttaaaatagactctaccctcagttcattataaactttgtgaaagcagggaccataattgtcgtgctcattgtaatatccctgggacagggttgcaggatgtgctctcctgataacttttctcatctctattcaatgcctctaagactcaaagtttaaataaaagccttgtgaaataaatgtcaagattgtcagccactgaatgctggaagtaccttaagctgtgattctatctggggtttccattgaagatgggatttggggtatagtcctaggttaatgtgtaatcccaactctaattttgaacctgaggaacctaggtatcctagcatcaattaagtcataggctttaacaatttttttaataaagctgtttttgccactaacactggaattggtttctaggcaacttcttttataaaaacaaaaacaaagaaagagaaattgaaatgttctctttgaggcacaaaactaattttctctagttatgtgctggagaagtgattaagtcttttaaatgaacacagtatttttgctcttcatgggtctgtttaccatcagaatcttagttgagaaatgattttgaaaatagttctgtttcatacatggtataagtgaaacaaggcataaggcccactctgcaggaatttaccattggttccttattttaatccttagactcctagaattgaactataaaactagaataaaatttagagatcatcacataattcgagagtttgtaaaaagctctccatggaagcacccagctccacagagtcactgcaggggccaccacagtgaagggaggatggggaagggcacacagtgatagaatttgagcgtgtaatcctgcttcatccagaacagaattgctgtaattcattttaagatcttaagggaaagggagagtttagtgctttaaaaaagtggttgataagactgactgacggagagaacactggagcgtactgaaggtacacttatcagtagctgagctactttgtaggctgctctgagacctgatcctccatccagccctatttccgcagtgtcacattgcctactctgaaagcttgttctctcttcaccttcagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggtaacaagtgcttcctcacattgtaattctttcatttgtccatggggattttggtgctggtaagaaattctgtagggaatcggtcaaatcattttatattttggttttcagttttagatcctacacacatgggccaaaaatttgttttcagaattatttcatccgctctaatgtgatttatcttacaagttttcttcccaccccccccactataagacctcagtctttacaacagctttggttgacatatccagatgcctccttggcactttctattgggtgtttctggcagtcattgagtattgaagcagagtgagcaggcacagtcagcatgattcaaagccctccctgcctcatggcctttttcatagatctttgctcacttgtatatggtacctagttctactgcccaaggtgagacatgatttattccttcaccctgtctcccccaaaactcagctaccacacccaacatcttctattttcacccccttgtgatgtgggatctccttcctggttgaacccggctatttctggtacttgcttctgctaatagatttgccttaagctagtcccacattagggaaagctggtacttacaagagagggcagggagcttcctaaattgcttcttaaaggaaaaagtaactgttccattcttgatgagaggtatttaccctcttagggggcattgagtctgttgcctggagtgaactgaagatacctattctctcttgtctgttgtctttagaagacaagtggtaatcctttgggttttcatctgtgaagggccctgttattgcgagtgcatttcatctttattctgtaacatgaaagagctttattctctcctaggcccagcacttggtgaggtcggggaggccatgcgggaactgtcggaggtcaaagactctttggacatagaagtgaagcagaacttcattgaccctcttcagaatcttcatgacaaagatcttagggaaattcaagtatgtacaatgagtcttctggaaagtgggcagttgaaatcatacagatgcagatgccttttttctttagaaaacatttttttagcttaccctgtgtgttgtcagctctgggcacgttaattacaaaacaacccagtaagacaaaatgagagaaaccagaaatgtgatacttttcagcctgttatgactgtgccactcatgagggctgtctctggcttctctatgtttgattttcatattgaatagtttttttcagactttttctccagaggataatatacttttcctgagaatacacagttttgttaattattctatggtttgctgggctgatttcacccactaaaatgttagttgtactagttgttagcttaaataaatagttattctatcactgcataagcacatatttttatttttttccaagtctagaaattagatggatgttatgtgtttttatattaatattttcataatggttgttaggattgaggaagaataccaactagccactttttaaaacatgtagagcagttgagctgtttataataaagttcatatgtctttgagtgtggaatgtttgctcacttttttttatctaacaaatatttgttgagcttttttgaaactttgttgggtgtaaaatggattgccataacttgaactagggcctcctcctccttattctagcttaaatctcctttagcagtaccatttgctcaagattatagagttagtaagtgacagactgaccctaaatccaaaatagaactctgactccaatgctgtaccctatagctcaaatgtttaaaaaagaaagttccttccaaatgagcatttagtttttggatcagggcatggactgaggggcgggggatgcagtgtgagggaaggtttagaatattattcttcctcctttccttttcatttttttaactactccctactttgttttcatttcctttcattctgctccatacatactagtaacaagggaaaatccaggattttccttcatccattagtagtgaaagactagctatcggggaaaaacaatactttttagctttggaaaactactttgctacctggtcactagagatgatgggtggagcctgggcagccatctaccaggtatggtgcaaggaggggattgaagctcagcatggagcattagatataatcccttggtaggtcccttccaagtgagattttgttcttgagttcaattatatgtcaagtgggaggcttaaactaaatcactggatttagtttctctggtgacagctgcatcagtcagctggggcaagtgttaagatgtagattcctaggcccccaccctagatatcgattcaagagctcaggaatccatattgtgatgagcaacttacgtgattctaacagactggatgatttgaaaagcaagactgccatttctatctcacttaatttcaaggaaagagtttttcctctggcttctcatgagataccatttctcttgaagacagggcctgtggggcctgtgagtgtgtcctttcattgtgtgtagggcatgtgcattccttctctgtttctgtcatgggctgcaaaggcttagtccagcttggctttggcctgacaaggccagaaaataaagggcactgatatttcctataatttatcttttattcttaattatttttaaagatattcccccatatttagcctttgaaagcactggccccattgatgcatgtttctttatttctctggtggcgttgtattttaaaacttagcctatcttaatttggaagttaatggacgtgatggagaagtgagctcaaataagccttttccataagccctttcaaagcctattcctgcccttgacttttgcagcatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatgtaagtgactcctgtggttttcaatttaatcttatcatcgaggcacaacattaatatgttaaaggccataacccttaaaagcattaatatctgattacactatgtgataagaacttcagtagatagttatttattttaaataattgtcagtcataaagtagactgagaaatagaaaagtttcttctgcattcctgtagtttaactagattctcgactgctaatgaatcttaaagtacagatgctccttaacttatgatggggttaaagtcttgaatatatcatgtaatttatcgaataatgcattaaaagtaaaaaacagaatggttgtaagggtacttgaggtatggtttctactgagcacatatcaattttgcaccatcataaagcctacaaatcgtaaagtcagggaccatctctcttatcaatagtgggaagataaaggatatttctgaggatctatgtataactcaatagaggcctgagaactcagttgtggagcagggggcatcagtagtactggtgcaagtcccagagtccaaaggccagaaagcctagagctgtgacatccaaagacaggagcgtatgggtgtcccttcgctagaagagagagagaacaaacttgcctttcctctgctttttattctatctgggtcctgagctgagtgggtggtctccacccccatagggaagggcagctcttcctttgtttagtctactaagtgaatgccagtctcctctggaaacaccctaacagacacacccagaaataatgctttaccagctatctggggatcccttaatctagtcaagttgtcacctaaaattaaccatcacattgcctacttgccttactcctgactgtggcaggggaagtgtgttgaacatatccagactttcctaccacctggagacagtgtaggtttttgtttatgtaaaacaacttgtgtccacctaactcctcgagaggaatactgtgtgcatgaggggtgctccaaatcacagtgctccttccctgcaacacagcacccctccccatccccaaattcatgggacaacactgcttctgttgacttggaggctgctacccagctggatcataatgtgaaacataaaatcaagagaaatcaagcttagaatattagagcaagaatgaactcaagatgtcacttgatttaacccttttacattacagatgaggctcagagagcacagaagattttctgtcataccatgtcgcctctccgggtacattatgtgagatattgtcacatttttattaacagtaccgatattaacagcatgaaaagtataaggaacaaagagtcctttggccagtgtaccttcttttctatagaataaaagaagtcaaatcccagatacaagattgtagctaagcatgagactctttagagctatatggtcttcctgagggttacccatgttgcttctcctcatggtactgatacgcatgattctaagcataaggatgctttcttttatccttgatggatttgaaacctgcagaactatctatcttagttggcttatcacacagtcatcagcaccaccaaccaggggctgtgtgttgagggcagccctggtgtatgtatgaaacagtagtggctgtttagggatggtaacgtgtaaaactaaggcatgattttcccatcaatctgcagattgaacaagtgagccagctctctgcacttgtgcaagctcagctggagtaccacaagcaggcagtccagatcctgcagcaagtcacggtcagactggaagaaaggtattctacagttccctgcatttcacatttgcattttattgctataaaatgatgtataaagaaatggaaatcatagaatacatttggagacaaacgtctgccaaaattccgcttatcctacagaggcgccttgtggattgttttgattttgttttttcttgtgctttgttttacgttgttctgttgaatctaattttctgcttatgagagatcgatacttggattatattttggctgccacaggtggaacaccaggatgctactgctgataatggatgccatttgctgagcagttattccatgtgggtactggatacatatcatcatcaatcttataacagccctgtaacctaagtgtttttagcctcgactaacagatgagtaaactgaggctaagagaggtgaagtaactagcccagggtcactcagtggtgcaagtggagttcacagccagccataacctgtgtgagaggctgtttcttttcacatcttgtgtttctctgaatggcggtcaagtcctctgccatcagagagagctactttcacctcattagatgtacctcacagcagggctgtagtagtaggaaactaccgtgtgaatgtggctccgtggagttgtggggcacagcctgtttggctatataccagtggccctatgttataatatgtgttattttaatttagccagattaaacaggatgattttgctgaacatgtatacctcaaagggtcacctcagcaagcttttttcttaggccacatggccagattagactctcacagctgatcacatggctgcctgcgtgaagaagacaccaatcatacgattccacacctgttttcgttgttttccctcaggctgatctcatttcagtattttctttgattcatggtttaattgagcattttccttcggcgcagccttatggaaatttatgtaatgctgaagcctccagaaaggttttaaaaccatatacttcaaagatactaaagaaatactatgtgtctttgtaatgtctcttgagcatgaagggagccctttcctttttttcctctgaaatatgttcaaagtcagtatcattctacagttaccataccctaaaccctcgccctcccttgcatatctcttacatactttgtttattgaataactgaaactttggaaaatatttaggggtatgtagaagacaattattagccatacctttccaatttccttttgtcttccctctttcctttcctcctccctatatttcaaactgctcattcttctaagagcacacagtatatttcctccttccctctgtccaaaccttctcatgttctgaatagaatagctccctttcacattttcatctggaaacagctcctgtgtatcttttagttctctccttaaacctcctccagcttccttatggagagatagactccttcccaccttcacccacaaccacacccctgtgttcctgtggcactttgtagatatctctgacagtgcttactaaaatttatagtaatcagttgtttgtgttctgtctcccttacagaccataatctgtttgtgtcttttttaaaattgaaaaaattgtgggtacataggtgtatatatttatgagatacatgaggtgttttgatagaggcatgcaatgcataataatcatatcatggagaatggggtatgcatcccctcaagcatttatcctttgtgtacaagaactgtgttttaattcatttttgtgttcctggtacctagcacagtgcgtatttggataaaggactctgaataaatgagagaggaagtgagggattgagagagagaatgaagacagtgaggacatggccccataaagggacatcaccaaaatctcagacatatacatacaagaaaactaagggtccttttttgatttcccacacttcatcatggtagcatggtgggtgacccaagcatttcctgaatctttatatttgcttttcattttacttcttaactggttacataacctttccaccacttttctttttactgcagaataagacaggcttcatctcagcctagaagggaatatcaacctaaaccacgaatgagcctggagtttccaactggagacagtactcagcccaatgggggtctctcccacacaggcactcccaaaccttcaggtaagagctgaaactgcagatcctattgcatagcccttggcatatccattggcactcttccagaaattttaggaatagtccaatctggctgcataggaaatatgcagtaatacatttcttatggagtcagttgtcaggtagaaactctgttaaaggaatccttttgtctttttttcatttaccttttctttccttccttctcattcttctctataaaactttctttgtatatcccattttctctgtcaatcatcagcacacacgaacacattttgttttgaccctcctttgtggtcgtaaatcgcctttccttgtcagtttggtctgcgagtgtcatcttttctcctgcgtgttcgctctgaatccagcctgtatgacagtgaatgcccctggacagtgtgtccccatatgcattcgcatataacccacagacagcaagcggctccagaaatgtgctgatgagctggatttcttgagtcacagaagcatatggttaaatatatttgtagaagaagatattttgaaactcgacacttgctgggttttccttcccatgcctcacctctgatcactttatcatgctgtggcactggggttgatataataaaagctagatgacattttatctcaggaatatcgatgcataccaaatagagcatcctttaccttgtcacacttgctctccactcctacacgcagattacacaacagcctgtgctggagacattttcaacctccacatttgcttgtttgaagtgggaactgtcttatactggatgtggatgttagagataggtagctttcttttatttttcctgtatccccagtgcttgatgttctactgtagaaaactttttataagatgctctcaggagacttactaagaaaaaaagcgaggtctgagccggcaggtggtgctctctgtcctttgcgctcagcacttcagggcatgacataagcagctgtggctcctggagctggccaccaggactagtcacagaaattgtgtatagctatgcttctccctgtctgaaaaccaaccatatatttcacttttcatctggagactcagtaatttgcttctttctctaaataaaaaaataaattacattgtttcctttccagccacctagatggcatgggaactgtgtgcacttgtctgagtctgtatctacatgtgtatgtatgtagtattaatacagcgggtcatttggaatagatccctcttaagatatgatttcatccttcattattttactcaaggtggagtacattatttttgtatgccatagctccagtgcactgcatatatttatgtatgcaacagtttaccttaccaagtataaattacaaaattttttacataatctcatttagtagccacagtagtaatgtgaagtaagtcctactgttacatccaatttcagacagtgaaactgagagcgaagtaccatgtgcaaggtcacagaaagtaaaaacttgaactcagtgttttatattattccgttttcaccacattacagcagttttccagaggctggggttatcattttaaagagtgataaccgaactgttacttaaaagcattctccatgtaattcaccatactttttcagatatgcaaaggttttaaagtgctcagatgagagaattcttgccatgctgtgttattaacctacatcattatattcttcttaagtcattgtccctcctatttctgggcattatcacgaaggcaaactataatgaactgtgttgtatgtatcacaagaatagatgtgactgtttttcatactggaaacagaaacaggaatatgcagcaacttccaaaggtccgagaaagcttctgaggattggtagagggcaagatgcccagtgcagtggacactaaggtccagtagcaagaagaagcttcaacaggaagaggaatgagggaggaaagacggggagcagcaagccaggtgggtacagcaggcagcagattctgtgagttaaataccccttatccttttgtgttcttctcttctctcctgctcttactcccaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaccaaaggctctgctccttcattttgtgtcagttctttgggtctaacactgggtggatgggggctggtttcagtctccattgctttctcatgcagccaaacaagacctggctccaacttcatatctacctctttacacgtaggaaaagtttcagcagcaaggaagtagctagcctggacattgggaccttcctggtaaccccaggaaggaggagaatttgggagagaagaaagtaaggagaattaggtctcatagatgttaaatgatatattgttaaaagtggtatcatctgaagaatataatgttaggaaggggaaataaaatatatcccttcgagtagcctcttattttctttcgtaattgaagataaagaaatagacatggaaaaatagtttgatcgaaagtcactattaggccaggtgcagtggctcacacctgtaatcccagcactttgagaggccagtgcaggtggatcaactgaggtcaggagttcgagaccagcctggccaacatggaaaaatctcgtctctgctaaaaatacaaaaatcagctgggcatggtggtgcatgcctgtagtctcagctactcagaagactgaggcacgagaatcacttgaacctgggaggcagaggttgcagtaagccgagatcacgccacagcactccagcctagggtgacagagtaagatgctgcctccaaaaaaaaaaaaaaaaaaaaaaaaaagccagtattattttctcttgatgtatatgtttggggtgtgagtgggaataggggagcagcaaggcacacaaaatgtgtattttctgagttcccaggaaaataaacatgttctttgtgtattaggggccatttctattattttgtgctgaggccaatagtccagattttctaatctaacatgaatagttgtaattaaatatactaagtttctgttagtccattttcatactgctatgaagaaatacccgagactgggtaatttataaaggaagaggtttaatggactcgcagttccacttggctggggaggcctcacaatcatggtggaaggtgaaggaggaacaaatgtacgtcttatatggtgacaggcaagagagcatgtgcagggaaattgccttttatgaaaccatcagatctcatgagacttattcactatcacgagaacagcatgggaaaacccacccccatgattcaattaccaattacctcccacctggtccctcccacaacatgtggggattatgggaactacaattgaagatgagatttgtgtggagacacagccaaacgatatcaaagttctatatgtgaactagtctaacgtgaaaatatttttttctagctgtatgagttctagagtattacagatcagttctctaaagcaattttaagaaataccaatgatattgtgactatagaaaatcataaagaatccaaagataaactattagaaaaatcagtgaatttaataggatcactagatatgaggaatatacaaaaatctatttctatatatcaatagcaatcagaaaaaatgtaatttaaaaaaatgtcattcacaaaggcatcagaaatcaaaaccagccgggcccggtggctcacgcctgtaatcccagcacttttggaggccgaggcgggtggatcacgaggtcaggagatcgagatcatcctcgctaacacagtgaaaccctatctgtactaaaaatacaaaaaattagccgggtgtggtggcgagtgcctgcagttgcagctactcaggaggctgaggtaggagaatggcctgaacccaggaggcggagcttgcaatgagccaagatcacgccactacactccagcctgggtgacagagcgagactccgtctcaaaaaaaaaaaaaaaaaatcaaaaccatagatacaaatctaacaagattgtacctgatctctgcatagaaaattatggaacatatttgagaaagcaattgaaagatattctgtgtttttagattggaaaactc

SEQ ID NO: 12174 - DNA, 153642 bp, Human
  misc_feature (1)...(153642): n = A,T,C or G
ggtttggaaaattcaactggccacagaggatgacagttttgtctgaccaaggagggaaagggcaaatagcttgattctggaataacaaatttgaagtcaatttcactttaccactgtgtatggctgagcagacagaggtcagcttcaggataagaccgagttcaagtcctgcttctatcacttctgtgctgtggcctcaggcatgagtctgggtgggttacagagaggaagcagtaacagctctcaggccttccctgtccaaatgtctcagattgaaatctgagtttgacctctacttccagcgtggccagaactatgatgtgatcaaaagagcccctggccttgctgtctgccctcacagttcccactgttactacaggatatgggaaaaacagactcccccaaagcacatctataacagacagacagcaaatgcagattattgatttgggctattgttttagtaaatcaacattcttagagaatttctcagctctcaggtgcccacatcttagagttaagtcacattttgagggttgcccaggcaaattcaaagcagcaccaggccctagtggcagctacttcatctttaggcagcatttccctctcaacagggagcatgccacctcccctgggtgcagatcccaggaaaagttacactgaccaaatcaggccactccctgggactgtttcctcaattttggttaataatcaaaggatgatctgaaatcgcaaagaagagactcttggaaaagacataattatggtgccacccgacttaggaactggcatccaagtccacctgtgtgactttcctctgggcctcagtttctccatctgtaaaatgaggtcctgtatttattttttgagacggaatctccctctgtcgcccaggctggagtgaagtggtgtgatctcggctcactgcaacctctgcctcccaggttcaagcaattctctgcctcagccttccgagtagctgctgggattacaggtacccgccaccacacccggctaatttttgtatttttagtagagacggggtttcaccatcttggccaggctggtattaaactcctgacctcgtgatccacccgcctcggcctcccaaagtgctgggattacaggcgtgagacaccgcacccggccgaggtcctgtattaaatggatccttgccagctcctacaacataaggcattaaatgttcccacaacttgctccccgccggctggcagcgaacagggctaaagcctcgacttcctcagaggtgaaaaggtaagcaaacattccgacctcccctagccttgctctcggattggtgctgggcccggctcccaccgcctatcccgaccacatccgtcatctggactgctaatacactcattagcataaagattcctccgaagacctggcgcacggggctgaaccggagtctgtccctttaaggaagagggacagccactctgtccctaagggcactaggcactgcatttcctccacacgggccacgctgtaaactagacaggttccgtgttaatccactctccctcctcaaccccgacagggggatccctggagtgaacaacgcgcggggtcccgggggactgcggaaaggtttggcctctgcgcgtagcaggctccgccaggcaacctctcgcccgaggcggcggcgagctgcaagctaggtggagccggctgcgcggcgggaccccagcgccctggggcaagaccctggtgctggcgccagggcagccgcgggaggtggcttgtgcaggagcggagaggtgcgcccaccccggccccgggcgcgaggggggcggggcttgggccgcggcccggggccaggctcgcggggatgggcggtgctgggtctgcgggagcgggcggggggcggggcgcgcgagcgggctccgggggggcggggcggcggcgcggggcgggctctggcggcctgagtgtcacacacgcggcggctcgggaggcggcggcagtggcagcaacaggcgccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcagccgccggagccagagagctgccggcaggaggcggcggcggcaagaacttgaacttggcgtcgggagcgggcgccccggacgccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccttcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtaaggtgccccttggcctcttcccgaggttccagagccacggtgcgcacggggaaaccgaggcacccgccgctctggtgttgagtctctacttcagcttcggcctaggaccctgggtcggggctggcgtgctgcttcccgcttctgcctcctcccgcgcccttttcctgggaccggcggcctcctgaccccacctctttcgccgctgcttccagaacgtcccctctgagcgagagcgcccggcccagccttgccccaggaagacggacccagtcagtccttctggctgccaaggagtaaagtcagagtcagagctgtctaggacttcgaagagctttgactcctgacaccccttatcccagcctccaccctccgctcacgctgtaggtgggaaactgaggtccagagcaaggaagggactcgcccaatattacacagctttcttggtggcagatccggaccggctgtctccagcgtgtatatgtaaatctctcgcggctgccctgcccggccctgccctgccccacccccagctctaggtttccaaatccgggctgcctggtaccggagctgctccgggaacctccacgcgtgcttttccggttgaaatgcgctgcctgcaagagcgctcctcatcgaacccgtcagttcctcccgctgcgcgcgggagggggtcagcctatcaggcccggctggaaggagaccccacccctcctatcctcacctgcttccttcctgacctcacccctaccccataaggtcccaggaacacggggggactttgtgacagcccccttcctaacgcattaggccacctagattcctccctttgaagcagacgagttaattacagccagactaggtcccctcctcccccttcacactcctgtgaagccctcccttcccccataaaataatacttgttctgtcttctggtggaaggcagtgttttgattaaatctgaggcccggtgggagagctccttccttctcagcgccctggtgcgtggctgttgttctccccaccttcttcccccaaaggtaaacctttgcccaggcctgggctgggggagactgattaagagtctgagttccttttaggactggatgtccagacaggagggagacaggctcttacctgccatctggtgcttggaaagggatcttttttgtttgccaggagagaggaggaagggaatgtccctctagtttttctgcctggcctcccctccccgaggtccccagaatatcccctcccctgtttgatctgcatgggcagtccgtggaagatcccacctctccctggaggcagtttggggcacccctcggaagcttggactctgggtttctaaagcacctaggatgccacacctagatgacgactagctgggagccaggtggctacctaggagctgctttgggagagggggcagatttccctgggagccaccaggaccctgggcctgtgtttggtcagtgagggaaacaccagataggctccgtgcagtcttatgcatggctgaagcttggcttggtgcaggcactggggaaacctggaggtcttgtatataaaaggcacgagagggtcacggctaactgcactggactttatgcatcctccttgttaccctgcagccacaccccaggtgggcagatctcctttctcttccactgctagtggttcaaaacttcagtaaacattttttcccagttacagttaagactgtttcaaacactaaggaatgatttgttttatagccaggatgtcaagatatttaagacttgactcttttcatcaccagatatttcttacgggtcttctctgtgtcctcccctgctgggtgctggagcagggaccctctgcagcgaatgctatgacagaggccatagtggcgtgatggtgatgagtgctatgatgagacctcgtgttacagggttacaggagggatgaagggcaagggagaggttggggggtgtggcatcgaggagtgcaccttggaggcagggccattattgtgagggaggggtggtcaccatggttggctggagaagaaccctgtgcttcagggaactgcaggtgaagtcccttgtggctgaaattgagaggttaagagttgggcagggcctgagtcagggaggaccttgtaggctaagcacagagggggcctgtgaagggatttagctgcgagagtgttgtgatcagatatggttttttagaagatctctctgggttacttttcacctactaggttgtgactgcgagacctttgatcttttgagaagttgtccagatgttctttctacccaggagggaggaggcagccagggaggctcagcaggacgttatagtgcagcgatcctcaaactttagtgcacctatagggctggttacaacagattgctggggcccatcctgcagcgtctgattgagcatgcctggtgggggacctgagtgtttgcattccatcatttcccaggttgaggggaaatggctgagggtcctgggaccatggtttgaaaaccactcatgcaacagtggcttctccttaactgtccctctgggtcttctggtcagggcagccttgggatgcagagactctggatgcccttgtttctgccatctgtgtgtggctacctcctgatcctgggccagcacccctccacctccaccccatcaggcagtcaggaagcagttgttttcacattatttccagccagacagcttttgggaggccaggcacactgtagatccggccttccttctgcccctcactcatggatccaggaaaaccacttctggcacctcatttagtctttatctattgttagaggtctcactctgtcacctaggctggagtgcagttatggctcactgcagcctcaacctcccagcctcaagcaatcctcccgccttagcctcctgagtaactggggccatgtactgtcacgcctggctaattttttttatttgtagagaggaggtctctctgtgttgcccaggctcctgggctcaagcaatcctcctgccttggcctcccaaagtgctgggattacaagtgagaaccacggcaccctgccaacttttccatttagaattatttggaagagaaactagccttactctactggtttctcccctaacatagcccactttttccagcatttactttgtactcagagatgtcttggtacaagtgtgagtgaggaggggaggtagtgaaggatgcaggagacttgtccatgatctctggcctgagctcctggaggagattgacaggaatttcatcctttgtttcccagtgtttttatcttgaagaatttgggaagttcatcacctagaaggtggctttgagctggatctagggttggaagtggaatctcagctcaggggagagggtgactgcacgctgcaggagtgcttatgtgtcagggtgtgtatatgtaagtgtatacatgtgtgtgaacatagacgtgtgtgtatgtgtataaaatctcaatgtgaggcctgttcttggaaagcagcactttcatgcagctgggccttgtttggggaatgagagatgacagtgtgagagaggtaggggcttgaagttggaccccacaggggagaccttgaaggttgttgagccagggaagggatgtactcagagccatggtggaggggcatccaggctataaacagctgccaaaatctggggaaaataggatcaaagttaggggacagttgtagttctggtgagagacggtgaggtcccgagctcctgggatgagaaaacgaaactggaataggtagacacagtattccttcaagttgtgctttatgaaaaaaaaaaaaaatgatgacaaaagaggccagttactttggtaggtctccttttgtgcagccaaacaggtctcatccagttatattttctgctgaagtcttgtttcttttattataattaaataaatgttgtttccaccacaactaagtcaggagcatcatgacatcagttttcccaggttttaaatacatactaatgtgtaccaacactttatattttgtcagcatccagagttgagttaaataacactttttccatagttacagaataaataatatcatgtctaactttaaaaaaaaaaaaaaaaaacatccagcaaacagtttctaaactgcctgctaggcagagggaattcagagagaagtaagtggtggctaactttccaaaaaggaagcttctcagtttgcagttgaataccagcttctcccggtctagtcagggagacagatacaaccagagagacaatatcacaacccgaggaatgccagaagtgtgtgcagagggttgggagggcctgaacttggctgggaagccaaagagggccttcagcagaaggccactcttgagctgagtgtagaaggctgagtgggaattcccaaggcaggggagtggggaagagggcttttcatgcagaaggaataaagcagcctgtgccatggcctggaggctggagaggatggctgggggcagcagggcaggtgtggtgggagactgcagaaggaggttggagcccacaaagggaagaaagtcccatgtgccttgctgcggagttgtgaattatcatttgtcctgtttcacataaaatcattgatgtagggcttgattgaagccggggtcaaacatgagttgtcagtcattcccatttgatgaacagccacactctccagttcttaaaatatcactaatggcaaaggtcagggttgcacttgatagctgtggtttggcttgggacactttcccctttgaagtcccatcccctgaaagcagtgtgagagaaatgctgcgtatcaaatccagtttttcctggttgattccccagaagggaaatacattccccaggcttcatagtaaccacttaatcggtcatttaatcctcactgtcccactgggagaggcttgagtactgtattagctgttgctacataacaaatcaccccaaaaccgcccgtggtttgattgtgggccatgctgtctctattgtagctcttcagctctgccactgtagcttgaaagcagccatagacaatatggaaattaatgggaacagctgtatcccaataaaactttatttacaaaaacaggcagctggcctgtgcgctctagcttccaacccctgctttaaacgataaggttttattatagccaagagcctgcatatctgagtcatttttctagtctcagttgggctcactcatgcctttgcagtcactgggggtggggtgggtatgcagccctgctgatcctggctaggctttcttacgtgtttggtgggctggtttaggatggccttgggctgcaacaattcagctctgttccgtgtggtctctcctcctccagcacatgttcatatgacggcagcagggttccaagaaaaagcaggagcgcataaggtctcttgaggttggaaactggcatggtgacccttctgctgcattctgttgactaaagcaaatcataaggccagccacaattcaaggagagaggaggagctgcagtgtcccatggcaaagggcagggatacaggcaagccattaattagggccttcgatgccatcatctaccttatccccatattccggataaagaaactgaggcttagagaggttgatgacttgcctaatgtcacacagctgcaaagtgatagagcaaggatcacaccagtgcagtcttgagttcaaaacctatatgcttcctctattttccgtggtttcaatggaaataagtagtatgaggcttggatatttactggaatatatgttacatgtctcctcctcccctttacttaatgctactcttcttgcatccctctgctgtaatttctccgctttcagcctttgctttggtgtccctagaagaggccctagagctggcttttctgtttctctgtctcccatctgcctcagagttccagaaatgagatgttaatgcagcacttgagttattttatagagaaattctgagcacagagttggcacatcccaagggacagctgcacaaaacgtgagtcttgtaactgtcatgtcttctcattctaacaccaagcattccttcccttcaaggatttgccgggctgtgtgtgctctgtttggaggaagagactggcggtacattggccctgatcaacaaggaacttaagtttccttgaaggagatcaggtgactgtcctctctaatctgacaatctcagaacatgactgattaccccagggcttaacccccatgacttgaccctatcctctctttgcccccagagcatttctgacccataaaaattagctttaaaagtcaaatctgaaacagctgtggtttcttctgatcagtcagcaaggtctaacttgcctgtggtcaagccttcccctgattagcttagcttgtgctgggagagcccagaagtggtggcctgtggggaatgggtaggccaggcttggccctagaaaataaactgggacgtgtgactttccaacagagctcgcatgctggctggctgacggcaacacaccctgtggctttgtgaggttggttgatggtggtggtaggggtgatgtattttctatttctttttttttttttttttgagacaggatctcactcctgtcccccatactggagtgagtggcacgattacagctcactgcagcctcaacttcccaggctcaggcgattctcccacctcagcctctcaagtagctgggactatagtcacacgccagcacacccaactaatgtttgtatttttttattgcccaggctgatctcaaactcctgggctcaagtgatccgtctgccttggcctcccaaagtgctgggattacaggtgtgagccactgtgcccagaaggttgtgcattttccgcaggacaaaggtggtggtcgtctctgacttcctagctttcatttggcctgtgctgactgagcaattgctatatgcaggccaccatcaggagctgtgtggatacagggatgaaccagggcctggatagtgcccgcccctgaaaagcttatcttttggttgaggacacaggaaccaaggttgaaacccacatctgtatgtcagaatttatctgtaaataaagtggtgtgggtgagctaaaagctgtcttggcacagagactgttctgggcagggccttgatttcatggagccacaggagatgcagggtgaggaggaggtatttgagtaaaaaaggtacaatcacttgaattaagggagttttccactacagtaatattagctaatacttttattatacatactctgagctaggtgcagttctgtgtgctttgtatgtaactttactcctcactacagtcctttgaggtagctactactactgctacttctattttcatttttacatatgaggaaaccaaggcacagacaggttaagtcacttgtctaaagtcaggtcggtggttcatgcctgtaatcccagcacttcctgtaatcccagcacattgggaggccaaggtggatcacctaaggtcgggagttggagaccagcctggccaacatggtgaaacactgtctctattaaaaatacaaaaattagctcggcgtgttggcacatgtctgtaatcccagctacttgggaggctgaggtgggagaattgcttgaacccgggaggcagaggttgtagtgagccgagatcaggccactgcactccagcctgggcaccaaagcgagacactatctcaaaaaataataataataataataaagtcagacagccagtaagtggcagagatgagatgtgaagccagatctagcatctgtttgtaaccactgtgccatactacctcaagctgcacaatcccatgcctgaatttgctttatcatctctgccttatttgtggctagacttactctttgtaaaatgtcccctctgttggcatggtagaagtgactgattccaacatttatgtaagtattccacagcttaaagggcactttcacaccggtaatttgtttgcttctcagagccactctgcgaggaatgggctgtaatctcccctttgcagatggagaaacagaggctcatggggaggagtgcattcttccctgcctcacagcagaggcagagctggtggccagtacctgctgtgtgtgttgaccttgtgttgaggccagtgccctttgtgccggggtggtgtggaggtggcgtggccgaatctggagtctacaggaagggtgacagcctgattgatttccgcttcttcccgtgttttgattctgaaacactttgctgagaccattaaggagcatcgacagaggaccttgcttccacaatggaattttccttctcttcctgtttggtattttccagtaatatttctattaatgtttcactttcagcggcactaacttcctgagagtttgagctttcctaactcccgaggcaggaagaactgaattttcctctaaatcattcagttcctttccagtttctccaaggggagctgtctctggatttcccattatgctgtaaaggaaggatcttggaggtgggtccaggggatggagagagaattagagccccactgagtgactcaggcccagtgttttccaagcaacacgtaatactcctggtcagaaaggggcttcccacggccgaggaggggagagtgactcgacaggtgggtgggtgggtgggggaagcgaattccctggcccactgccgggccttgacttacaggctggacccagagttcccagggggctgtgagagcccatgccaagtcctttcttctcattcattcattcattcattcagtagacactgttgagagcctgctgtgtgttggggattgttctgtttaggtgctgggaatagagccatgaacaaagcagataagagtctatgctcccctgagcttgctctctcatgacaggagtcaagtaaatacagttacgtcaggggtggggactgtggaggaaagtaaagaggaataaagaggcgatggcaaacgtgaatttggggtgggatgctttttatgtgggtgctcagagagggccttgctaagagttgtgatggcatgaaccaccccgctctccaaggacggcattccaggcagagggaagaagaacagtgcagaagcctgaggcagtagcatgcctcggtggttcagggagcaatgcagagatctatatgactgagcggagcaggtgaggaggaggtatgaaggcagctgagggctgagaggtgtggggcagaggatgttggaactcacaagcattgaagaggccttcctcgctaaccctgcatgagatgggggcagcagagggttctgagcagagaagccagccacgcatctgacttgggtttttaaagggtggctctggagattctagagcagagagggcaccagcaggcagaccactgaaagcagggctttgacagcaggtgatgagaagaggggcagattccagcgtgtggtgaaattgggcctcaggatttcctgacagagatgagggagaagagccaggatggctgcagggttttggccccgagcagccactgatgcagtagattcagcagctgaggcctaggggtccagagtgggacactctctgccctctggggtcaggaggtgcctgagatcccagggaagaaatggatggccctctgtctgggtctgtgggaggaaatggggaaaaccgtcaggaagaggaggcctcatgggagatgggtccagaggaaggtgtggatggggcatccaagacagaggggatcccatctacagtggctgagattggaaggggaactctgctgtgtgcagtcaggggtggccagagcttggggcatgccatggtatatttgccagggatagaggaaggtggcaaagggccaggccctgcctgccactagtctgaaattgccccagtactcctaattcaaaagaggccacctgctatgttgcatggctgagctgggcaccacagggcggtggagacagtgcagcgattaagtctccagggacagggctggagcagccactgttttgctcagcagaacatttcattgctggctgcttctgataggaagtggtcccttatattgtgggttcactggtacatgggctatggggagaatgcaaacagaactaggaggaatgagagtctgcaggtttctccaggccacggctaaattctaaaaatgaaaatcatcagaaagttcttaacagtgaaactttaccatcttgttggatgtgcactcccagaaagccagacagcccggtaatccctctggtgcattccaaagccacacatgtgatcggggactgcatggcatttgcggaatggcatggtgcctacctgccctgtgtggggcccttgcaagttggctgtgctctgagccggttcctcagaaagggaccagcttgcattttgagctgtagttccacatttatcttttgactaaccttttaccccttataacaaaattaagacaagtttggtatagaaaataataagtaagcaaaactcagaaaccaaccctaattccgtaattcaaagaaaccaccattaacattttactactttttcatctagccatttttcattgcatatatatatatgtttatttttctcgccacaaaaattaagtgataccgtctatatttttttaaacgtaaagacatggaaagatgtctacaatatcttaaatatttaacaactgtaatttaatagctgcattgtattctgttcacatgttgggcttttcctcgttttcaccaatttaacagtgccgtaatgaacatctttgtaacttaattctttgcataggtctgtgattatttccttggggttgattctgagaattgttggataagacagtaaaaagtctgatacatactttcaaattgtgttctagaaagaccttacaagttgacacctgttttacccttctcacacaatcctcggaattctaatgcaagttagttgcatttgcagtttcctggattcctggtgcaaatgtgtgttgaccatttgtgttgcttttccaaaactgtttactttatcatctgttcatccttttctgctgcagggttttgtctgttgatttgtaagaactctttgtggattaacaatagcagccccttacctgccatttgggttgcagaacattttttaaagtttgtaatttgccttttggttctatatgtggcaattgttgttggttacaatgaattgttttctatttaatcagtctccaccttcatgatttcttgagcatgctgctgagaaaagtcttcccatgtgggcgcggtggctcacgcctataatcccagtactttgggagactgaggcgggtggatcacatgagctcaggattcaagaccagcctgggcagcatggcaaaaacctgtctctactaaaaatacagaaaattacctgtgtgtggtggcatccccctgtagtcccagctactttagaggctgaggcacgagaattgcttgaacccaggagacagaggttgcagtgaactgagattgcgccagtgtattccagcctggaagacagagcaagactctgtctcaaaaaaacaaagtcttccctactgtagtatttatattttcttctaatactttgatggattttttttttacattaaaatttccatccccctagagtttgatttcattgtatgaggtatggttgtcatcttattttccaaatggctagtgtgtgtctgggtaccctgtattgcttgctcatgatcttcaggtaccttttgagacttaaatattttgactccatcttgccctgacagtgtttaggtctcatcagtgattatgataatgatgatgaaggcctgtctttataaaatgacaactttcttctgcagatacccatgcgcttattacacattcaactcctgacatctgaggaaagtaactaggtattaactagggcttcatctttacccaccacagcagaatgccaaacctgctgtggtgtgtgggatgtggccaagacagccttgtcttgcctctggtggagtcggcatcctcctctgataccggaggctgggctgtctaggtgtatttgaggcaatcacggtggtctgccctgcccatgtggcttgagccaagcgagtgtttcagttttcacagagtgggtgtagcgttcagtcatccaaccatattccagcactgggctgagtcctatggaacaatcagagacagttaagcctgggtgctctagctgagagcccaggagtgggtattggagagggaggaattcattgccagcataggcaggcaggtaaatgactccctgagcagacaagagaagcatttgggcgaggtgggtatggctggtgggagagttcagaatgggtaggatttgaaggtgtggcctgtgtgggccacacgattttggtcactcaaattttttaacacctgcaaaaagttcaggtcaccaggttcttcctctgcaccccaccgttttcggcccaccatcaacccaggtgtcccgtgtcttcaatcagtgagagatttttttccagaccactatagcctgtttctctttttctggttcatgctggtgttaggaaaatccatcctgcagtgtttgctgtgaggttgatgacataaacaaattggtattaaaggaaaagattaagtcgtggagtgttcatggggaataaatccaggaaaaatgcagatttctgaacactgccgaacatgactgtggttctaagaggctgaaggtgtctgcctaactcacatcacgtcactgaacccaggaccagccctggcagcacagtaaaattacctgcatagcattttacaaatttcagtttcctaggctcccatcccagattaattaatttctggagatacagccagggcatcagtattttttgaagctcccagatgattgtgatctgcagccaaggtagaaagctgctatccttgacctttggtgtcccagagagctggggatcaccccatccaactctcttccatccatgctgaaaacttccaatgttgagatttgttaccttttgtccggccacctttgcacagctggggttgactttttttttattttaaatgtttactctagctttttgagcacctggtattcacaggaactcgttggttgaactttttttctttgtagattctactactgtcttggtttgactctctgaggtcaagtagaaccagtctaaccttgcttctctcatataaggaccctcagatgtgcgattgtatcttcaaaggcagagagaagctgcaggctataacactgcccacagagccagattcccagccaggaccccagctgctaagggcaaggaccctttgatgtcacaactgtggaggtcttgatggagcccaagtctaggagcttcctgtgggcatgaagtaataggctagagcaggttcccggtgggtgagttgaggttggcactgaggtgttaactgtgcaggcatgtgactggatggggaacaaggtcagattcccaggtggatttggggagtctcagcaaaggagctgtcaggagtggattccagaggagtaggtagcaagtggagcagaggttgcgtggctgaaagcagtgtgatgtcagggttgggcattccctgtcctgcttcttggccccttgtgggggctagctgacaaggtcatacaccacaggagcccagggctgttgctccagacacagcagaacccaagtgtgtcccactgtggtggcatgaaacactcactggctttagggtcggaagtccagagctcaaatcctagccctggtgcttggaagcttagtaacttgggacaagtgataaaattctctgggcctggaatgccccatcttctatgtaggtagaatagtaacagatggtgtttcctgaccattcactctgtgtcaccataggtaacactttcagtacttgatccttaactgtgtgtctttgaggtgttgctgtgagaatccccattttacagatggtaaggcatttgggagatgaggttctggggaagtacattgggtcgttgtgaggattaaataaaatcatttgttgaaatggctgagcacaatgcctagcatttaggaagagctttatgaatgttttatattattttggcctgtgtgtcttgggcctcagtccagctttgaactttgggctttctatagccacagtaaagtcagtggggttgccctgtctgggctgatgatgtggtcctcagagagtgaacctatccttatcttggtgggtctgcttacggttaagctttacctgggatcaccactctgttctaagagcttgaggtatgttagctcactgattcccacaacaccccataggaggcaagttctattaagagtcccattctggctgggtgtggtggctcacacctgtaatcccagcactttgggagactggggtgggcggatcacgaggtcaggagatgtagaccatcctggctaacatggtgaaaccccatctctactgaaaatacaaaaaattagctgggcgtggtggcaagcgcctgtagtcccagctactcaggaggctgaggcaggagaattgcttgaacccgggaggtggaggttgcagtgagctgagatcgcaccactgtactccagcctcggtaacagagagtgactccatctcaaaaaaaaaaagagtctgattttgcagatggagaaactgaggcaaacaagtttgtatcttatcgtagatgacactgctagtagtgggtagagctggagctggggttccagccaggcagtcagtctatgttacacagatgcaagggacagtgacgggtcagctctgtgtcagctgatggccatttatcagctgaataggtctctactgtcatagaaaccacaggtctctactgtcgataaagtgtctagtttgggccaggtactccccataggcacattctcaggacaatgctgccaaaggggcatcaaggaaagcttcatggaggaggcagcatgggagctgggccttcatgcataaggaggatctggatatttagagattggtggatgtgaggaggacatcccgggagaggggccctctgaatggtccctagtagatgatggaggagaagccaggtgtgggaaggccttcagggccaggccacagtttggtctttattctgtgggtaaagaaaggtagtggagggagtgagtgaaagggtcagcctcatgctttagggacacctgtatgtctgtagcctgaggggatagttagaaaggagtgggggtggggaggctctaagctgggcatggaggtggggacccagttaggaggacatggaatgctttaggcagaggcaccaagggcctcaaatactgcaactgactgctcaggcagctctcagatgacactgggcaatcgagagaaattgaccgagcgcttgtcaggaggatagatttttctgtcaatagccgaaacgtcctctgtgggagtttgtgagttactcagtccatcagagcatttgtccacattctgtcagagccggacggaacatgtgctggggtcacggagtctgagccgggaatggctctgctggttggagagttgggcggaggaggccttgtacaagtcagactgcttgtttctgctgaaacatggagcaggaaaggacagagctaccaagcagcccatccatgaggaaagacgtgggggactaaggagatggggagggggctgtgtgtgttctgggggtggacagagctagtcacctgcccttgagatggagctctcccatctgatggcagcacctcgtggagttagagacattccaggatgtccaggcaaatgatggcagttagaaagaagccatgtaaagttgctggtgtcgtagttgaagtcttcagaagacagcagtgcaagaagggaaagggaaaaccagggctctgagccaacgcgggatgctgatcttcagaggacgtccttgcagggagaagctcttcgaaaaacagtaagtgctcagcctcctttaggtccccagagggaaagaaatgttagccacgatgaagatgtttgctgggctcagtcaaagagccccttgaagatccctggacaattccttacacattcaccactccatcagagggccactctgaccggcagagctcgctttacaggctcagaagaaacgctttgtaaagatctaggaataatgttgccatcagtcagctcctgcttgccgggcttctgtggggctctggatcatctgaaagccatctgtggtgtgactgtgaagtgacgagatggtgggagttggtgtcatcacttcctcatcacccacaggacagctgagaacgctgtcacagcctggatgatattcccaggccttgggcctgaaggttgtcaaagtgcagacactcaacccgggcatgctttgaggtctcgcctacttgccctttgtccctctgccttgaattttttttttttttttttttttttagacggagtctcactctgtcaccaggttggagtgcagtgtcgcgatcttggctcactgcaacctctgactccctggttcaggcgattctcctgcctcagcctcccgagtagctgagattacaggcatgcgccaccatgcccagctaaatttttgttattttttagtagagacagggtttcaccatgttggccaggatggtcgcgatctcctgacctcgtgatctgcccgcctcgccttccaaagtgctgggattacaggcatgagccaccctgcctggcctgccttgaattttgtgtgcaacttcgactcagattctttgtcacctgcaaactagggtagaagtgggcctggttttgaaaaggcagagaaacttttctttatccaggcaaactgttttgaggaatccttacagatgattagacttgaagcctccagtgggagcaaaaattgtgacaattcagaggatgctaaataagcagtttgtagtaaaagattgtagtcagtggttgaggagtgaaggcacgttcttttttgtgtgttttctcccatcacccccaaattagaaatctctctttttttttgtatctgcctggcctttttgggaatgattatccttgaaaatatcttaccctttgcttttgatggtttcttctgattacatctgttttctacagactagcagacacttaagagtattggatttcttaacattcggcagcttctagttccatatatattcaagcatttcttactctgaaagtaaatttcagttgtatacattcattcattttgagagtcattttatgcttggacatttctgacgaccaccttcatagttatggggaagggactttagatctgtgaagggtactgaaacaaaacatatattttgttcatacgttcttgtgtcttcccagacttttctttaaaaaaaaatcccaaaaagggaaatcagggcttcccttgcagaaggaggcctggctgccttaaaatatccatatatttgaatttcaaaggtaggtttgaatgtgaaatctaaggtaaccttgcattcatagtctaaattcagagtgagcaaattagattgtcattattaagtctattccttagacttaattggggcatggcattttctgccgcttagttctttagtggtaaaagggaacctttcccattgctgaataaaagactacttgagcccttttgctgaaggactgtgacatttccctgcattggttctggggttggatggtcaagacattgacaggtggatttaagattacagggtgagacttggggaccatagcaagctgtgtttcagatcatcatgcattcaatttttaaatgttggctgggcgcagtggcttacgcctgtaatcccagcactttgggaggccaagacaggaggatcacttgaggtcaggagttcgagaccaacctgaccaacatggtgaaacctcgtctttacaaaaattagccgggtgtggtggcacatgcctgtaatcccagctacttggtaggttgaggcaggagaatcacttgaatccgggaggcggaggttgcagtgagccaagattgcaccactgcactccagcctgggcaacaagagcaagactctgtctccaaaaaaaaaaaaaaaagtacccatggtacctgctgaaatactggcctgcctaggggcctatgagggaagcagtgtgggccagtgttagtgcccagggttagtctgggttcagggtcagactgtgactgtgggcaagtcacttgacctctctgagcctgtttcctttttttttttttttttgctttgttttttgtttgtttgtttttttgagactgagtcttgctgtgttgcccaggctggagtgcagtggtgcgatagctcactgcaacctctgcctcctgggttcaagcgattcttctgtctcagcctcccaagtagctgggattacaggcgcgcctcaccgcacccagccaatttttgcattcttttagtagagatgggcttttgccatgttggctaggctggtttcaaactcctgacctcaggggatctgcccacctcagcctcccaaagtgctgggattacaggcatgagccaccacacccatctgagcctgttttcagtgaggatattggctgggctctcacacctgtaatcccagcactttgggaggccgaggcaggaggatcgcttgagcccagcttgggcaacatagggagaccgcatctctacaaaataaatttaaaaattagccaagtgtggtggcatgcatctgtggtctcagttaattgggaggctgaggtagcaggatcacttaagtctgggaggttacggctgcagtgagccgagatggcgctactgcactccagtctaggtgacagagcgagactctgtctcaaaaataaataaaaaggatgttcgtttctgtcttgagatgagctgagaaggtgcctgtgaatagactgtattgttgccctaaaaatgttgtagacttggttttaggtcaaaaagagtgactggaaacagtgagagagcaacatggagaggcttaaaagttgttaccctgggaacccagtggtgccctcctagggaaaagcacctaaaacatttggcaaaaccaaaaactggaaattacctaaatatccagccatgggaaatggctaacgtgtggcctaaagtgagagggaatacagccaacaaaagctgagttgagtaactccactgcaatatcgttaagatggaaaacactcaacaatgtaatactttttcattttttgtatgtgtatttatcattattattttgaggcagggccttgctatgtcacccaggctagagtgcaacagtgccatcatagctcacagcaacctccacctcaagggctgaagagatcctccagactcagcctcccacgtagctgggactacaggcactcaccaccatgcccagctaatttaaaaattttatgtagagtcaggctctcactgtgctgcccaggctgatctcaaactcaagtgatcctcccacctcagttcccaaagtgctaggattactggcatgagctgctgcaactggccagaagtaatacttttttaaacgcaggatataaaaaatgatgaatatttgtattcttttccaattactgcattcccaccgacatatgtagaaaaaagactggaaggaaatcgaccaaaatgtatacactggttatcgctggaaggttggaatattttacagtttttaaaaacaaatgcaaatcatttaattactattggaaatttttttgaagtggtaacattgcaagcacaacgtgaggagggggatgagaaggtgaggtaagggagcacaggctctccacctcccagcagagtttttgctggggccatctgaatgagttgttgaacttcaaagccgctgagtgtctcattgtgttggaatgctggcgatgaggatcacaggaagtggtgacaagccctttgttatataagctcaccaggcttgctcattggtgccagctttggcccttagtgttcgatcgggactttatctgtctgtgtccggggccacagcgttagctcgggcaaggacctgtgcgggaactgcatagtcaggcacaggaagctgcaactcacacccttgtttgcttaacacccactggcgcattgggctattccatgaaaggagaaaggacaaagtggagggatttactggcgctattcctgacctgtaaagatgggggattttcccttgcctctttggaagaaatctgtctcacatcctccaaaagcaagagcaacctgctttttgatctgctgctgtttctcagttcctgttagttctgtgtttataattgtggtcctgctgaaggcattagccaagaggggtaggaatgttgcagttccagagccagattgcagttttcccctctgttaacttccctgttggaggcaggcagggccattcctcacacaggacaggtgctcagtgaagccttgcagtctccagttttctgcaccgaaggggaggtgtgtgtacacacttgtgggtaagaagattggaccgctgcaactagaaaatagctcagccttgtgcctgaagtgattagctgctttcagttgagcacttactgtatgctatactctgctgggtgcttcaggtacatctctcattggagtcctcacaggaattgtgtaaggaagatactatttttcatacaagtaagcagacttggagaggtcaggggacatacccaaggcctgccaaacttctctgtttttattgacattcctgtgttatctggataccagggactggactcttggagaacatgaactcatttttcactcatcccccacagctggcactgaacctgaaacactggccactttgggtacgttgaaccttgaggtgccatggctaggtgatgttggcaaggcccctcccctccctgggccacagtgtctgcatttgtaaaaaggccaggtgttcttttctctcaccaggccccatcttttccaaaaacttcccaggacagcccttaacagccctctccagaccgcaggttcctgtggaatgtggtttgtcttgtaagaggtagtcataagccacaagcgacgaagggatttttactgtcaggcctgtcaggccgaggcccaaacattatatgactgttgtccccaattaatgagacacaagaaaccaagttgtgcaactttacaatgaagccacatctcattgcgatttcaattccttccgtgttagaggcttgcgtcctgcccctggcaagtttgtatgtttcattgcttggcgtgatcacccaccttttcacctaaattggtttggaaaagccgtgggcagtttctagaaattaaatccactccagagtatggaagattgaccacccaagatgttcagaggaatgtggtgtctcctgagggccctactcggagaaggaggacccgggggggcttcgagcatcagtatattgccctcagggcaactgcttgttcttgtttgcctgtattcaattcttatgtgtctaacacagaggtcacaaactttttctgtaaagggccaaatagtatttcaggctttgcagcaacacggtttctgttgcctctgttcacttcttcagggagccacagacaatatataaatgagcaggcctggccacgttcagcaatgctttacttacagaagtgaagctttgcccaaccctggctgaaaacattaggtgcctcttttctttttttttcttatctcggctcactgcaacttccgcctcccggttttgagcgattctcccacctcagcctcctgaatagctgggattacaggcacacaccaccacgcctggctaattttcgtatttttagtagacacagggtttcatcatgttggccaggctggtcttgaactcctgacctcaggtgatccgccctcctctgcctcccaaagtgctaggattacaggcgtgagccacctgtgcctggtgcctcttttcataatcatgacccatgttaacttgtaatctctgtgttttatacatacccattttgacctgattgttttgaccccactccctcttggtttctttcaagctgtctctggcctagacacgctagaagatctttaatcaatctttacattgcacagaagttgcccacgttctcatgtcaaaaaacatacgtctttttaaaatgcaccgtttttattgtacctgtgttgtgctgtgtaggatctcacgttgtatagtcaggttcattacaaagtggtaggaaattgatatgttgtcaaattgtttattgttgtggctttgttttttttggagacagggtctcactctgttgtccaggctgaagcgcagtggcacaatcccggctcactgcgacctctacctcccagattcaagagattctcctgccttagcctcccgagtagctgggattacaggtgcgcgccacctatcggctaatttttatatttttagtagagacttgggggtggggggggtctcaccatgttgaccaagctggtctcgaactcctggcctcaagtgatccacccacctcagcctcccagagtgctgggattacaggcgtgagccaccgcacctggtcgttgtggcttttacaaatgttactagaagaaaagttccatacctgatatcccatgtggctgtagtcttgacccttttgatttgtcctttatcttctgtcttccaaaagtgagtctggacgtgtcatcatttagacactacccatggcttctatcatgtccagactcatagcttgacattccagctgacccttacctcttggaaaggcttctttttactccatcccttccatgacagccagctgggaacctctgaccttgtgccaggatgcaaggctcacctgtatgcctctgtgtcttcacttgtgtgtcacacctttatcctcctcatcctcttaagttcagctcagctgtcctgccatttgggaggcttcctgacctcccacccctccctcctctgtgtacacatgtccacacctctggcggaagcagtcacaccatgtcatggctcctggagagccacagtgagagccctgcaccttgcacggggcctgaccccagagtggatgcaggagtgcttgtcagataagtgatctcagagaggttgattgaagagccagtatgctgtaaaaccccaatagtccccaaattgccagtaactccaacaagggaaaaaacctccaaactccagtgccctccagagcagccaagactctacattttaggcttctagtggcctcatgcaggcctgtgctgcctgccttttggtgtggtggtgggcattggaaagagcagctttgattctcctcagtggcaggtgggagtgatgattaaaaacagttagtaattaccacctcctctatggagagcttttagctggggacttgtgtgtgatctgcaaaggattcaggacccatgagaccttaggagtgcttcagctccttcagcatcatgcttggcacatagtaggtgcttagtaaacgtcttatagatgaataaatgaattagattagaaagagacttttctggaaagagttgttgcagccagattgaagggctgcaaataccatactaaggagttaattgagcctttggcccacaggcagtgggactccaggacaggtttgtgcagggagggacgtctgcacaacatgtgtcgcgctcaccccattatttgccctttccggtgtgactgagttgccagataatgaggtgttgggctgcacaaagcgcttccttgtgctagagagaggcagggcctgccttgaagccagttggccaccggcctcctccctgtaatttatgtgcagtggcaggttagagtgggctgccaggcagaaccagggcatgcccgcttctccaggtcaacaccttggtgtgctggttccagcataggggccatggccctggattgaggcctggccctgagctttctctgccaccagtgcgttcagggagaatggtttcttttcttaatttttttttttttttgagacggagttttgctcctgttcctcaggctggagtgcaatggcataatctctgctcacctcaacctccacctcccgggttcaagccattctcctgcctcagcctcccaagtagctgggattacaggcatgtgccaccacacccagctagttttgtatttttagtagagatggggtttctccatgttggtcaggctggtctcaaactcccgacctcaggtgatccccccgcctcggcctcccaaagtgctgggattacaggtgtgagccactgcacccggccagggtggatgatttctatggcaggggaagggggagccccactgaccctcgatacctctcccctccagctccatgttcccagactcagacaccttgcgtttctctcccatctaaaggtggctgccttcacagcggtgcttccagtgatcactttttcagggaggatgcaactcactgctttcagacagggaaatgcacagttaagatgtcagtccccagaatctaagtacatggagcagttatcctgttcaaaggaggctgttgttttgtctttgtttttggttcagtcccctatgtgtctactaggtaatatccccaggcataggcacagtggggaatgcaggacagggcactgtggcataggcagagagaagctgggggcagagcattggacacaaggacttccactgcaaagcaagacagggtgttgcagtgtgtcagatggattgattctgggagagtaatctgggcaggctacttggaggaggtggttttggtctgggcttgaacactgggtaggggaagaatgaaatgtactctaggcagagagcacagcttggccaaaagcacggagtttggcaaggacaagttgggtctggtgagaaaggtagaggactggagctcagagtgggaacaggtggggttgtgggcggtctggcagaccgggggagtttgagcagctcctagagcatggccagagacttagctgggtagtcatgggtctgaggagtctctgtgactgcagggagtctgggaaagcccagagcctggcctggcctggggcggacatttggtggggatagtgagaattaacaggaattcgacttcgaggctgggccaggtcgccccaggaaagcccatgcttggccaggctggaattgggcccctgctattctggctgtggctgctgctttcttggcccagccttccaagagcctgtcacaagtgatttccgagggaagccaacagaggagcatggtggaaatgtcactcccttggaggtagatcccctcttaaacacccagctgaaggtggaggcaagagagtgctaacccctgcaccggcactttccagcttgctttgagctgccccaggaggcagagagactggggattcccccttcccattttagggttggagaagtgaacttcttggtcacccagaagtcagtgaatacctgagcgggactggggcctccccactctggacccagtgtgttacgcacaacactgctcctcagtaattaaagggcatgtgtgcagtttggaggtgaggttagcaattaaacgataactgaagatgatgggtgatttctggatctactagtacatagtgagctcttactgtgtcccgggcaccatgctaaactctgccttgctttgttgcagcaacactcgtgggtaggtattttcgttaccctgatgaggagacaggggcacagagggtttaagtaacatacttggtgacccggcacaggacagatgtggcagtcccaccctagggcctgcgctccaaaccttgatgccttctgggcgaagccagacgtcggcacgtttcccccgtctgccccagtgctcctagcgtgctttataattagaacagactgcagcaccagctaatgacttcctcatgagattaatattcagaaactcgggagaaaattgaagaacaagaaaggaaataggtagagaatgaggttgtttccactaaggcccaaagcactatttaaaaagtatgtttgagagccgacttcggctgcgttttggcaatcagaaggcttgcactgtacctctcctctgcttgtgcttcgggcattcagtaccggcccctgtcacgacctgtttgtggagggcagctgatcacatccctcctgtcaaagcataagcctgaaccagttcctcgacttctcagaaccaccagtggcttcccactgcctttgggaataatgttgagttgctttaacctggtatccaaatctccaccccaccaccacccccaatgaggttttctccacctcccttttcttccccgaactcaccgaagttttatacctctgcacttgcctgtgcccatttctgaagcaggcatgcccttctccttcccatcacccatccagcctagcaaatgcaggtttgcctcagatcctgctagttggcaaaactctgtcccaacgcagtctccctcttgccccatacccataggtcatgcctgggccttgcttgtgactacctggcccatctcatgtcatagtggtaaggtcactttaggtctgagtcccttccccatacacagcccccgcctgactggtggattcaccggtgcgtgtgcatggttatgggaagggagctggggtagaacctttactgggcaaaggtaaaatgcaggctcttgattagggaaaagggctttctgggtatcaggcatgaaggggaaaggcttgtttcagtttgtgtagaaagagagaaaaggacttggtggtggccacttttgaccctccatccctgcccagaagaaactaagctgtggcttgttagcctggagaagaggacttcggtaaggacaaatgtcctcagaccttctctgcttgagtcccaccaggtgcacagtcctgtggaagttaactctaagcgtccctggggcagtatcttccaccccagccctgccacgtgtccccagtgtggctttattcccacctaaccccaccccgcaccctcccttgccactcatcttccagagtgcacatcacacctctgctccaatactttcatgcttcctccatttatggcaaagccccaaagactttagcatctagagccctcaaaatctatccccaaactccttttcttcattttgctctatacctccccacaaactctgcaacgttgtaaactggtctcttgactgccactttcctcacttgcagcccccccaccgtagtgtgccctattgctgatacccctgcctgagcccaggaaagaccgccacctcctccaggaagccctcccagccactccagcactacctgcctgtctgcctgcccgcccactcgcttgctgttggtggtatggcatgcagtggctggggacaggggtagctcttcacttgagcagagcagcggagctctggctgaccctgtgccctctctgtccctccactgcactgcatgggtgccgacacatgtctggggaggcctcccttcccaagccccccctttagggataacggccggcattcatgtggcagcttcccaccgtggtctggtttcctcctcacgacagccctcagcggaccatcatctctgtcttacccttgaggcagccaagacttgcccaaggtcacacacatggccagccagtggcgcagtcgaggccacaccccagcctttccccatcgagttgtgccccctctgcttctctgaacctaatgttcagctgccatggacggtgagttctgagccttggaaggagtcgccttcctgcacacagcagatagcggctatggggaaagaccggctgacctgaggtagtgtactaatttctgaggaggaaaaacccccaggcttatcctccagaaacaatcaccacaagaattaggcggctgtaaacacgcctggggcgcagctctagaatgcagtttcagaacccaaatcctgggttctggcttaaaataagactggggcctagggattcatggagggcagggcatgggccgccagactcctgtcgagaggcccatttctcctcctctcccctcgcccctcgagctccagctgcaagttgccccagaggcctgtggcctactggaccagccgctgccctcgctgaggcaggaggggatggtgggcccggccagcctggcctggactcatgagggagctgagcttccctgaggtacttcttatatcagggctgtttccggatgacccctttgctacgtgttttactgcccttgtgtggtcaagttaaagaggttgttcaggaagtaggattacaacgggaccttgtcgtggctttgtaacctctgctctgtagatggcagggactgggcccacagggaggggccaagggtagtaaaatccagaatcttggaatccattcattcacatactcctttgccacaaagtgggatgggtgtgcttggccccagggccatgacccccttcggatcttgcagacttcttgcaaacttgaagtggcagcagcacatacaggctaatgactaagcagttcccactgcgctttaaagtcttgccttaggctttcaattgtgcttatcattcaaaatgctcttttttgcaaaagagcccattttgtcagttttcttcttgtttagatttaatgattaatcagaaaagtggttttttgtttttaggtttttttgtctggtttggagataacattggaggcttaacgcctgacagcagtatctgacagggcactttatcttaaggatgcttttcaccattccagctatgtattatccacatttttccggggaagaaaatgttctctggcgaccccttttttgtagtgtagtgtcctgggctgtcacgcccgcccgccagccctgcctgataagcgataagcgtcaggagttcagaaacatgtttttcttcacggctgacagtctgtctcaaaaaacttccatctcctcacttcctcgggctcctgatcccacccgctccattcctgcctttgttctctttggcacacactccctctccggggttccatctgcctttccctacttctccttgatacctccctggggggtggcccctgcccactgtcactccccaacacccagtttctccctgccccacccccggggcctcctagatgcccaggcagctcattggttggcctgggaagcggggctggctcatgacccgagtagggagcagagtgggctgcatccctgtgtcctggggaaggaggcactgggctggggcaggaaggagtctgggagtcaggcagacccgctgctttcctttgctgtgtgacattgagcacatttcttaatctctctgagccagtttcctcatttgtaaaatacatttattcatctactcagtaccttactgtgtgccaggccctgcattagactcagggaccaaaaagataaagtgaacataggccctgtcccagagtctccagtttggggtggaggtggggcttcttagtaatcatggtaagatgactccctgggtgttagggaaggggaagtgacagacacagatgtgttttatgaaccgcaaagtgcagtgcacacgtggagagtgttggttcctggggctcccaggtccattgcttttgtgatagaacagggcctgccttgtggtgctcttaagtctggaggtcccccacgcctgacctgaccacgcctggtgcctgtgcgcccagcctgttgtgtgctgctgagctctggcctgcatggaatggctgggctggggcacacatgcatggggcgtaggatggggagggcagagccggacagccagacccaagctataaagcagggttaggggaagattctgggtgctgtttggagttctccaaatagagtttggcctgacttttaaaaactcttagacaatgtgttaggagttagttaaaccacttttagtcagtaggaagagagccagattttaaaaaaaatcttgttagagtgtgacagaatgtgaaatgtcactttttagctcctcttctagcccagccaccttgtgtcatgcctatttgtgagcctgtggctatcccccaatgagcctgtgtctcctgcaggaaggaccactccttctgctctatgttccagagcccagcacaggatctgccccaaggtcagcccagggaggctgaatggaggagcagacagaacttcagggctcagaggagagaggctcacttctagcggaggtggggttctcagaatggtacatgggggctgaatcgatgataatgacacacagttgagcccctcctgttgccaagcactgaggtgggttctgttactatccccactttatagtgaagaaactgaggcccagagaggttgagcaaacttctcaaggtgacacagtgtggatttcaacccacatttcactctagagctcatgttctcatgtgccgagcattggaggttagatagaatttgaacatgcagtgatcagagaagagagaagggcacagtatgagtgaagaccccctggggaagttgggggctggtgactctgcgtgtgactggagcgggcagtggtgggggcaggtgtcggaaacaagctcacagccctgttgaccatgggcctatatggaggtaagataggaagtttccaaatgacacggagtactccagcaattggtactttacacagactacagacaagagccctgtgtgccatctctttctccagttctcttgtttgagcccactgttgtgtcataaggagatcgcaggattcttctccgggaaaagagggagttgtgtcagcctagtagggcccaaagccaggctgtctacagggcagtacacagaactgcttttaccccagctcccgtgctgcggggtcctgcaccagtcccttgctctctctgggtctattttgctgtctctgcagggaggagtttcatagtagagtcacttctaagtctgttgagcataagattaagagacagcacccgagtttgagtcagggctctgcaacttaactgctttggtgaccttggacatgttatccagccaccccatgccttggtttttttcatctgtaaaatggggacaatatgagaatcaaatccatagggatgttgtattaaaagaactgagcatagtccctggtagctgctctcagtatttcttgtattattattcagcttctcccatccttgctctctcaagtccctcactgtcctgtggctcaatggagagaaccccagagagtctggggctcagagactctccagttatctccactagcagagctcctgctaggcgggggatgcctgggtctgccctgtctttcggagctcatttgctctgtagacgttgagatcatcgccgccagtggccacccagcctcagccaagctcttgcaacattcccaagggctctgggggttccttgtgcccaagtcctgcgtgggcagagctctaggcaggcggcacgttttggcaagtctttagtggtgtcattggtaaagagtttgctgtggctgcgcttgttaggactgaagaaatacagtttttacagccctaacttttgttcctcccagatgctaataaactgttagcaattttggttaaaatgtggctgttttagaaattcattcccctgttagttctacctcgttgaggtttggtctggagagagggcagtgccccatgcgttagagtgggtcggggcgaatgtggctggtgtttctctggggtcttcaccttatggggcagcagggcttgagcaagaaggcctggtatcccaagctctggaacaggagtttgggcctgtctgtgcctgggtgctgcagggagaagatcttgggctcagattctttgcctcttgactcactgtatgaccttgagcgagtcacttcccctcgctgggtttgggaaatcactggggataatgctgaggttttgcacgcgcctgtttctgctggagaccagagagtgattctcagtcttggatggattgtatccaagctcctaggggagcttttagaaatactaatcccaggccccaccttgggccacttaaatcagaatttctgggggccaaacttaggcatggtgcattgtaaaagctccccaggagtttttctgatgtgcagctatgttgagaatcactggactaaaccaggagtactgtatgaccctcaggaacctaaaatattttctatatggtaatttacaggagagggttgctgacctctccctagattatccactcatggaaggtagacactgactgagctttgtccttctgtccccaagacctaccccaccgtgggcattgctgaacttcaggatgtgattctgtgcttctcccatggcacccaacctttcacatgccactggggaaagaggtggagaacctctctcactgagcagcctgtgaaagtgagagggagggatgcagttttataaggttggagcaaccccttcaacactggctcccctatccccagtcctatgcttcagggtaccataaaaatctcaggaggactatagagtttctagtggcaaaggatctcagtctaggtcctccttgccaagtgctcaacccgcttctgcttggaggtcccctgtgacagggagctcactacctccccaaatactctgttatactttgaatagctctgtctgatcattcttcctgaaattgagttgaaatctttttgagaacttctactggttggttctcattctgttctctgatcccacagaacacgcctgcatcctgtgccaggggttgaccactgtcttgcatgcccccaacagatacccctgaatcttctctagtagatacccctcggtcccttcaattatgcccatgagacgtgggggagagtctgggctctttatcatcctggtgaccgctccttaattaaagtacaaggcccaggccggatggggtggctcatgcctgtaatcccagcactttgggaggccgaggtgggcagatcacctgaggccaggagttctagaccagcctgaccaacatggtgaaacaccatctctgctaaaaatacaaaaaatagccaggcatggtggtgcacacctgtaatcccagctactctggaggctgaggcaggagaatcacttgaacccgggaggcagaggttgcagtgagctgagatcgcaccactgcactccagcctgggtggcagagcgagactgcgtctcaataaaacaaacaaatgaacaaaccaaaaacatgaagtactagagaagattcaggggtatctgttgggggcatgcaagacagtggtcaacccctggcacaggatgcaggcgtgttctgtgggatcagaggacagaatgagaaccaaccagtagaagttctcaaaaagatttcaactcaatttcaggaagaatgatcagacagagctattcaaagtataacagagtatttggggaggtagtgagctccctgccacaggggacctcccaaagagctggacgtgattctccattggtcctttggttgtacagagtagagggagacagtctcctctctcatggtggatcataacatcattatcactgtccttgcagcctgtggtcaggttggctgtgggaagctgtgttagaccacatgagcactgcatcactttagtaaaggtcccaggcagtggaggcctctgaattcttgcatacaggtggcaagttattacattatttcttcctcctgtctacctgcagttggttttatgaggggcgttagtacacttcccaaagggcttgcccgcagggtgagaggtgcacattgaactccctcaccaggcagatgggaagtgtggccatgagagagagcttcaggggccctgggtttatgacatcgctgggccaggaatgaggttaatatttttaatggcgaagggtgagccccgttattacccgagctcattcatcaatggcagaacccgtttcacctgttaagtgccctcggtgtgggtaattcatgaatgggaatccaattttctttttaaaacccaagccacctcccccttcttaaatccaggaggtggtgctgggggggtgtcaggattttacagcagttttttcctgggtaggaaaggctgtggacagctttgagggcctttcctgccttactcaccaagcaggcctgcgtgagccagtccataagactgagagttatggagaggctggggctgcaacagctctagttgtgggacccaggatagatgggaaactcgggaccacctgttttatcctgttgcccactgatcagaggatgggcataacaaaaatatggggagggggagtgtaacgagaccactcaggtggaccctctccaagcccttccgaaatgattggtcaactagggcattggattaattttaatttttattttttgtggaggcagggtctccctatattgtccaggctggtctcgaactcgcgggctcaagtgatcttcccaaattctaccagcatgagccaccgcaccagctggggtattggtttaaatgtctccaaggagtacatttttctgggatctgtgggttggaagggccccctccccgaattggctggccccagtcactggtgttatccctgataaatgggcatgatcatggggcacccatagaggtgatggggtgctcacttttatcttaggaaagcataggctttaaattattcccagatgccccattggagccagcacctgctttgagggtgattgcaggctaaccatgctgaccctgagggccgcctcatctccttagatcgtccagtcctcactgcattgtggatgcttggttttctaattcagctggtctcaccctaaccagatgaaaatggaaccacttctaccataaaattccattttcttgctggttctgatgagaaaaatcaggttttctttacagtcatgtttgaaaataacaacagccagcatattttagcacttagtacttagtgcatactgggcccagtaccagggctcactctttctagagaagcaggttttccttctggctgtcattccctcctctgcctggcacgggtatgcttccatgtgcagaggtttggtgttggggtccggggcctctccatggggacaacttcaaaacaacgctggtgctcattctgtgtaacttgaagacaaggactgtgccacgctgcactggctttggtatgtggggaagtaggatcccccaggcaggagggatacggctggtacagggtggagggagaggagagctggaagccaggcttcaaaggctgcaggcggaagcactgcttccccaggtgtggcccgggcagggcaggttgcaggtgtgccggagtcacagggcagctgaggaaggggaagggagacttccagcactcagctgacttaagggagttgtcaggtggcctttgctcacggttggcgcaactgagccaagctggcaaagctgctgcttcttcctgtcaaacttcccttcagagatctcttcctgttgcccagaaggagcctggacttagaaactcatacaacaggctgtaggtagcccaggagagccagagctttggggtgacgctggcctgggttgaaacctgcgtagccttctgtgctctgaggccttggcagggttcctagacatttctgagcttcggttttctcatctgaaaatgaggtgattaggaaggatgaaatacgatgatgtacgtgaaagcacagagccaagagcctggcttgtagagaaggtgctctctaggcggtgccccctctgtaagcatcgtcccttagcctcctgcctgttctagtcctctagaacactcaggcgcttggagggtctggtccgaggttctcgggccctggcactggaggatcccaggctctgggactcagcccccatgagtcctgcccggtcccaggtcttcacagagaagtgggtgaagagagaaagctgggtggtaggttgaggtgtcttgtgatagccaagttatcagcaaggggcctgcctccccttgatttactcatcagcagtggatcaaagtttgctcttttgaaatgggtaagtctgggattcagttcaagatacctttgcctccctttcaggatagaatgtttccagtggcaggtgatttatgactttgcatttggaaggagattttacaatgtgcattaataaataagggccattctgggcccgattcatacagccgttgtcaagtgctgtgttggtgtttcatggaaaccagctcccgtgatggtctcagatgtccccttaaagcggaagggacacagggtgggaagagggtctggaaaagtcagtgctcttaagcaataacatgcacaccagaccattgacatcataggaaggcttggtttctaaagtaatactaaaaggactgaaacactcacctggggtaatgcttccctagaaagcatggtgatctccaatgaaattagaaaaatggacggttaggggtttcttatgaagctaaacttactcaccttaaaggactatgctttattctcaatttcctttttacctttttactgttaaattgttattgtctttatcttttttcgtttgattttgttttgttttgttttttgagacatagtctctcgctctgtcaccaggctagagtgcagtggcgagatctcggctcactgcaacctctgcctcccgggttcaagcgattctcctgcctcagtctcccaagtagctgggattacaagcacacaccaccacgcccagctaatttttgtatttttagtagagacggggtttcaccatggttggccatgatggtctctatctcctgacctcgtgatgctcccaccttggcttcccaaagtgctggggttaaaggcatgagccaccatgcccagccctttccttcataaaatgtgggtgaagacagatggcggttgggttcttttagtgtgcgtgatcttgtctttccccccttttttttttgtataatttttttgtatagtagtccatgaaatccaggattctggccctaacaacccactctacccattctacagatggggaaattgaggagctgatagaatgacttagctaatggtgccctgctggcaagaggaggggattacagtctgggcctcaagctccccatggaaacttctggatgttggtgtttggggaggggtcatcacgatcagctacataatttgcagggcccatcccacaaaaaataagaatgtgaggcccctcatttaaaaattattaagaatttccaaatggtgatggcaggctgttaaaccaagtgcaggggccttttgcgactgcacaggccactcacctgtgaagctagccctggaaactataaacatcagtccctgatatactggcatttaaaaataagaacctaatgttcttaaccccagaaataaagtgcattgggcccggcctcttaaaatccccgttatgcctgacttagagcatttcctctgctctctgcagccctctgtgaggaagcttgaggttagagaaagcagcaagtgggaggaatcgcagcagtgaggcctcttatatacctggaggaaagaggtgggcaggtggtgtttatctgggctcattttgctgtgtcgtctacagagtgtgcgctctgggggctcaacatctctgaggggggaagttgtacatggtccaggactaatggatctggggtcccctgccccaggccagacctgtgtgggcttggttgggtgggcagttgctctctgactgggagcagcagctggtgtgatagctgggtccagccagatagctggttccattggccacagctgctggtcatgccctcactggactttgtggtttagggcagactgcagcccttctccctttccccactggctgtgagagtacacccacatccatctcgcagtgatgtggagaaaaccagttgcaatgcatgctgttgtgctgaagcatatgggagtgtgggcatacttgcttgtgtacacgcatgcacgtgtacatctaggtgcaggggcagatgctgtgcaaatgtgtacacatttacttatttatcaaatacttcagcagtgcttaccatgcatattggtctaagcatttgacaaatactaactcatttaaatctcatagcaggccgggtgtggtggctcacacctgtaatcccagcacttttggaggctgaggcaggcgtatcacttgaggtcaggagttcgagagcagcctggccaacatggtgaaaccctgtctgtactaaaaatacaaagattagctggacgtggtggcgtgtgcctgtaatcccagctactcgggaggcagaggtgagagaattgcttgaaccaggggatggaggttgcagtgagcctagatcacgccattgcacttcaccctgggcaacagagcgagattccatctaaaaaataaacaaattaaaaaaaaaaatctcatagcaaccccatgagggtaggtcttggtattattctcattttataaatgaggaaatggaagcacagagagatcaagtatgtcatgtaagttgcccaaagtcatgcagccagaaaatgggcaagcacttgagtaaaaccttgcttgtctatactgttgtatgaattgtcccttattggtaggacttctggctttgccctggagagaaatggccccatagaccctctgtagattaatttgctcattgactcccccagcatttactcacacccctttatgccaggctggggctgggcagagttgattggaccacttggtgttgaaagctttgggcctggtggagatttcaaggcaaaggctgtggtggactagaatcatttacatgtttacaaataggcttctggctaggatgcagtaaggggtccagggccatgaagggaaagctccaggagcaaggagggttccctgggcctgggaagctcggtggtcctgtatccacttgtccatgccctggccctggagggcttgatcacagaggagcagcaggcaaggtgccccctcaccctcaccctaccaccccgtggaatggcaggtgaccagggaggcagagagcatgcatctgtgtgctgtatttcatttctttctggtcctttttctatggatataaacacatttctttgatgttatattttagaaaaatggaatccttttataagtactgttttgagacctgattttgtcaattgctgagatgccagaaaggattttgttttaatgaataaatagactccttaacttctttcactggctgttagtatgtctcctcagctaactcagcctgcgctggagctggccttgccgggttagaggtgccacaggccttctggctggagttcctcttcgcaattctggtgtggcctgagccatatttgtttgcacaaaggaggagattggttttagaggcagtcaggaagggtatcactgagggtggcttgcttctctgtgtgtggggttgtgagcaagcctgggtttccagcaccccagctgcagggtgatgaaatgggcacaccgtggtgttctgatttaccactagccagtcgtgagggactatggcctggcccacatggacttgcccctgaggccttcataggtatcacagggtgcatgagcccgtccattattggcacaacagctctgggccctccttgaagctgccaggctgattgatgttgcaggatctaaagaggcccatagggtccccatttggttttgtccatgtgcttcctcggggaggtgcctgcttagtctctgggacagggccctagaccaggagaaaatgatacttgggctttgggaggggaggcagcctgcactagggagggtggcttctggggactcctgtgattctgcgcagtctccaatgcatttgcaaagccattatctgcttcaaaccctaggtgggagatggggtgtgagatccggggtaggagccaagcagatgggagccccgcacagtaccattgcttcagctagggaaaacgcaccagaagagacctcttggctcagctccatccctctccaggaggcaccccctgccctgggcagcagatgctgtcaagacccaccctgtcccttctgcctccccagtctggccttctccaactggctcatccacatctctgtgcccgagggcttttctagaacataggaatgggaacagccgctctgcctacaccaggagctcccaggagttggtgcctgacccccagctccctcactcttggtaaggtaattctgaggggtgggttgtgcatggtttcccagagtttcctctgtcagatcatgctccatctagttgcccaccatgggtagctggctttgtaacccagctttcctgatacccttctcaggcccattttccctgtccccggtaagtgtctcctcccagatcaaccacttgcattttagtgcctgcttcaaggtctgtgtctgggttccccagactaaaaggcatggcctgtggcctctagaggataagagcagcatcttttctgtgttctctagtgcccttgtgcccttgcctatgccagcataatgtgacaggcactatgtatcccttggttcattgactcagcttctcctgcaccgcagaaggaagatgttttcccagtgaaagtgggagggctcaggcttagagaaagtagagctccatagctggtgagaaatttggaagcattggagctcagggcccggaatccaccaccctggaggccctgccctgccctgcccctggtttcagcccagcacaccttgctgggaccctgctgtgcaccaggtgctatattgtaataaaaaggaaacagagctccagaacctgccttcctggtggagcggaagcagacaggcctacacatagctgcaattcagggcagggtgggaagggcccttcacccaggcatttactcaccctgcctggcacatgccagcctgccttggggaggtgaactgaataatgcccatctcccctggggacctggaagcaatgcaagagcagggggaggaggcctgcctttcctctcctctgtatccccagcacagagcccattgcctggcacgtggaggcacgaggtgatcggactgaacagcgataaacaccatcacagacctgcttgacatcgcaaagccctagccaccctaagtttcctgtacattagaaagcgccgagtacatgtgagaaacaggcctgtgaggttcagggtttcccagcctagatgacggcacaggagaaagagttcatcaaggcttggttgctggaggatacagcattattttaaaaagtgaatcagcatttatggagcacctggtgttaagcggaatgtaattgggagccctcaaacatggggctggtaattgtggctgatgctgcctatcctcaataaagagagagtgactcttggggagagcagctgtttagtgctgcttgtgccttaaaggggcctggcccagccttttagctcccctgtgggaaatgtgcatgagtcatcctaatgggtcccgttcggggagaaatgatccttcacttagtgcgggttcccgcgcctctgcagctgatcattaaaaggcactgtgctggcccgatctcgtgctcctccaggcctgagctctttctcccctttaaccttggcttctagcacaggaagcacacacgagagagagggtgcacttggtgactcccgggccttggctggggcacagaggcctggctttgaaaggtaccacattgcacaggaaaggcctttggctcacaggcgctgctgttttgcttttacatacttttcctgtgagcacactggaagttattcttactgtacagagccttacgttaccgtgagaaagcctcacgggcattcctgatccttccttgggaagggggtgggggaccaacaggctgtgcctatcagaagcagaaaaatgcctcgaattaagctgtctaaaaccagtttgggaggcactctgtaaatatgtagttcaacagatgacataggtcctctcctggttgggatttgatgggagtctagttctgtcacccgctcaggagtgttctgctgtgtcatttgttacttggagcctctggtggctcctcatcaacatggggagggggatagtctggatttctgatgtccaggtgaccctgggcaagacccagactctgcaggctggatggtgtgttgagctgatggtgatcacacctgacactgagcacttgctgtgcaccaccctgttccgaatacaccatgtgcgttggctcaggtaggccttgccccatcctcatttcacagatgaggagggtgagagcagagggctaaatgatttgtggaaccatccggcacctgtgaccctgagcttaactagtaccttccccttacccttccagccttcagctccgaaggagaaaggagaagaaaatcttgctcttactcttcgcgaccagggctggtctgagagctggcttagtaaccagctttcctgatacccttctcaggcccattttccctgtccctggtaagtgtcgcctcaggcccctaggggagcactcgtaccccctagagcaggaagcctgagaggaagggctgtctggcaaggtggacagaggttgatggagtctgcaggagagctgagcagagccaagtaggagttgaggggagaatgaggggcggctaagtcagtggctccatggggacccagcctggcccggagcccacctcccacagagagctgtccacagcgatgggtggttggtccttgtaaggggaggtaggggggttcttctgtgaggcagttgtggtgattatactctgacatttttaaagatgattttaagaggaaagttagtggtataggcattgaagaaatcgtgtggacctgggagtttggaaacatgggttgggttacctggtcctggcattaactttactaagttcatccccactcacagccttctgtccccagtggataaatggttttcaaactatgcatggtgtcactttcttcagtggtgcatgtgtaagattccctttgcagaaatcatgcacacacaagagtttgagatctagcagaatagaccatcccccagggatcctttcagtagtggctgcagacccctccccgggtgtttttgtcctcaggagggatgtgctggattttctatccatagtccctggctgaaagcacttaagaaattctaggattgaggtatttctgagttcaaaatagaacctcccactacttgagagatgctgaaaagcctgtctctaccacttgaggttctggggtaaacagagggtggagccaggctctgttcccagcagcctcctacccaggacccacagctcactctgagggggtgaagctggaagacagtgggctgtgtgtgtgtgtgacggagagagagaggctgagcaagcaggcttgagaggagctgacagaggctggaatttggaatgtgtttttcctaacaagttggagcctgcaggtgtctaggcaagcagctgtggccgtgggaggggcaggactggaaagaccagtggtgaccactttaaccccccacactcccagcctcctgacatgtggggcaggtcactgtcaggtctgtaaaggagcatttaggacagaacaccttaggtcagtagaaaaacggatagtggctgctgggagacagatttcagctcagtgtagggaagacactttagtggtgatggccgtcccagaggactgtgttgccacatcatgagctccctgcccctgaaggcatgtgggcggagtacttggcaggggccttcatgatgcaagagggggctttgaactttgaggcaagccagatcttagaaggtagaaagcaaaccaatcctaaatggagtggaaaaccaacctccccaccgtctgatttccagcagttgcagctgagtgcatgaatgtagctaattaatcttccctaaattaatttccttaccatgtcagcagtgatttattggcgtgcctataaggagagttggtctatgatgatagtcaaagctgaggacaggaagaggcgagtagggggcgcttgtgtgtgtacctgcatgggtgtcccatatccctgagtggtgtaacagcctggtgctgtggacccctcagggccctggatgctggccataggcaagtcacacttctgtctcccagcacacaggcggaagtgcctcgagagttatgagaggttctccaccactttgccaggtgccccaactagggcatgaatcttacccaaagcaggaaaggggggaaaaaagggcattcacaaacattttcctttttgtgtttgagaaataggacagctgttgtcatgcataattgtacccattttccctggtaatcaccggggccttggcgggggtttcttttcacgtctttgtcctgtcttccctaccagattttcatcttctcgtgggcagagaccctgcctgaaagtgcttttgcccctcaccgcacttaccttcatcctggaggtgccatctgctctgtaacaaggacacggccttttctttataaattactgacacatccttggatcatctgattatttgctccttacaacgtttatgtgaagctgagaaggcaaaccaccctgctccacttcacaggtgacctgccgaaactcagagaaaacaggttgcacggagttacccagcaagggtgtagcagaaccagttccagagctccacttgcctggactgtccctgcctggctgcatcctttctgcactgccagctgcctttctgtatatttacatagcctcgggcagctgctgcagcccagctgccaccggtcagccttgggactttggaaatgctgcctgcctccgccatggcaggggttctgcaacccacttagccagtccttaaagccagggctctgcttggggcagctcagacctctacgtccaagttgagtctgggctttgcactgtatgtgcactagaaagatactgagtgtggcatccagccagctgaccttccccccaaagcagaagcccatcttagagcctctgtttggacaccccacgcagcaggagctccctttcccaggcagcgtgttcctttactggctgtcgatgtctttcctgaatcacctggcttgtgtctgtatggcttctgggtctgcacagaacatctgtccactaccgcttctctgagcggcctcatcattatttgaagccctctccagacccccaaatctctgtttctgtaatgtcatctttgttggcatggcaacagagcctccttcctgtggacatcaggcccgctagggcctgtgttatgggggggtcccaaaggaggactgggacttcaggcctcggagcggggacagaggcacttgtgctgctgctgccgcctcacgtccccaaatgctatttgctcaccttcaaggagccctcctgaccctcagagctggggagagggccagggctcccggcaagccaagacaaagagccccaggccatcattctctcagagtgaccctctcacagtcaatgacaggcctgtgtcacacaccaaaccgcatttttagccaggtgaataatgagtgttgaattacgatgcagtcgacgcgtcgcatctgtgcacctgctgccttgctaaggtaaaggagagagtgtcttgttttcactgttcattactgtggccctagacaggggggcttgcttcatgaccttcctatgatgtgctcaacaacactctgtgggtgtatgtaatgtgatgaggggaggcacaacttcatcaatgatcatattctctaagagattagtggcccccaaactgttaaggaaattaatgtatagtcttaaaggtgaatcagtgagaaaatggtctgactgggagcattgagaacattctcaagtgcattcatatgcggtttgctttggcatagagcagaagtcaagggcctggcaagaatcaggggccttgtggggtgctgccccctcactttccggggagaggagagcagcacagagacccttcagccagcaagacactctctcctttgccttagcagggtggcggatgtgcagatgcgacgtgctgactgcatcataattcaacactcattattcacctgtctaaaaatgcagtgtggtgtgtgacacaggcctgtgctgtcccacagacagcagggcacatgaaggtgaccatggggcaatagggacagtgtgggccactcgatcctggaagacagcagccagtctgcctctctcatcattcttttttttttttcttttgagacagagtctcgctgtgtcacccaggctggagtgcagtggcacgatctcagctaactgcaacctccgcctcctgggttcaagcaattcttctgcctcagcttcccaagtagctgggactgcaggcatgcaccaccacgcccagctaatttttgtattttttaatagagacagagtttcactatatgttggataggcttggtcttgaactcagggttatctgacctcaggttatctgcccacctcggcctcccaaagtgctgggactacaggtgtgagccaccgtgcccagcctcatcattcttttttattttatttttattttttgagacagagtttcgctcttactgcccaggctggagtgcaatggcgcgatctcggctcaccacaacctccacctcccgggttcaagtgattctcctgcctcagcctcccaagtagctgggattacaggcatgcaccaccaggcccagctaatttttttgtgtttttaggagagactgggtttctccacgttggtcgggctggtctcgaactgctgacctcaggtaatccgcccgcctcggcctcccaaaatgctgggattacagatgtgagccactaagcccggacatgcctcatcattctttttagcaggtttgagcaatttcagcagagattccctttgcatttctgcagtggctcctcttctgaagtgccaccagcccttcctgtagccgggtgatcttcctagaacgagtttgctgagagtaaattggccttggcctgaaagctgctgtgggtttcaaacagaaagccttgccttgcaagatcctcggggctaggatccctgttgggccacccccccaccccgtcactttcagggtggtgacagggcagaagtctttttttaaatttatttaaatttttattttcataggttattggagaacaggtggtgtttggttacatgactaagttctttagtggtgatttgtgagattttggtagccctctccccctgcacaggccgaattgctcaatctggagccagcccacatgattgcagaggggttaccatttcctccatgtcttagatcctggagatggcacgtcgggtcctctttttctccagttgacccccagggaagaaaacaaaagagctgcatgttagcacaaacttcttgcttcacttcaacgaacagggctgagcaatacctgggaaaagtacaattccagagtaatatctggaggcttgtctctagactggtggggaagggtgctggctctagcttattgtttcccaagctttcctgataaggatcacctggcttgcttgttaaaatacagattattggggctaggaatctgtttccttaacaagcgttccaagccattcctgtcttcaggcaagtttgggaaacattctgtctactgtaccaaaaatagcctgtggaagaggagtgcttttaagcaagtttagttttgcacatagtacatgaataggttctccttgtttgaaaatgttttaacattgcagagaaggtctcttttgacttcccctaagcaccccattccaagtccttccctccttcccaaagaggggtcagtttggagtgtgcatctcccagaccctttctttaacttaatagagatacaggtttctgttttgtttttcattaagtaggtatgatgttgtagttatcattctacagcttgcttgctttccattcagagctatgtcatggagtgctgtgccagctcacacagagcaactgctttttttaaattttttttttcagcctgctgcataatgttacatcgtatggaactagcacagtttatttagcgattcctctattgatggatgcagtagtttcgggtggtttctcatgattacttcaggcagcatccttcccatggacccttatgcacatttgggaataaatactgagaagtaaaattgctgggtcaaacttggcgcatttggggattttaatggattctgcccaaagttacccttgtaagtgtctccacccaagtgcatttccactgaaagcatgtggagaggacccaattctgctcacaagtgcagctgtcccacaaaagcaactaaaactctgaccagtccatagggaagtgtggccaaggggcaacacccaccttcctctagtcctttcctttgggatgaacagctgcagactacttcctatcacaaagtgaagtttctaagataaaaacacaggggccccagcagtgtgcgttccagagaggaggcatggagaggccatccccaggccactgctggtttgctaggtgactgacaacgccctgcagtgggccctgtggaaaacaaggggaggtcagagcaggtctccaggaggacaaacctgtggaagccctgtaggggctttgggctgacctggggtctgtagttttgtctgaaagcaagaaaggtgcttgcctggggtttagcactcatcccaagaggccgagcaaacaaaagatgacgtggctcactgactaagcagccgcactctacagcctttttttctgctactgctcagctctgcctctgtggctgccaggtctctgccaatctgagactaaaaggaaagcttcttgtggacccaggtggcctggcctgcagaggagtcccggctggctcccttttggttgaattgttcaattagatatacaggagttgtccactaactgggaagttttaaagcaaagcaaaagcaatcccgtcagaaatccaatctcacatctggagaaaactcattctctttcttttagctcaaaaaagcagcacgcttcacacaaaccttctgcatggccatctggactggcggtgagccccaggcagcttggacagtggtcacactgcccagtcctgatggctggggcccatggtacttcacagggcactctggttgactgcctgctcaactctcctaacacctggttgaatttttattcccaaaactaggacatcattttgcaaaagatcagacagttcagtgtagtgtttgcaaagtttcaggttgctcaaacctcaaatttctttccctccaccaacctcactttgaagttcaaaagcaaattgattaaatatacattttaggaactttccaatttgcttcttaaactaacagaattctagacttttttttttttttcaatggaaggattttcaactgtcagcaggtataactggaaccatatgtcagcagagaccaggggcttttcctggttttaggatttgtacattcttactgaaacggaagtaagtggagcaggcagccgcagctccatgacagcctgagctcagatctcattttaattagaaaatataggtagcacttgctgaatcacagtccttccagaactcctgtcccagggcaaacaaagatttggtttatatcctgcaaacctctgtgtttgcaaattacagagcacttctgagagctggaatggcgatttctagattactatggagactgcaacccaactgcctctcccaccccgccagcaaatccccccaaatgattttgttttccaggggagacattttttcccttccttattgcaaaatagatggagcatgttcatgttgaagagagacagtgaggaaatctgggacaagagaaataagattagatgtcatccacagcagcaactcattttctccatttggatgtctggccccttgaactctgagacacaaaaccctgcacctgaccagcatctgaactgttccgtttgacagcagtttatgtgtataattttctccctaatgtattctgcaaatggtagagtagaaatagcaaatgaaagacattgcaaggcctagctctctcccaccccttctttccctggcctggtgtcatttgagctcagtgagtctcaagaaaggctgccattacaatgtcagcatctggaagccacccctactgggtccccactgggactcagagcctgagccacagccacggagaaagtggtggagtagcggcagcgggagccatagatgctccagtgctgggcactctgggcttcggtcttcactgatgagcttctcttgtttggggagcagtgaccgctgtgtgctaaacctcccgttggcctccagccacttgccagggacagagctgccgcctgctgtccctttccgggcatcacattcctggcagctggcggtcacttgctcaccctgccaggacggctgccacaagctgccatttaccaggcagacaaagggggattttcccttcccctgagtttgcaggcccctcaaatgccttacattccaggagctgagagaacaggctcctgtggtttctaattaaacccacaatttaaataacaattcatgtaaccccaagggttgagaggaacgctaacctgccccctcccaagagaagcagccgggtggcactggctgaggagctgagggcttggtctttgccagaaatgtgaccaaaaagggcaagagggaagtcccaggacaagtttatgatgaagcggggctaagcaggaggggcgtggattcggtgggttctgtgcctctcctaaaggttaggaagtaaaaagagggaggaacacttgccatgtttaattggagcctgcaatcgagaatttttactcttctccagggaaaacgtggaacggtggtctctgaagtgttagaatcccagatactcaggttctcatgggagtgccccccacccccaggtgactcactctttgtctgtgagttggagaatttttctctggggagaagaggcaggggctgtgttctggactacagacaagtggggagctcaggcagggccctgggaggcagaagatctggccaagcctctgctcacactggacctcagtttacccatgtgttgtcgaggggtctttgggtttgttgctttcaggtccttactggccctggctgtctgtcgatccttgagctgcttttgtgtttttatttggtctgtctggggccacagtgatctttgtatgtagttgatctcaccaaattgttgtctgatgacccaaggcgtggttatgttccaggtctggggaaatggaacgccgagctaattatctctagacaaactcttctgtgcctcagccagcaccaggagcatgtcagcatttctaggctttctgtgatctcgtttccaacttttcctccacttccattccattaaaccgagcaactcacattccctgaggatgccctccaggttctcgcctccatgcttagtgtgcattgttaccttcaccagatgcccttctgttctcacctcactgtgcctggagccagccaggcatgcacgagctcagagggctcttcatcgcagtggagccctgccagtatgggtcccattcgttacccctgtgagatgtggagctccctgagtccgggcgccggctttagttcctgcctcccctgcctctccttgctcatctagctgaggcccaaagcctagctgtgaagagatgtgaaacaaaaaagccaaaggtggactcacacctgccatcttcctccctgcaggtgaccatagccgatgactactcagatccctttgatgccaagaatgatctcaagagcaaagcaggaaagggggagagtgctggctacatggagccctatgaggcacagaggatcatgacaggtaagtggagctgaagcgcaggggctcacagctggggttgtaggggtagaaagggagtgagggcactgccgggtggtccccaaccagcctcactgggggcatggtgtgtgctttcaagttggtaggtgggagcaatgctgtattaagtcttccccacagtttacctgcttatgtttcacctatattaggaaaaaaactggccgggcaccatgagagtccaaatacaaggatatcacgtgcagttaaccaaaggtaggggccaagaagtaagtggggagaggagggagaaaaagtagttctatcagaaatttctgagtgaagaaagatagcatttgagacataaaactttacttagagcttcctagtaggcagggcaaaaagggaagcaggctgggtcacctggctttcgttgcttagtagaagagagctggccagattactagtagagacaaaattatttctggccgcatcccgagaaatctttgttttggagctggaagcagcataaataaccctggtctacatgacaggtttacaggaagcatggagacattcccccagtggctgttttcctgttggcccttgatgacaaaaccttgtcaaagcaattgtgtggagtcaagaagaatgtggctgggtatgcagcatcctgggggcctattttagccaggataatacaagacttggagcatctttaagaagtgaagggttagcagacatcagtcatcttgtaggcaggattagggggaggtcacaagcaaaagggaaacccctgttgtggcttctcctggttcaagagggcaggccagacactgaagagcagctgtgtaggctgcccctgtgaccccacacaggcagtgccatgggcaggggcacatcagcacattgtgctgcagggtgcaggagagtggctgggagcaagtttggggctgcctgggctttggaggcctatcaaattggtaccctgtgtatctggacacttgggatacagatacctctttctgtggccctcttattgtttgtctggtttttgtttggttttttgcattcctgtctttgagcaccttctcctgattccttcttgaattaggagaaagaagggagaggaagcggcatttactgagcactgagcgtgtgccgggtccatgtccagcgtcagcttatagggctgtgtagccgtgcaggttgattgttgaaggatctgggtgcaccttctaggctctgcctttgctgttctctgcctcctgctcctcctgttcatggaaggagattctctgaccaccagtgtggcctccagaacacttagccacttcgtgagggccagggcagagagcagtggaccagagggacttaggtccagacttctggagcatccctctcatgcccactcccatctttctaatctcctctggcaaagcagcctcagtgggcaacaagaggccaagagttgagcttgtgtttggatctggggtcctgagggaaggcagcctgctgtcctccagtggctcagggaagcaggctggctgggggagtcctcaccacagatgtgatgcatgcctgggccctgcgacaaccacagccagtgcatgccctcacctccatcaggcttggtgagacaccagctctgtggaagccccaggaccagctccagcccttgggctgtggcctgcggcctgcacctccctacagctctgtcagtcttgcattcagcaggcgttggctccggtttaaaggagcagtggttacaggagcgactttgggtcatgttcagaatgtcagggtggggagggatcattgaggtcatctaaacctaacagcctcattttacagattgggaaactgaggttggggcgggggggacagagacttgcttgaggacgcacagtgaattgatggcagagtacaaagtatggcctgcgctttgcaaactttggggtggggtactgaaggaagtgtagtgtttgcatcagatgctggggcacctagacatgaggaaatggcaggagcccctgccagggaccagactccatgctgggcactttgacatataccctcattaagcctcattatgtttcttcatcatgaggctgagggaaactgagaggttcggctcctttcctggagtcgcaccaatagaagtaagtggcttgccctgagtgcagaacatgggacaggggctgaggtcccatggagccacaggcaggatgttgttacaggagtccacactcgggaatggaagggggatgggagagggcatctgctgggagccccagtctcatggagggtttgcccctgcctggtgccttaggaatggagccggagttccctactgggtgctgctgaagacctcaaaggtgagtagttgttcacctggctagaaattacctgaggaacttcggctttttttgagacagggtcttcctctgttgcccaggctggagtacagtggcataatcttggctcactgcaaccttcgcctcccaggctcaagcagtcctcctgcctcagcctcctgagtagttgagaccataggcacgtgccaccgtgccaggctaattttcttgtagttttagtagagacggggtctcactgtgtcatctaggctggtctggactgaagcaatcctcccaccatggcctcctaaagtgctaggattgcaggcatgagccactgcaccgactttgccttttaaatgagggtacaccccatggggttaggtccaaggcagggcaatttgattgaggcagtttgatttagaacctcttaaagacctcatgcattctctctccaaagaagcattctagcatatgctgctctgtgtttgcatcctagcttggcagctgtgccctagtttacccacaattcttatttttaagaatataggttattaaaaggggtgttttctgtttgtaacgatccttgctgaagctccctttgactcaaaattatttgtgtgtaattctttgtggcgtcaccccagtgattgatggcagggctgcatatgggtaggatgagccatcagtgcgtagatgctccaggaggcttgcagagctgacgtgaagcttttcgaaggggagatggtgggggaagagagagtggtgctggtgatggcagtggagtgggagtgacatggaaaaagtttaaccttttagaatgatcctttttggatgatattacattttatgtgtatgtgagcgtgtaacttgtagttacagggcatcatcttgaataagtaagcataacgctgacaagaaggctgtgccctccgtgtgccgcaggtggcgtacctgtacaggaggagcgtgggctggagtcaagcagatatgggatggtcacttgccacctgaatgacccagggacctcggttttcccctgcaaagcagtagcctcagagcaggcagtcattagtgcttctagccgctttgggctgctaactggctgtgcgacgatgggcagcacgttgtatgcccccatatttacttacatatggaatgaggggccggtgataacaacaacggggaggcagctggtaagctctctagtacttgcttacagcacttgatgtcagttcttaactgggtcctcaccattaccctttggagtataggctgcccacttgactaatggagaaaccaaggcacagagaggttaaaaaactagcccaagacgtcccagctggtaagtcagttgtggggctgacttcctagcctgtttgaaccatcatgtggagcattctttccagggcctctccagccttggtgcactgtagtttggttttcagattccccagcatagccgtcttgggcagtgattcactgacgaggctttgtcctctgtgtcccttggctccatgcagcaggtggtggggagattggcccagccctgtggactacagctaggatggaaggcgtgaggaagtgtgcctgtttctcccaggggctcctctcacccctgccctctaaatgcctcagcttatcctctccacaggctccagtttgtgtcaccggcaggaggtatgttctgcttccaagatggatgctcagcccttcacaaacctccgagcccaattgtctgggcctcacttgccatccccatcgcctctctcaccccagcagcatctctgggggtgtctccttaaaccctacagctctatggaacctagttggagaactagtgacctggtccaagctttcttttttatagatagggaaactgaggctcaaagaagttataatccttttgagattttttttaaaacccactgattaaatgtgaagctgtcttgtaaaccagtgaactgcctatccccagaggtatcagagcagaggcaagacagccagcattgggcagtgacatgaaagggagttgagtctcagatgggtggctggctcaagcgacttctgaggtctgcattaaccctgagctcccaggatgccatgtttcactgtgatctgcgttttaagcagagtgactcactagtcacccaggaccagccccacaaagacagcacctgagaccaactgaataggagggatctgggtagggctggcagcttcctttctcagtgctggcctggctaattgttcagtcctatttccccttttcatcttccttgactcgtctctcaagatcaaattctggtcttggccttttctatgccctgctgcccatctgggcctcagtttccttgtgtacaatttaaagagaaagtaccagagcgtttctgggttcccttcatgccccatcatctctgtatttggaatccccaggccaagcctcctgttgaggcagtgatcaggcagctagcttcacagccccttctttccctcttccccaggtcttgatcccaggcttaaggtccccggatgcatgaaatcctgctgatgcagcaggaagggcgctggacactgatcaggctgacttgggtgcctggataggtcagggtgcctagcccactgagagccgtggtgtcatggtaaaatagggcctgtgatcctgatgcccatgtggaaaacaaactttgcacatgtgcataagattgttgttattagaggacagagggcctgtttgtccttcctgtggaatgctgtgctgttgaattctctagttattccctgtaggatcacctacccacctggaagtaggttgcacccttgccagtgctggagcaggtggtccctgggccctctgcagtgcgctcggtcattgcaggggctccaggccgggctgtgttggagactacaccaaataacctgggcagataccgccactgccctccaggaacatccacagagcagataggcatggacctggagtggtcagtggtgggtgcactgagatgagcatgtggctctccaggagttcagaggagggaacaagggcttccaatttgggtgatccaagtagagtgggttgtgggaggtggcggtgatgagaactgagtcaggcatcccaggccgagggaaaagcttgagaaaagcatagaggtgggcccttgttgctagagaggagtggctggagatgaggcttttgatgggataatgataggaaaatctcatggggcaagagcatgtagagactgactgggatctggaagcccaagttaacctaaaggcacagcgtgtttttgtgcctgagatcgtctcttcactggccttcagccctaggaattctcagaggtaaccaaggagttatggtggcatggatgacagtcattagcttttgcaaagggcttccctgtgtgccaggcactgctccaagtactttccagagattagctcacttaatcctcgcctatgaggtatagggatgttcatcatccccattttacagaggagaatactgagcctcagattaaataagcagcagaaacagaaccaagatgcaccttctggagccctcgcttacaactaaaacactctctcatctgtcctgtgttccccagagtctgaggaataattggaaaatttagttacttaggccgcctttttagatgttactaacccttcctctggcatcctttataaaactgttcaaagtgtcatctcacaggatgaatctttaagcattaattgaaagcattttcacataatttttaatatgtaagcaattacacattaaaaagtccttagcatgtttttattattaaatcaactttatagcctaataagaggaaattaaagtcatttcacacagagcccccctgctttgacgtggctgttttccttgcttacaactggccttctgccctttttaactgtgtgctagtaggcaccgtccagatgaagccagtcactgattttaaaggcaagaggggattttttttgtattttctcatcctctggtgtggcctcttctagtggcaacatgctctctgggagaatcatggggtttatcatgttaaagacgatgttccaattgtggcctctgtgtttcaggagaaaggaggcaggaagtacaggttctagccttggctctgcccctggctctgcccttgggcaggttgcttctcttctctgggcttcagttccctcatctctaaaatcagattctgcctccttcactgggtgtcaagaggattcttagaggtcatgggtctggagtgacttcataaatcctttggttacccgcctctgcggtcacactgggcttctccagctgcccttgtcaggcctggttctaacagtcctgagggtcctgccccacccccagccacctccatgtggcatcagcctcagcccctcccaaaagcatgcatgctgctgtctctgctctcaggacagacaggacaccattctggacagccagctctagaggcccttcctagggctcctgttctctcattctggaatgaactctcccggagaccggcaaatgcttctcagaaaaaggagcctgtgagtcttgcttgggtgtcagagaagctgcctctggccaccctgcctgagacttcagccttcctctcatatttgccgtcagccctgacccctggttccaggcagcactgttcccctgagctgggaaagcaaagggccttctgtctgggtcctgagtccaggccattcccagccccagctctgtagtgccgtggactctgctcccaggatgtccacacacttgcctccctgcacagctctgctccccaaagcctgtaccctgagccccctcacttccttctgtcctgctgcctctcaccctctccaggcctcaagctcctccctggcctgccctccccaccaagacaccacaggcttcagcctgtcctggtggtcacagctctcccccagctggatcatggcaggatggaactgtccttgaggagcagtgcttctggccccatataggcttcctgcccgaggcccagagagggttgtgcactagccaagtttacacagcagcaagccacagggcaagtctcctgacttccatcctggagctcctgggccttattttgaaatgttgtgaaatctgttgtcaatcctcctgcctggcaggtagcaggcttggtcgtagactgtgcagagttccctggctggtctgtcatttgccagaatgacttacctaccggacaggaaggagatcatcaagtgtaaatagatttcatattagtcacctgatgactttcctattcttaagaaacagcagggctcacacacccagcccagtggtgctcacccgcagagctgtgggcggggagagaagtgggaagcctgggtttccatggcgaccagcgggcccactctaggagccacttcctattctctcaccccggctcccctcttgtctttgacccctgacactgagcacgttcaggttttcaggaaagttgcagcaggcctggaataggccaaggagagcagacagtcattgatagcacccccgctgtgggctgagggtccttgccctccaggtgctcctgtcacatggggaaggtggacaggggcccagagaacacttgatgtctgtagtataaaacaaactaagaaaaattacactggagagagaaatctggtcttggagaacacagaagaaggagtggtacagcctctgggaccaaagtgtgctgcacaaagagggcagcatcccagcaaagccaagcttgaggtcctgactcaaaatgacctcctcagggaggccttctggccacttatcttacatttccacccctcccccacctctctgatgttgttccttaacacttgtcattatttagcatattacatactttttttacatttcccttgtttgttgtctgtctcactgctgagatgtggccttcacaagggcagagatataggttttgttccctgttagaacctgaagtacctggtacaaagtaggttgtcagtaaacactggttgaatgaatgagtgcattaattcactcctgggacctgggctggtccacagagtcctgggtgcccctcaggagcccagggacctcctatcctcctccaaagaatgccagatctggaaagtctgagtttagccacttgctaggtgggcagggaggctgccttggcgtcagggtgggagttgggtgggcgttctgaccagttctgtctccgcagccggcggactgcatagggatagctgattctgcctcttttccttccctctctgggccgagagctccgtgaaggaagggactggtcctcacccatcttcatttctcttctgggcccagtaaatattcaccgattgcatgaatgagtataggaatgcaagtctgtatggagaagaaagaaaaggaaacaaacaaatactcactataagcagcctctcccattctgctgtgacttgcttgcttgaagtcacagggcctgggtcaggggaaaaatgcagtgcattcattcattgactgggtggctatttgtgagcacctgccatgtgctggcaccgttctatgctcccgggtctatgcatgaacaaaacaaagttgttctcatggagttaacagttgagtgagggaccaaggtggcagtagcctacccatgattccccgaaactcatttactagatgctgtggctccgggttatcaagggctggaattcaggggctttctcaaagtcaggagctgagtggagacttgtccccagggccagggccaccttcagtaggaaggatggtctcagtgctgtcttctggggataagggggacagctgtggcccagtggctggcaggtgtgttcctctgtccttggccccagtagaggagcacgggccctgagggttgccattggttttccccgtgctgctggcactaagcctcatagatgtgagggcccaacaaacagattgcagtcctgctgagcgtttgtcagcgagggctcaggcccctcggaacacatccctaactccttgtctttcctggcagctgtgagagaaacgtgcattttacccaaggtagaaatacaggaataggaatgtgaaatggaggagttcacctccccaggcctgcctcagccttgcatttcagaatcccagagagacattaaaagatctgaaagtgcagaaactgatggagatacctgtcctgaaataggctcagggagactcagattaatctgcagcaaagctcctgcatcctgtacccgcccagctccctgcgtgctgggcagggtgtggaaaccttgcggaaacccacactgcaggggtgtggcacgattaggaagtcatttaggaaaacaggcccgcctgggagtgtgggatggaatcttgcagcgcctagcaagaggcagggagacaggttctatggttccgaggctatagcaatcatctaggccaggtcaggtgctgtggagtcagggtaggtgtggtggaagggcccaccagccagtgggtgctgtgtggaagggagaggagagggtgggatgacaccaccagtggggtcctctgttagtgggaggatgggaaagtcagtcacctgatggggcctgtcctatctgagtagggaagggaggttcctggggaggagtcagagttgagatgtggtcacctttgaggtgggagcagccagctaggtgcttgggagagattgaatgcattcatgtgttagggaaggtgctggagtcagatcagaggagggccccaaactattccagggacctgggggccaccatgagaagtcctggcctgtgtttctggtctggggagaggagtagtatgcagggagtggccaaggagacagccggccacagttcctgcctttcagaagcctgaaggaggagattccgtgatttgccccacaccctattatttgactaattaattagtactctcctctaagtagggctcaggctggctttctggaaacttacagagatgacagcagtctgtgtttaaagggtaccttttatatatgataccaggactctccctaaggctccgagaggaagcagatgagatgatttccattttgcagatgagaaagctgagtcctggtggctgacaggacttctggccccttctccctacagggatcactgcctggtgatgcaagggagggatgctgagtaacagcaggtctgagtcctcccttggtggcggcaatgtagccggtgcctcaggttcagtgctcttccccatctcctggagagtcctgccttctccctttcagccagcttggcccgtttgcgttcctgtggttagtgagggctggctgtggtccttttccaaaacaggcagctgagcagaaggaaataaaatgccacctcttcactctccctttcagggtataggcgtgtaattgtacctggccaccttaaagcaccgaaagaggggccgtctcccaagcccaagcctcaacttttgggcctctcttttcctactgcccacgtcaccccattctgtccatatgccgtcacagccctcaccatgtccactgtgatgtatctgctagactgggaacccctggagggcaggatgacaggacaggccggggccagggtgtcttgtgctcagactgtcggtgccctgtgtttgaggttttggcctggaactttctggtgaagaatgtcccctcatccagaacttgctggttttggtggaatgatgtgtgcacatggtgagtaaacatcccccacaaatctctcagctcccagaactgggtctcatgcctgctgggccggctcacctctgccctggccaatggggcagtgtgtatcctgtccctggcacctcagctgatctctcacttgctggcctgtggccgtgttccttcccatctgctaagcctcgagtctctgcgtggacgctggcacatgcactcatgtgcccgtgcccccagccacacagccctccgtgaagctaccctctctggcaactcctcaccaggtcgggggccttccaagtcttcatgctgccctagtgggcctctcttggcccctgggtcccccttccccaccctctgcccctcaggctgggttctggagtcctcaacttcctgaagtgaatggccttcatcatgcctgccttcagctctagcctcttgctgcccaattcagaacacctctggcctggtccccccacctttgccagcacagccctgggagggtgggctggggggtgcccacctcctcagcagatctttattcactcagctccaccgcggcccttcccttccgagtcccacgcagcccccagcagctcaggttcaccttccccagaagcctctgcatgcttcaggctcccgatctgctgctttccccaggtgcctgtggctcaaggcagaaccaggccagctggcattcagttttctgctcaggtggtgtttactgaagccctgtgctctcatgcccttcacagcatctctcctaagcctccctaaggcccagggagggagcgcctgggttgtttccattttccagtgagaaacctggagcagaggcttccgcaacagctgggggcctgggagcacctccaggaacctgggagttgtgttccaaagcccaggcaggagcagggcaggcagtcaatgggccggatggaccctgggctgagggaagcacatgggcctgagatagatcccccgggccagctcctgccctccccagtaacagaagcagaggcctggagccaggaggcccccagcaacagcctcaccaccccacacaattgggaaccagccggtgggcgacagcatcctcccttccttgacctcttctaggatttgcttccatttctgtgctgtgtcctttaccttacggagaactgtttctgctgagtgagtctttactgggggaagggttagtgctgagccactgagtggcctgctccagtgggcactgagggacatagtacagttgggacagtgtcagagctatgtaagatagaggaggggcagcccggccccatgctcctgtcctccccttcagggtgaagctctggagggtcttcgtggagaatccatggaagccctgctgttctgggcactgcaacgagcacaggggctgggaggtggagcccaccttggccctcccctcaggagggctgtccactgggatgtggcttatgactgctgtcatgtgtgggtgtagaaccctgccctcgtgggacggggagccgcggggaggatgtggcccattctgcttggttaggggtggatgttggttaggactgggtgggaagggtggtggaagcggttgcagcgaggggcatggcctagccccagggttcaagggtggagttggaaggaagtagaggcctcagcctaggacagaacccaaggaggtcctgtgtttagctgaaggggactcagaattgtgaaaagcacccacctggggcaggtccctatgcctttggctcgcccatccctgcccccttctcactctcatccccagcacagcccaggctgccatgcaaagtgagctgtcctccagctgatcctcagaggaaactagacaatatttttaattattgtctaatttacacccagaaattaggaggaagggcttggtccttattaatagcccagcctgtttacccctagacttgaaactaattttcatctggaccaagatttgttgtaaattcccaaggctccgtactaataaaaagtttctggctgccttttgggccccagccctatgccctgggtctggctcccaaatttgcagaaatgtgtgatttcttggggtgagacagggtggatcttaaaactcacggtctccaccccagggaacttgatgcagggtcctggagtctgcaggatctagtactgcagttaaaattcacagtctggttttagctcactttttaactgaactgtatgtgatgctgttggaaaagcttgaacttgggcattagaacctttcccctctctggaaatcttctttcacagagagagaattttagagccaagctaggttgggggactagacagatggtggtggggctagggtgaggagggtgtgggaggagggttctcacaactgtcccctgaatggtggcctgagctgaagtcctagcccagggccccttccagtcactaggatgccttcttatgtgtttcacgtggttcggtagtgctctttcaaagcaaggcctcctgccctgccttcccctgtaggaaccctgtccaggtcggtcagggttcctgtcctctaggtcctctgcagggagtgatggcttttccacctctctgtttaagcatttaggaggaaaacttctttgtttcaggacacgtatggctttgtagaaatttctaattaatattgtcagattgttggcatttctctaatttcttccaagactgtggccttcagttatatgtgtggggttattgctatcaccatttatatttatttctccttttgctgactactcacatctcatttcatcctcagaacaaccctggaggcagtccttgctatcctttttttaagatagacaaactggaaaaccagagaatcgaagtgacccacccagggtcagccagctgtagtgccagggcttgagctagggtctctttgctatatcacatcagtccctgtccccttcccctcccttccattaaaaagagtctgtgctcagagccaggtcctgtgaggtgggatcagggtggatgaaagtcactcaccaccactcgtgctctctggagctcatggggaggatgcagatggccttttctcttctctcctgttcatctcctttgggctgttatctacagaggtctcagcgggtaagtgtgggtgaactgccaagcgctcaagtcattgttctaactccatggtagacgctgggagagaacctttctgccagcaaggatgtggcctccaagggaactaaccctaaccctctgtggccagccagtctcctcccactctaagaggctgcttgtgcctcagtgtccctggcacctggtctcaccatgcagcgaggcaggaccgcagaagacctaacttggagagtatcgaacccaacccgcctggacatggcttccaggtcaaagcgtccaaagggcttggcctggagaagccatccttgtctgaaggacagaactggccaggctctccccagcccacaaagagccttgcatgtcttcccattcagggtgaggaaaggcataattgtgtctggacagagccctgggtttgacactagccatggagctgtaattatcgtccttaattacacgatggtgcctttgccaggaaggtgtgcttgacgattatctcctctcctgacaagggtggttccgtctccctttgtaagtactgatgtaaacacacaggctcacttgagatttcaggattaccaaagagccattcagagttgcctacctaaggacccctgcctttcagaggagaaaggggcaagccaggtatcagccatgcaagtgctttcttgcctgctgctgaaaaagaatgtccatttacctctgagttgacttggtctctgaaaccgaaaaaaagaattaacttttccctgatgcttaaaataaagaaaaaaggaagagcaaaaagccatgtaacagtgccccatgcgtttacataccaagcacatccctgctgattggattctcacaccaccctggcgagacaggcaggacacgtggtgctatctccattgtatagatggtgagatgaggtctcagagaggctaagggactttcccgaagtcacataggaaaccaggactaaagcactctgccagcaccctgactaaaagccaggctttggcacctgcagggcagtattttggttcattttgtgagatccctcaaccccaactggctctggggctcctatgtggcaagtaaagcctctcagccttgaggggcttccgagggccaaatgccatgcactttataggactgaattgaggggcagcccccaaagactttggaggccaaatcacactgcatttcccaatggactgtacaggttagcccagcgttgcagacagaatcagcccacccggcctcggaacagcgccacctgggaatcagcacacagtgcagaggatgggaggctcaggagaatgcccccgccccctggctctgctcaccacattgggtcaaggtgaagggcaggctgccctgaagatccatgagtgcagggccttccagggtcagttggtaccatggtcaacatggggaaacaagggcaaggtcgtgggcagtggtgaaaatgcggattcctaggccccatcctgtagaggccctcactgaagcccgagaacttgcactgtaatacatggctccatggctctgggacagatggtcccatggttagagagtccctgctttagcaaagagcttaggcctggggtctccttcagttgttcaagctgtggtctggcctggcctggtctgccagcagcagcaattctcgctgacttctcgctccctctcttttctctctccactgcctgtgggagggatggacatccgttctgttgtctccttgaagctacctgtgcaagtcctgaggacccagccctgggcctgtggaaaggaatggaaaccacccactcaggtgtggtgccccagcctcgtggctcttcttgtcagccttcacaaagctgtgattcatactggaatcttgtaaatctctgaatggccaaatagaacagggctgggggtagagggcatggggtgactagtggagagagtcatgagctggaggctgcaggagtgaattgcagctcctccgacagccggtttgagcttggacaaggcatgcctcagtttctccatctctgaagtcaaggcttcagccagatcctaaggtgactttagtgctaacctgtcctggtagtggtggcagtcacacaaagacacgctggatgcacacagggacacaatctcccagaacacagaagcctcccacgtgctgctggtggttgggctgctgcctcggctgcctttgtttgtccccagtctctgtcagacctccactcagtatgcggcgcttggtgtctgcagcttccactcagcactccagaaacctgtttgtgagctcaagtcacactagcctccctaggggatatctttccacagaagcctactttcgaattgggcctaattgtagcatatatacctttaaataattttttttagtgtatttgaaacagctgtcattttgcatgtgcatcagctgaataaagtggagcagccatttgagctcctggtcaccccgagtctgcagcaggcttccttcaccccttgcaggagagagacctcagggaggagagaagctaggaggtttgagaacagagtgagatcagctcgcctgctagtctcagcctttcacagatccctcctcactgtcccctgatgagtttcccaggcctggctagatcatgttactttcctgctcagagatctccactgggttcctcagatctgagcccagactttccaggccttcctcaaatcccacaccctatagggttcccagggtccagcagcaccccatcacccacttgctttcctgtgtaaacgctcactgtcctcctcactgaggggctccccagggctctgtgatcccgcagggacttcctccctcttgttctgccttgctcttgagttcctccagcagcctgggcagggcctgagtgactcacagtgggttccccagagcctagcacagagcttggctcttgggaagagctggttgaaactggatgaaaaatgggcctttcctctgcttccatctcatccttgcctttgaagtcagtttaatggctgcaaacatattaatcatttggatttcctgtttgtccctgaaaaataagcattcaaaataggatttcgaggacaggcagggcagctcacacctgtaatcctagcactttgggaggccgaggagggtgcatagcttgagctcaagagtttgaggctaacctaggcaacatggtgaaaccccgtctctactaaaaattcaaaaattagctgggcgtggtggcgtgtgcctgtagtctcagctattcgggaggctgaggcaggaggattgcttgagcccaggaggtggaggttgcagtgaactgagaccgtgccacggcactccagcctaggtgacagagccagaccctgtctttaaataaataaacaaaataggattttgagaccatcagaacatgtgctttcctggatttgaaaacaggcgatgcagagaccatgtatctggccctgagggtggtgggggaggttgtgagtctctggggcgcctgcagttctgggaagtttaccgtttatggagtccttggtggtcaggaagcccaggccagcaggatagcggtccagctcagtactgtgttggggccctggccctagtgcttccctccctcctccctcctccctccaagctgcctgctcccggccactggtgccttggaatcgtaactcagagctcagagcaacaggaatgctgtaaatccccgtcgcgctcccctttacaagcaggcagttgggcacggcggcactttacaagagaaagcagctccaccacagcagaatgcagcaagtgcctgtcacacgggctgtcctgccactgcctctgcttgctcggttggacacagtgggtaccacaagccaggaagaagcatcactcttgttcatccccatcccatcccagggccctctgccccttagcagggtctcctcctgggcctcaggcccccagggccttgttgtcctttctgccacttgcccttgtcacacagtgagaagctgctgtcgccctggacagctgttgtttgataagctggccatctgccctggggtgatggagcagagtgcctcggcctccgtgtctctgtgatgtgagaggtacagggttccagtcctgaggtggtggagctggacagcccagaaggccaaccacaaagatgagataacttggggtagcagtactttaggagttttgcccactctgcagtcattttgtaccctcctgtgccagcttctacactgggcgtccagagattgacataaatgagatccaagccccagtggatgtggactcaggtctgacatgtcttgggctttactttgcgctgtggggacctccacagaggtatttcgatcactcaggttccaggggaaaaggaggcaggaaaggcttccaaggaattggagcttggcctaagtcttaaaagatgagcaggccaggagggaaggggctgtctaggcagcagcccaagctcagacctggaggagaggactagctagtggctctggggacccaccagtggtttcgtaggtgctgagctgacacctgagttgggtcctgaagttaactcagaggtgggtgtcatgtagagaagagggaaaggatggcttgcaaatggagatacagcctgtggccggcatggctgcagcttcaagaacttacagaggggagacgtggctgccaagatgttcgatgactagttcataaagggctttctgagccccctaaggggcttggactgtacccacaggactatctggagttgttgaaccttcacctgctcccacccacctcctgcctgtcagcttcccatttccctgactcagactattgagctcattgaaatcctcctgacaccaggcagacacacagattgatcacatagagcctctgctctcaaacctggatcaagcaagaaaattagtccaggataagccggtagatatggagagtcacagggcagttagagccagcactggcaatgtcttaaggccttgggtgattaattgacatgtgaatcagacagataattagtgctacattggggtaccaaagggacagaattcttctccagggtgattaagagactacagtagaaggaggggagatataggcccaaccttgaatgcctttgggtgttgaatgaggagctgaaagaaaggccattgctggggaggtggggaccagcaggctccaaccttggcccagagccagcacatcagtggacactctgtgtctgtccaacattaggagatgaggagccagttggtactatagagataagggctttagactctcatctaagtgttcattgaattaccaaatttttttaaagaactgctgctttatttaggctctgggctcctatgtacatgatcacagaattctgcacacgtacaggcctcaggcctgagttaaggaccctccacccaagggctggacaggctgcaaggctgtcccagctatgtgctatttctccctgttgagcaggcttcaaccatgagtaccagctaagctcagactttatgatccaggcgagaaacaggaaagttcatcctgggtgtgagggaaggggaggggttcagatgctcctgaaagtggagtcgcttcatgcagcctgtggacagatggcctggtggcttcctcagcaggctgccctgtgtccactcccacctgcagaccctggctgactacgggcacacagaatggctgcagtcatttcggcttggacattattcaaaaccaccatttcaggtcatccaccacatagaaaaatctctacaaagcaccctggtacatttcattttaaacagtgggagctttctggtgaaccctgtaagagaaattagttgcaaattaaacccccaggaaacaatgatttgacctattgtatagaattgttgggtgtaagccaattggatgttcaaagacacctgcctaagatggtgatttgggtctcagagcaactgattttaaacccctctggcaaacgtaagggagtgccgtcaagtgtcttcagaacagtgaccttctctgcagaatagatgagaatgatgggaatcagccagcatggaatgaggcccctgcaggtgttgggggctttctggataagtttgtcgagcacccttggtctcattgctccctctgccccctaatattccttctgatattaatatacatgacattgacggtgaggaaagcaagctaggaaggaggctccccgctagtggaggaggaatgagagtgtaaggacctttggggtgatgcaagattcagtagggcctctgaggtcctgtgctccccaggcttggagcacgctgtgacccaggctggcctgtggaggagcatttttccagactgactgacagtggccagagctgggaaaagcagggccttctccccatcagcagtgggcaggtggctggaatatcaggcccagaggccagcaggtatacacagcagaggagggctcgcgctaagaggagtttaaagattccttgggagggtggggtgggacttccccaggaaagtgtccgcctctgtctcaccaggacaaggatgagtgggatgagctggagcctcagcggtcatgtggcctgtggctggtgcctccctccgtcaggggacgtgagtgaaatctgaagtgcgtgtctgtgtggtggcagctgtaacgtgacagctgccgcccgcctgcccttcccccagcctgttctcgagtgaggaagcttgtctggcagcgccaactcagctgtcatcccacatcaatttttgtaggttcccagctagtggaagagtgccaaatgcaagcagatgatatacttaatgaaacactcaggaagaacgtttcagttccagatattaagggtttgtgtgtcatgttgctgagccctggaatcagatcatgccttctcagccttgtcacagagtacagggctcttccttttaggggtgaatgtaaaaaatatttcacggtgaggtagatgtttatgctattgaagggcagcatacatgactgatattatgaaagaaaaaaaaacgagaagtcttccccatgtggacataaaccgattgactggtgagtcatttataccagatgtcagctagaaggaaggttgtgtgtctgcgcactctatgtatattcctcatatgtaacatctgcatggggttttatggttacaggtctcttttatataccttttgtttggttttattttaaacagcgccatgaaattgatattaatattctccccactccacaacagaggttgccaagtctctactggggcaaatcgctccccagagggcataggctggtaggcggcagagccagggtttgaacctaagtctcccgagtccagttccaaaatgaacttactggtatttggaattgccagtgtatttcgtatgtggaatcaaatgggaagtaatcagtcatttgagttacatttgcatttattctaacctgatcaagttggaatgagggatgggacagaagagaataatatttatatgcacggtgctcttcattggttactctttcatatctactgacttatttgacttttgaggagctggaagcagagagaagttggaggatttgctggggtcacacagcttggagtggccagctgagagtccattccagatctcatggtcactttctactctctcacattgcagtgttgctataaccatctataaagtaacaaagggataatatgaaaaagggtgattctgtaagtaaatgaaccactgaggtcaatcagccgcctatggttccattattttgcagacaaggaagctgcaaaggagacggggtgctgtctggggtctcccagcagcagctggggccaggcttctgactctagccatgttccacccattgccgtcctgggtctcagcttcaggcaagtcttcacagtctaagttttttgtaggtctttgagccaatagacaggaatgctcttggagttgatctcagttctgtatcgtcagcttcctatttagaagagaaccttaaaattccaaagttcaggtaactcctccctgccaagtgagactgtaagctcaggcttatatcaaaaattccgtatttctcaacggtgaagtccacatttacactcccagttatttttaggtgggaactttatattttctttttttttttaagggagaataaattaacaaatatatgtttaacttacattaacacaaactcaatgtttatgttaacataaagaataggatttcttcattgtaatttctttttattattattattatactttaagttctaaggtacttgtgcacaacgtgcaggtttgtcacatatgtatacatgtgccatgttggtgtgctgcacccattaacccatcgtttacattaggtatatctcctaatgctatccctccctgggaactttatattttctgtttcatatcacattggcttccctgcctaactgaggttatattttctgtctcacaatagtgttggagcagccttatttttagctcagttcgtttttcttcctgtgacttcctttttcttgtttaacacacacacgcgcacacacattcaagtaggcatccgttcccatcgcactctccctgccagttctcattcacttggtcacaagacttcatccaaaaggcaagtgttaagcctcatctcattccaggaaaaaaggaagaggaagagccttcagcaaacctcaagaatcttcttgtaacataggctgctgcttgtcattttattaaaatctcttcacctgtcgctcacctcgcctgccgctaactcctggctgagacactctcatgtgcacagctgataagaaatgctttggagctcccttgcagagaaacctattgactgctgttgggggcatgttctcaggagcttgggtatcaggctcctagagggcctagagtgtgagactgtgtgtgtgtgtgtgtgtttgtgtgtgtgtgcatgcatatacgtatatggtgctcaccagaccctgtttctatctctgatacctgtagcatttgattctggtggcaggcaccccatggagagcacttgcctgtggtcctgtggttgatgatccttgttggtgctgtctagttcatttacaccatgctgtatggtggcaggccaccggtgagaatccagtctaaaatgttaggaaacaggccaggggaacacgacttacccagccccctgcatgggataaagtacggggcagaccccaggcccctgctcaccccgagtcttcctcagaatccttcagtggctccctgttgcccctccactgaagtgtaagcctctttagcctagtggtacttgagcaggtgacacacttacctagccccaaagaagaccacgtttttaggccatgagcttctctaaagctggaccaggtttttatttattttttatttttatttttttgagatggaatttcgctcttgttgcccagggtggaatgcaatggcgcgatctcagctcactgcaacctccgcctcctgggttgaagtgattctcctgcctcagcctcctgagtagctgggactacaggcgaccaccaccacacctggctaatttttgtatttttagtagagacggggtttcaccatgttggccaggctggtctcgaactcctgacctcaggtgaccctcccacctcggcctctcaaagtgctgggattacaggtgtgagccaccgtgcccggctggaccaagtttttattgttcagtgttttcccataaaacagcaacacaggtgctccggaggggaggagtggaagaatgaactagtgaagtgatatgttgtatctggacctcctcctttacctactctagccactagtcaccagaagcatgtttctggtgtgggagcctgggaccccatgttaatctgtgggaaagaacctgtcgtggtgctgcctgtaaccccttcagatccctcagtgaggcgtagcctcttctgacagggtgtctgacctccttcactcccaagcacaccttccttcacagagcacagcctgtgggttatcatccatctcagtttggtttttggttcagagctttgctgatcaaaattgggtgatgggcatcactttgccttgtgacttagagggtatcaagcttccaggagagtggggccctttgcagtgaaaccatgggtcccaaaaagtcattaggcctgtccttgtagctgtgtttttagggaaatctttcatcatttcctgtgctgagaccataactatggttctttaataatcgagtacctctgtggatgaccagggtcatgtttgggggaatgttataattaaaatgtacatcttggagttgaaaaccaatacataatttgttccaaacttaatttcctaaacttcaaaatgtataaacattacatgaagtgaaaattgtttagaaatactcttgaatgcagaagcccatttcactggaatattaagtagaagttgatggaattccatgacgcagtgtccctgaaagcgtggagccctgaggagagcgtgcacagactctgatcagagaagcggaggtgggaaattctagccctgccataccagctcaggtatctgccctctcagtctcagcctcagtttccccatctgtcctaggggttaatgtagaactcctggcactgtgcctcattccacatagaccctcaacaagtgctgtcacagatattgataatatcaaacaggagagtcttcatgtgccacatttgcaacttccttttaaaattttaattatcacattaggtaatatgtgctctgagtaagaagattcagcatacaggcttataggaggtaaaaagtgaaatctccctcccgagacaaggattgttaataatttatgtattcttatagcccttttcccatttgcttacaaaaatacacatctgtgcgtatctacaaacacagttttctacattaattctatcctgccaaacattattctttgtcacagatcttgtctgaggtcatttgttctattgaacgattccgtgtgactgtagtgtgatgtgttcagttgttttcctgttcatagacttgtaggttattcctagtttctggtcccttcattctgggctcccttcattctgtagcaaaatttgtgagcagttatttctgcctgtgggtctggatatttctgtagagtaggtttctaaaagtggaactttaggccacaggatatttacctctgaaaagggcatttccagtttatactcctccaacagtctatgagtacagttccctttttagaatacacaaatttttttttaaacatttgttttctgtgctaaattctgaatttgcaaaaggctgtgtgtttatgttattccatttcaccagtatttgctgagcatctgtggagctgggttctgctgtgggaatcacaggggatgtgttaagtggattcaactggaacttgacccccagaggtggggtggggtgagcctgagcacgcaaagggctagaaaatggtagaagcctcaaggctcccagggtggaggagagatgacagtgggagtattggattcatctctgagcccctgtaccacctccaacacccttgacagtttagagtacctggtgctctaaacagaggctgaaacttgaagctggagcagcagcatgtcagcagggcacctagaggggactccattggaacagaccaccaggggagatgaggccatctctactcaatcaaggtgcctccagtctcgtgttctggaagttgatgacatctttcacacagtctggaacctcttaaggacggcttttcagggccctgagcaggggctattctcgtttcttccagcacaaaaatgttgattatccagatgtttccttccacataattcttgggatggttgtgtggatggtgtcatctataatagctattgacaggaaagagccgcctgagaggaattttgaatagtggcaactttcaggttcctggctcttgtgcatggcatcccacacacaccttttccttccccactcctctttaaaacaaaagcgaaaacagcaacaacaacaacactttaatagggttttatgtgctgtaacaccaagaaatacaagaagtgacgttagagttggaaaggccattagggtaggaagtggagacatagtaactgtgccgaccgctcactctgtgactttggcaaggcccttcaattttgagtttcccgtttccccacttaaatggagttgccggctctgtctgcaatcaggtggttacaagaaccaaataatgcaaagggttttgtggaccttgaagtgctatatggaaggagggagtcttgctgttagtcctttttgttaaattttggttgacccctggcaggtgatcgctcctgggccaggtaggaagtcccaccaagatccttgggctcatggtggctttgctactgtcaagtctcctgaaggaagaattgcaggtcctcttagggaactgctatttggctgcatgcctcgttctttggggtcaggagaaggggcagacggatccctctgtattgtgataaagataattcctcatagacttgactttgaattgatccagtctttgcaggacctttgtttcctaagaagagaaacagacaagcagctagtctaaggaccacgttctggacatgtggggaaagggctgtccatagaggcatgtattagggttctccagagaaacagagccaataaaatgtgtgtgtgagagagagagtgtgtgtgtgtgtatgtgcatgtgcagagagatttataaaaaaaaaatggatcatgtgattatgaaaactgccaagtcccaaaatttgttggtaagttagtaagctggagacccaggagagccagtggtttagtaccagtccaagactaaaggcctgggaaccaggagagtcaatgatgtagttcaagtctgaaggcaggaaaaaggctaatgccccagctcaaaggcagtcaggcagtagagttctctctgactcaggagaaggtccacctttttgttctatgcaggccttcaactgattggatgaggcccaccaacaaggaggggtgtgcaatctgcactattcagtgtactaatttaaatgttgatgtcatccagaaacactcagaataatatttgacgaactatctgggcaccccataggacaaccatgttgacgcataaaaagaaccatcccaggcaggaaagcacagctttgtgtatggaagagaagcttgtcggtgggcagagttcttgttgcatgtagtggtcggattttggaggcatttgctggaaggtggtcaggatgccaggtcagcgtccaacatgctagtaggatgggtgctcttgacaggtccccttccaccttaacttgatggagccacagcattagcaagttacaagaagaagccggtgtgaatatccactctttgtagaagcagactgagaaactctggagtcagaaaggcctctgagatcatctggttcaacccctctcacctcatctgcgaggaatattagccctgatggatcaggcagctggccaaggtcacacagctggtgagcggggagccaggctggtcccaggctggcagcctcgtcattgttatccagaaggcaaaggttgtctctcagtccctggggggattagtgcctctcttgaagcagttccaaagtgaagaagggtgggcagagcatgtgccaagatctcagcaagttgcttccgcaggggcagctgtgctgggcactgggcacattgtcaacagcacccctcagcttgaggcagtgaccctgtgacgccccaggtatacaggtggggctactttggttgggaaggctggcatgtggtgaggggtacctcagcccaggtgaccagggcccccagggtatataggtagaggggaaggtcctccccagcagaggaccctggctctactctaggcagctggcaccctgcccccactaccagtttgtaatcactaagcaccagccaggccggcaccagcagcctgtgttggccgcccctctgacgcatctagaatgtgctgaatacctccttggtgggccactctcttcctcgtgataccaccccaggctttcctcccaggccccccaaccatgatgaatcctgtagggacttgtatgtggtcagataaacctcagggctagagggcagggagcctgagattactccagtgaccctgactgatgaccaactgacagccagagggaggaagcgacttgcctggtgtcactcaaccttgtgggatccggacagagctggagctgggactgggctctttagtgcctgccttccttgctgacctgaatgtgtccgtgttcttttgtccctagtggagtggagggaacactgacttgggctggaaaggcactgtagatagctgcacagttaaggacatggactttggagccagactgcctccatcccttcctcgcttgccctgtggctgtccataaaatggcagtgtctgtggggtaccacctcatggggttgtcttgagagttaaacgagaagctggatggcatgcacttagcagactccagcacgcagtgttcctagaatggtgattactgcactattgacaattgagtttttgcgatgttggcccaaccactgagcttgtctgagctgtggacttggcagcagtcaggcggggagggtcctggctgcaccacagcccctctgaggttcgctctgtgaggttctgtgagagctgcaggtgaagccacttggtgagcagggaagcccccacagggtaaggggtatagccgtgactggtctggcgtgaaagcctgtcccctatggctttacctcattagagtgtggtcccaggcctctctggaggcagagaccgcaccgtgcccagcagactggaagatcgcgtgtgtggggcgctggcccttcgtgcagctgtggtctgtcgatactcagaaggaacaagctgggacgcacatctgcctgtgtgtgctgcagccctgtgaagtccctgctgggccctggctttctgcagcacaggggccccggggatgcccgccctgtcatggttggcctgaggatgctgatgccacccgtgctagcccagcccctgctcatcatcccagtggatatgccagcatttccacatctgggggctgttcacaggagtgtgttttgctttctggagccctgggcatcttctgcccacttcttgaaagggtggagccctagttgtttggaaggcccaaccttcagattatcagtgtctagttaccacatccccatgtgtcctgccagcttcttaaaggattttgtgtatgtgaagcacaaacccaatgaaggctcctggtccacctttcccagtttcttgcctttagtggctgcacccctagtcctggcatcccagatcctccatagctggccccaccttctgtgggggccattccctgtttccttctacctcatgagcattaggcttaaggcagcaagaaccctgattttcacctcaacatcccccagctttcctctctcccaaacttggtttatgcttgtcctgccccagttgccctttgtcctgatggcctcatcgtcctctcctggagagccttctacacctgggcccactcctcgctgtttgtgacaccaggcagggtccgttggcatccctggccctcaaggtgtctccttgcatcaggacttgagattctgtgaaatgccacctcctccctgaagttttactgaatcctagggctagatttcctttctgcctccatcaagctgctggtacatacaccactctaggacgctgggagccaggcagaactaggcttgtcctggcttagcctctgctcctgtctgaacctcagtttctgaattataaaatgcagtataactcttgcctctctgttttgaggatgaggagtaatttactcccagtgcccaggacacaggacagtgcctggcgcaggcaggcgctcactcgtcactgctgtccaactcagcgcttacagacggtggtgtcccgattctcctgctaagccatgagttccctaggaggcaggaccctcatctaatgcatctagtgctcagcatctggcctcaggtctaatgtggcacatagtaggggttcagtgggtattcgaggaagaaaaacaggcaccccacttgcctatgaagttggatgttgcagtcggcgaggatttagaaagcagtctcctaagtagacatggctcctttaaagggaggcccactcgccccctgcttttggcccccagagcagcaagctcgcctcagtgagtctccacgggggatggcgccagaacgcaggcctgcagcggcttagaggcctccgcacgcaaaggcagtcactggaagatgcagagtgatggtagggctaatggacactgtggatcattgcagagctgcacggcaaggtccacgtggcctttttactcacaatgaaagcaattggtcgtcatcaggtttgcaggctttgtctctcttcgagtacttcaggccagaggggctcacgagaagaccctgtccttgtacagacaaccaagggaagggagcaaacccaggcaccctgactccagacttgggcctttcccttgccctcaggctgagcataaaagatcaggcagtacaggttcagccaggcagccataggccctgctctgctcctaaggtgaccattgttgtcccacagccctgcttccgcagagcccaccctctgttggttgggtgtttctgtgcatgcctggaaaagagatgacagaagaactccaattagtcagtctcctggctcctagacagctccggaaactagactagatagatgaggaggaggtggggcctcctgccgtgtgacggttggggtggctccagctccgtctctgagctgccctgccctgccttgcccttgccgtcctgcagccctgctcttccatgccactcaccctcagcctctgagggacccctgaattcagacgttgaagcaccctggttagggggaggattcttctccagcagacgtttgaatggtttagatgggggtaaagtcacctcccttttgatgtggcacctggaacttggctggttttgccgcgtgtctaattaggaagaaccgcctggcactcccgcagagctcatcgctcactccgtggtgccaggtgtgcttttaacacctcagggacctgactgcaatagacgccctggccccagaagaccaaaaacaagacagactgatttaaaaaaaaaatgtcagaaagtgtctggaaaaggccaggagagccctggtccaggagttaaggagcctggggcctagtccctgtgactttcttcccttcccctgacctcagtttccccatctataaaatggggtgactagacatacatgagaccttccctgtgtgtttcacgttacgtacaagagctgacctagagtatggctcctatgtgggggtgtcagattatcaaagtggcactggcctcgggagttgtggacccagaaatggcaacaggctcaaaggttggtattgggaccctcccgttcccagtgcatttttggcctgtgaggcttcagtcagcaggccttctgtggctctgtgggcaaagacagccttggaggaggaagagtcttggagatggggctccaaggaagcccccaggagtggtcgttgaaatggcaatattcacaaaacgccttctgtgcaccaggcactgttcgaaacacttgacgtatatggattcatttaatcctcgtaacatccttcctccagtgggtgccgttttctcccctctagagatgaagaaactgaggtaacttgccccaggtcacctgttggagccaggattcagactaagcactctagtgggatcggtgttttcacccagcacacagtgctgctatgcctgtcggttcacctggacccagggctttgcctccctccaggtggttggcgaggggcagccccgctaagtggcaagtgcatcattccagtaatgcagcccttcctgacaccgctggggccctgagcctaatctacctgcaaccctggcgtctcaggcacggatccccggtggctgcaaagccatgtgagagagatcagatggcatgcctaccactggcagaatagaggtttcctgggttgagaggtagtggcagggcctgggagtgaagagccatacaactctacctagcttgctaccccatgattagggagtggtatggattcccagacaagcccagctgggaaaattagaggtgaagggcctgcaggccagcgtctatcatttccagcaaggctcctgcacgtctgtgccagcctgtgtcctgcccagctcctccctgcccagaggttcctgggcatcactcctttaccactcctggggatgctgccgtgcagtacttttaaggccatccagaaacccacttccatctgcctccagcatcatctcccaccaggtacctgtcagtccccagccctctcgagcaacctcatgtacaccttaagcttttgactccctgggcctctgccttggttcttcctctggtacccattttcgccgccacatcactgtgctatgacctcctgtctaaattcttttaaggccctcccaggttcccccaatggaaacctgtctcttagttatcagattgtggtatcaagtctgctcccattaaggaggctgagctgtgtctgtccctgttgggagctctgccttctcctaccaagagcttcatgaaggccaggactgcatctcattcctctctgtctcctctcatactgggcattcagtagatagttggttggttgggaggacaggtggatgccagcacagctggaaaagatggagggggggggggcaccagagaggcctgctgatttccttggcctcagttttccagcgagcaaacccaagccttttttttctattcctgaagagaaggtaaagaagtaaagaacaggtttcttctgatgtttaccataagacatgttatgtatcatttcattagatgcttattcttttttttttctttgaaacagagttttgctcttgttgcgcaggctggagtgcaatagtgtgatcttggctcaccacaacctccgcctaccaggttcaagtgattcttctgcctcagcctcccgagtagctaggactacaggcgtgtgccaccacacctggctaatttttttttttcttctgtttttagtagagacggggtttcactatgttagccaggatagtttcaatctcctgaactcatgatccgcccgcctcggcctcccaaagtggtgggattacaggtgtgagccactgcacccggcctacttatccattttttttgagacggagttttgctcttttgccccggctggagtaaagtggcgcaatctcagctcactgcaacctccgccccctgggtacaagcaattctcctgcctcagccttcccagtagctgggattataggtgcccaccaccacacccctctaatttttgtatttttagtagagacggggttttaccatgttggccaggctggtctcgaactcctgtcctcaggtgatccaccccccttggcctcccaaagcgctaggagtacaggcgtgagccaccacatctggcccatcttctttcaaaatacagattttgagactctccataataaaatgtttaggcatacttcattttattgtgcattgcttcattgtggtttgcaggtattgcattttttttttttttacaaaatgaaggtttgtggcaaccttccttcaagtaagtctatcagcatcatttttccaacagcgtgtgctcattttgtgtctctgtgtcacattttggtaattctcatatttcaaacctttttattattatagctgttacggtgacctgtgatcagtgatctttgatgttactgttgtaattgttttggggcaccacaaactgcacccacagaagatggcgaacttaataaatgttatgtgtgttctgactgccccactgactgaccattccttcatctcttcccctctccttgggcctctctattctgtaaaacacaacaatgttgaaatcaggcctattaataattcaacaatggcctctacatgttcaaaggaaagggagagtcacacatctctcactttaaaccaaaatcttggaaataagcctagtgcagaagtcatgtcaaaaaccgagatctgccgaaaggtaggcttcttgcaccgaatagttagccaggttgtggatgtaaaggaaaagttgttgaagaaaattaaaagtgtcactcctgcgaatacacaattgaaaagaaagcaaaacagccttgttatgctattagagagagagtttggtctagatagaagctcaaaccagccacaaattcccttaaatcaaagcctaatctggagcaaggccctaactcttcaattctgtgaaggctgagagagtggaggaagcttcagaaaagctaacagaggttgatttctgaggtttaaggaaagaagccatttccataacatggaagtgtgtggtgaagcagcaagtgctgatgtagaaactgcagcaagttatccagaagatctagctgaggtcatcgatgaaggtggctatgcaaaacaacagattttcagtgtagacaaagcagccttctattggaagaagatgccatctaggactttcagagccatagggaagtcaatgcctggcttcaaagcttcaaaggacaggctgcctctcttgttagggactaatgcagctggtgattgtaagttgaagccagtgctcatttgccattctgaaaaatcctggagcccttaagaattatgctaaatctaccctgctcgtgccctgtgaatggaacaacaaagcctggatggcagttcctctgtttacagcatggtttactgaatattttaagcccacttttgagaccaacttttcaggaaaaaaagattcctttaaagatactactgctgattgacactgttcttggtcacccaagagctcagctggggatgtacgaggagatgaatgttgttttcatgcctgctaacacaacatccattccgcggcccatggatcaaggagtaatctcaactttgaagtcttattatttaagaaatacatctcataaggctatagctgccagagatagtgattcctctgatggacctgggcaaagtaaactgaaaaccttctggggaagatttactgttctagaagccattaagtacatttgtgattcatgaaaggggtcaaaatagccacattaacaggagtttggaagaagagtccagtcctcacagatgactttgaggccttcaagacttcagtggaggaagtaactgcaaatatgatgaaaataacaagagaactagcattagaagtggagtctgaagatgttactgaattgcaggaatcttatgatcaaacttgaacaaataaagagttgcttcttatggatgagcaaagacagttttcttgagatagaatctattcctgatgaagatgctgggaacattgttaaaatgacaacataggatttagaatagtacataaacttagttgatgaagcagcagcagagtttgaaaagattgactccaattttgaaagaagttctgccgtggataaaatgttataaaacagcctttcgctaagagaaatctttcgtgaaaggaagagtcaatctatgtggcaaattttattgtctcattttaagaaattcccacagctggggggaggggcataaaaaattttccacagccacctcagccttcaggaactaccaccctgatcagtcggcagccggcaacatcaaagcaagaccctccaccagcaaaaagatgactcactgaaggcttagatgattgtaagcagtttttggcaataaaatatttttaaaattaaggttctacatttttttaaggcagtggtattgcacatttaataaactacagtataatataaatataacttttgtatgcattggaaaaccaaaaaattttacaggtacctgccaccatgcctggctaatttttgtattattagtagagatggggtttcaccatgttggccagactggtctcggactcttgacctcaagtgatctgcccaccttggcctcccaaagtgctggggttacaggcatgaaccactgcacccaactttggtgggggggcctgttttttttgttgttgttgtttttttgttttttttttttcagggaggcactaagttggtgaatactggagcagagtatagcttgttgcttgtggactgggcaatcttttaaacccccatcacatcctctcaggattactgcctgctctcttccccagcccttaccttctccacattcccatgggcagaccccgccatggccgcagtctgtggggagcacacctgcctagctctcctggtgaatgggcccaggcaaattcttagggtccctttcagttcaaacattctctgattctaaagaaagtgctttagtcttcttttctttctatgtatgtagttctgtttacaaacctttctgctccagaggtcaacagaaacccccatcctgttaatgtttctgctttctgcctaagaggcatgaaattacagactgccacttaatattaaaggtcattttgcatgaatgtgtagatgctgatgttcagataacttgtgacttaaaacatatggtcacagactcccttgtgagatcggtctctggaccctcatggattggcccagctaataaggaagacgggcctggtagttaggcaggaggcagcaacatctggcaagctggcctggcacaagggccttcgatgtcctggagctgttggtgagcctctcccaggagagaagatgctcccaaatgggcattttctcagggaaaggcagctgcttcctaaatacacgcagctcctggaagcccagcctgcttaaaatcatatttactctctttcatgtgctcatcttaattacattttttctgctctagtgtctttattcattatttaaaacaactttcaaaaataattacgcgataatcccttctcctctacacagtagctgtttaccttcctgtattgggtttttcagctcttggtgttgtggatgtctgtacttacaacgttgctgtcatcacagtgtagatataggccaaatctgtgatgtcagtatttaccaatgcccaggcaaggagcagaattccctgtggggccctgctcatattgacggagacttgtttaaaaagcctgcattatactttgccccccacacataaacaatcttgcattttactttttagcttagcataatttcttgcatggtttcccatgtcgctacataatcttcagattgatcattttaatggctgcttaatattccatccagttaacatgccataatttacttaactcttccctattgttggggccttaatgaaaatttgaattcgccatgtaatgtagtgggggaggcttgttttaatgattaccgttataacatcccctgccctaactgcatgccattactagtccagctttggtaaggtgcagatgcttctggaacaataaatcctgcatgagaggtgtatgcacaagtcctctgatttaatagctaatctgttcactgcacatgtttccctttaaggctggtgtttatggagaatatctgtctctaatgcatattgtttaacactaaactgtatgcatttggcatattgtcccagatcctttatcactactgtcagggactttcataaagtatctggaatttgggggtaaatagtggtttctggctgtcagttctgtttcatttatcccaccacattcactgagtatctctttggcatgagagtgagcaaaagcactcctgattatcaggggcccgacgggaagtacatctgtgaattgtttgtggttcctttagattaaatggtgaattgcatgaaaagtacttcatcaactgtgtacatgggagtggttgctggtcctgcttttgtgaaggagggtgaagaggaaggtggttttcccaggtcagtgccttctcagctgccgtatcctcagcccccagaattctgcagacaggaggctagacttcactcctcagaacggaggaagacgaatacaggtgatgaggaccctacaagacaataagttgcagattagtttggtagatttagtgatttacgaagttgtccaccgtacttaacagttggtcttcaccgtaaagtgacaaagtcctaccactcttttcccttctcttttcctgttcctccctctgtaaaaaaaggaagcatcatcctcaaaactaataaatgatccgagtttactcatgggacccaataaaagctgtgtttgccaaagtgtgggacaccttctcatagatgtgatattaggtgccctgagaactacatagtgagaaggtttttcccttcttattctctctctttccagggagagaagattattcatatttgccagagaaagtgtctgtttgctgattgcatttcccggtggctctccaacacttgcaaatctcacctctcagcagagaaagcaagccccacgctcagcttcccagcaggcatcagcacctaccttgctggtttttattcattctgcttagtatctatttttggcaaagaataatggcttatgggatggtgatccaaagtctcttttttaaatgagtttattttatctaaaaagtgaggcgagataaataaaaatgataagtaaccacccaggttactaccacccaactggtaggcagaaatggcccaagtcatgaagtcacatgactaaataaagcttgggaaatactagcataaagttaattcatgtaaacactaatgatcacaggcacagtatccttggcttctgtttcttcgtggcgtgtgtccacatgagccggcctgaatcataaagcccagcctgaaagcagctctctttctcggaagggctgatgtcatttgtgtgtgttttatcagctgctcttcaaggagcataactcctgtggcttctgccatatctttatgccatcagaattctgatttcgggaagacctcaagagagcattgaaatagctcacttacagtcctcaccccttttgcatcaaggctcacctctgctccctcacctccttggacctggtactccagccaacatggatggtaaatatacataatgatggaatattagcctgaaaaaggaaagtcatacacaggctacaacatggaagaaccttgaaaacattatgaaactgaatgattccacattgttcaggatgtgcctagaccgatcagattcatagagacagaaagtagaagggtaattgtgggggctgaggagggataatggggagagttagtgtttaatgggtacagggtttcagtttgggaagatgaaacagttctagagnnnnnnnnnnnnnnnnnnnnatagtgtgaatgtacctaatgccactgaactgtacgttaatcatggctaaaatggtcaatgttggctgggtgcggtggctcacacctgtaatcccagcactttgggaggcagaggcagggagatcacatgaggtcaggagttcgaggccagccttgccaacatggcaaaaccccgtctccactaaaaatacaaaaattagccaggtgtggtggtgcacatttgtgctcctagctatttgggaggctgagacacaagaatcgtgtaaacccgggagccagagtttgcagtgagccgagattgtagcactgcactccagcctgggtaacagagtaagactccatctcaaaaaataaaataaaataaaaaagtgctcaatgttattatatgtattttaccacaataaaaaataaagtaggcagcaagcacgttctttccagcctcatcgcattggcttgccctggtcctaccaccagaaagccacccctctcctgcttccacttgtcagagctgacagttcaaatgccatctcccttccctcctgccctgccactcccaggccctacactgagccccctttgccgccaagcatgatggtaatttaggcacatgttgtgtctgctgggaacagtgaggttcctgaaaccaacctccatggtaaaccttccccacattccccgcttgggccatgcacatagtatccatgatcaaacagcaggtaaaatttccctgtttgactgggaagtgcctgattttagcatcctagcatccatccttccagccactactggcctcccaggactgagcagcagccaaaatgaacacctcctgtctgggacctcatctagacaggcagtcatccctcagcccacaccagtgccaggccttagcatcttctctagaagatcaagagcttgctttctttattcagaagtgaagctggacaccctctcaaatccctaaataaattcagtctatttaaaagatggtctgggggaggtagaaataaagggaaggggtcactcaggctttgcgggggagaaaagtggcctctggtctccttggggaggctcttgttggttcttttaaatgaatgtgtgagctggtgggaactgggaactgcatggcccagtcttttccttgtacagatgaggactgaaagtccaaagagggcaaggaactgccctagagggaaagaccccagcctgtttatgaagcaaggggtcagaagctctgcgtgttctgggtgggcatcaggacacacctggagcatcatgttcacatctgggctctacctcttaagcctgagattcatgagtggatggaggcagggctgtcattaggcctgcgagcatgtgagccttgtgagcaagcctggcccaggaagagcagagatgcggcactgggggttggtggggtgggtaaaacccagacaggggtctgtctctctgtcgttctcacctccccgctggcagctctgagtttgtggtgtttctgggtgggaatgcaggtgaggaagtgcagtatccatttcatctctgcttccttcctttttgcctgcagaatttcagaggcaggaaagtgtccggtcccagcataaaggtatccagttatatgacaccccttacgaacctgaaggccaaagtgttgactcggactcggagagcacagtcagcccccgactgcgggagagcaagctgccccaggatgacgacaggcccgccgatgagtacgaccagccttgggagtggaaccgggtcaccatcccagccctggcaggtaaggagccctgaccctgctcaggaggcagctgctgagctgcgctcagcactcaccttggtccccacctgcgctcaggacaaactccagggttgtttaataatccagttgggtggtcttttttctcagtaccctcaaagatgtaggctgcagaggaaagggagaggtgagggtagggaaaccaggccgaggagaaattctgggtctggcttccagggtctcagtgttccagcctccacactttaaagagagggctcagatgctctcattgtctggttctgtcttggtcctatttattgataataccctagctcactgaagccaagagttcagtttttggtttatttatttatttatttatttttgagacagagtttcgctcttgttgcccaggctggagtgcagtgatgcgatctcggctcaccgcaacctccatctcccaggttcaagtgattctcctgcctcagcctctcaagcagctgggattacaggtgcctgccacaatgctcagctaattttttgtatttttagtagagacggggtttcactatgttggccaggctgctgtcaaactcctgacctcaggtgatccgcccacctcggcctcccaaagtgctgggattacaggcgtgagccaccacacccggcctgatttcagttttcagaaggaactttcttagaaggtaagaggaacccagtgtgcacagcagctcctgttggccctcagcgggcccattgatcccacccagtgctgcgagctgagctagccctgcagggctcacaggaccactgtgtcttctatcccagtttcagcgtgcacacgctcacagagcacaggtgatggacagagctcagcccctcccagatgaccctcccctggccaagagccccttgagtgacttgggtatctccttcctactcaaaggctggtttttctagaatctgggtatctgtcacaattctagaactcctctcccacagcccttttgaaaagtgatcttgggcatgtgcatcataagtcataaatctaagctaacacctttttattctaatcccactccttagaatctgtgccaaagttatgataaaaaattcagaaggccgggcgcggtggctcacgcctgtagtcctggcactttgggaggccgaggcgggtggatcacctgaggttgggagttcgagaccagcctgaccaacatggagaaaccctatctctactaaaaatacaaaattagctgggcgtggtggcacatgactgtaatctcagctactcgggaggccgaggcaggagaatcgcttgaacctgggaggtggaggttgcggtgagccgagatcgcaccattgcactccagcctgggcaacaagagcaaaaaataaaaataaaaaataaaaaaattcggaaaaggcactgtttataatcatggaaaatggagagcaacccgaatgtccagcaatggggactggatttctgtgcgtctgtgtggtggaatattggaatgttgtgtagcctctaaaaggtgatgttcagcaagagttcataataacctagagaaatgcttatgtctaatgttaagagatgaaaagccagatgccaaacaatgtttaggtatctcagagtttaggcatgtaaaaagagagacagtgagtgacatttaattcctaccacactgacaatcataaagggaaactttttatctttagtttgtttaaaatttattttgccttaaatctcccctttttttgtatataactagaccctttctacctttctaaccccgaacagtgaggcctctaccctgccctcatcccaggccccttaattgctgttctagccattccaacacagattactcacagttctgtgaatatagcatgcgctgagcaaatcccatttttctagctaaaatgcccttccctgcctgtcttatctggaacaattctatgcctcctttgaggcccagcttaaacattatcatctctccaagccctccctggtacacagccatgcactccacaggcttcctgctgcccctataggtctgtcgagtttcctgcatacatcactgggggaagatttctcacaccacatcagggttagttctgtaggtgttggtcttgcctgccaggctgtgaggtcctcaaggacaacctgtcccatcacctttctggagccccagcccctggccgagagccaaagataagagtcatcctgtggctgcaggtccttagttgccccaggtctctcctgtgcattttacagcctcctctgttcccttgaaccaaaggaacccaaggtctgtcccctgggcatggctgatcaggggctgtgtttctctgggcatgggaggaactggggccatccaagagcttactctttgcaaacaccagtttgattaaagggctaaaaaggctcatgtgacaactttcccagacaccgaggacccacattataacgcagcaccacaggcaggtgtggggactcaccctcccctggactgaccccctgtgggcctctcaggggctgcccttgcctttgatggtctagtctagtctggcatcttgttactcaaagtgcagtccctgaaccagcagcattggcctcacccagtgctggttagaaatgcagggtctcaggtcccatcccaggcctatgagtcagaatctgttttaacaagatcccaggtgatctgtgaaagtgaaaagcaattcccctattggacatcatctttgaagaaaactctcaggccagaacttgcccacttctgcccaaaggtggttttagaactcctgtacatttagttgttcacaaaggatcataaggtctcagatggaactgtctcagaatgagtttctgagcccacaagcatccgttttggcctgggttttgtgtggcagagttgccatcacaggtgtcacggtcagtctgagttattgggctgttgatagaagatagacagagaatcacatccacgtctgtgtctcatccggtcactggcctctgtaggtcctactccagggcgggtgctggctgtgcttttcccaagctgcttttggctcagttctgcttcctggggcatagaaggaggaggccatctcactcaggagctggaggggtcctatgggcaccagccttctcttcccatgtctgtggacagagtccattaggcgcagcattggcaggtgagaagcatcctcactgttactgtcgctggagggaaagtggagaggtcggtgggccacctctcaagtggtgaggataagttgaagcagcttggttagattgctgatgtgttgccacagccccatgtgtaaaaccagaagtgcagcttcccgggaaggatggcgaggacccccacctgagtcagtgttgtgtgtgcatgagagtgtacatccatctgcatgtgtgtgggtgtgtatgcaagtgtatgcactcacacttgagcgagtcgttggtgtggtcagtgagtaaggcagcttggctgggccccatccttagcatagtacctgtcagaaatgccctgtgcagttttttcttggcttttgggagctctctgcactgagtctttggagcctgaggtgcaggatccatagctggaggaagagctgtatggggtggagttggctggccaaaatcattaccctctcctttcaccccttatatttgctgattgtgcagatttggcctggatggggaaacttgggcggggaatggggtcagtgctttcaaatttccaaagggtggagagtgtgggggactcctaagggacagacctgggcctgccaaagggggagtcacagggatgtagggcccaggtgaagggtaagaattttggttagaactgaatgtgtgtaatgagcttcccatcactgggggtttgcaagcagaagcttgagcgaggcagggctctgacaaagggcgtgtcctgggaggtcagtctgcaaccagctctgggtatgcatccaggcttcattccatcagagcctcagcgtgctggtcagagacagggagaggggaagatggctgaattagctccatccatctatgaagcaaaagtgccttccagctttcaaagcactgtcccgaattgcgttcaagaaaagcacctctcaggcactgcctcagcattctccactggggcgcccttcttgggcagtgtttctggaagtcagcgccttccttcccatctcatcaggctggggctgccaccgcggaaggctcagttatcacttcccagttgtcacaaaaacagctcttagagtgtgtgaggtggccccaacttcttaggaatgaaagtttccccttctctgagaatggctgacatggaatttaattaaggattcagagagttgttggtgagaaatacttggagccgtccaaacagcaaaccctgggtgttcgttgcctgctcttctccaggaagctgactgtggcctcaccagacccccactcccacttgtcggatcccaatccccaggacaatgcccagtcaggttccaccacgggctgctggctgcagggagtggactgcagctctgcctccacagggaagtgatgtggcttccatcaagctgtcagcccccttcccacccggcagagacaccagccttccagagcaggctagactctgttcctggcccactttgaatcaccccaggagtctttacagcaaccagcaaggccagcagttgggtctagaaatggccttcttgctctgtccccaacccacccccgccagatgcagcttgggcccacacgaggcctatgtggcaccccctgcccaatgttgggaaggggacaaggagccttggatgatgtcatggtgtctgggggtggtgcaggttggtgtggcaggtctacctggttgccaggctgtgtggcacagattgcaagatggacaaatggaacctgagcagaaagtggccacgtagggaggggcccacaggcagggaccaaggagctggggtggatagcctgtagaagcagacctcggtggaggtggcaaagacaccaaatcggtgtcttcacacctctgaaggaccagtgtgaggactgggcatgaacatgtcctgggagtctcagtttctccacctgggaagtaagaccagtagttcccacttcagaagggtcttggtgagatttgatgggtatcacatcaggaaagtactggcattgttgctagcatttactgagcactttctgtgtgcattctctcattcaatcctcataatcaccctctgggaggttagtttcctccttttacagataaggaagctaaggtcccatgagaagaaataacttggctgggggcccagcccatggctggtcagcagcagagccggactttgaacctgtcagctccaactccagagcccctgccctaacccagtcaaatgtctggcctctctggtgctatccaagatgctgcaggaaatatgattggagctctcatccccccacagccctcaagaggtatcgcatgcccttcatctcacttgcactaatttcttcatctcacttgcactaatttctgcgacatctacaccaggatatgtaactgggtggtggcttcccacctgaaatggttccagtcagggtttctgtgggggactgggttctggaggttcgtgctttcattggagggggaccagcgccatcccatgggttggtcttctcctaccaccactcagcacagagaggggcccgtataccatagagtcccacataccatagagtcccactccctgtccttctggggaaactaaggctcagagtggagaagggaacagctggagacctcatggcagagccagtcaggccatacatagaggaatgaccagcatttccttttaacccagtgagtaaacggctatgtctttaataatttgcacttgtatctgagaagtaagtaactgcagctcttgagcttgatagaggagccagatgacaggagggtgtgtgaagggcaccccccagaccttcttgagaaactaagtcatctcatttcgattcaccatctgaagctttgtctccgtgaaagttactcttcaggcagtgtccttggctcagccaggtctgcctcatagcaaagataaaagacacatgactcaaatactgctcagcatacttattttgggtacttatctgtcttccccactagctccttggcagatttctctgccctagaagtttaggacagtgtcttgcatgttgggacccatggggcaatgggatgagtcagacagtcccaagttcacatgccggctccacccttcaccacttcgggacctgagacagactgttcagtctccctgagccttagtttacttatctgtaaaatggggatggtcacaacttctcacactggatctctgtgttgattaaataaaaacaaaagatctgaatgaaaagacatggtaagccctaaaggatcatttggtgttttggttttcagaattggttttggtgttcagagggggcttgctgtattacataaaattcaatttaacataaaaaccatgttgcataaagaagtacttagtggccacagaggacctgtttccaaagctcattcccagttatgcctggcaatgggaagcacggatggtgtggaaagcaccacttcttcaggaaaccccatatcccaattccagcaacagttctaacgagtcccctggttcttccattctttactcagtccctcccgaggattgggccactggtcccctgggtgggagagggtccccagggccttcctccgatccgcgccttccctattctaggtctgacatgtctgtggatttcttttttgcctggagcagtaagtcttaaacttgaaggcatcagaatcacctggaggaagtgttatacagattgctggggttccacccccagggttcctgattcggtagatccggggtgaggcatgggagtttgcatttccaacaggttcccaggtgatgctgatgctgccatctggcgaccccactttgagaacatagagggtacagagtacatgctttgtattaggtgtggggttggggtagagttagggaggggaagtcacctcctccaggaagctttccctgacacaaccggttccttcccctctgtgcttctactacaccctgtactggagtacattggtttattcggaaatagctagatacgcactagacactgtcagcgtgtggggtgcttatgctatggtatcaccccttagccagcctccctcttgagttttgacaccttcaaagcctcatcaaatgaggctaaaagggaaagtaaggccccaggtatgtctatttcctaaacaactatgaatcatctcagagccagctcaactagctaatttaaaataatcccattaaggtaaggaaggatggggaggaaccagggacaggaaattaacatttattgagcaataattataaacctggcataggttaaccctacagagccttgcaaggtagggttcacttcattgtcgtcactcagatgacagtagtgaagctcagagagggtgagcagcttgcccacagtcacacagctgtgaacttgggccagtctgactgcacagcacttgttctctccactgctgccttgatatcctgtgtgtggctggggtcaggctggaattcccttgcacactggtacaaggcagaagcagttgcacccataccatgttgccctcgtgacttgtcaccgtccccctcaaacacagtcgctctgaagctggtttaacaccaccattgtgtgtgtagggcactgctccacacttgctattcccaccaagctatgtgactcatcttcacgtgctcagaataaacagggccccggcatctgcagagggtcccttggagaaccttaaacccggccaccaccaccacctgtcctagccaggagaatgctgtctcttccaaactggctccccttaggctcccatgatgcttcctgtcccctgtatagcttcccagaatgccttgagcctgtgaggaaattaacaattgtgttggtaccaaatgctttttgctatgtaatgagtaacagttgtaattaatgtttaacacctgtgaacagcaggtctgcccaggaaaggggggtttcagtgagagaacggggatcacttgtttcctttggctaatgtattactgagggacaggtttttccagttggtttttctatttgacgtatgaataaattcatttagtaatcttaaaaaaaggagaggaaaaaaacaccaatgtttaatagctttgtttcatctgctaattacattgatagaaatattcctccaagtgcctttgtctcctcagtggaaaaaaaacaaagatttgatagaatacttttgctcttctgtttggcagctcagagatcttcatgtggagatttttaagttccctgaggtcagagaccctgcctgtcttgttcacacctgtgatctgtgcctggcacacagtgagccctcagatatttgagtaaatcaggccggacgcagtggcttacgcctgtaatcccagcactttgggaggctgtggcgggtggatcacctgaggtcaggagctcgagaccagcctggccaatatggtgaaaccctgtctccacttgaatccaggtctctacttgagtccaggtctcctgaatcctggaggcccctaacaagttcagcataaaccctgtgtgagtgcaatacagtctcaaaaacaaccacagtaaccacagtgatacatctatgagcactcactgtgcccccaactctcagtgcatagtaccgcccccactgtacagatgaggaaacagagacagcttggcccaggtcatcccgccagcaagtgacagcacaggactttaaatccagataccccggccccaaaatacaaaattagctgggcatggtgacaggcacctataatcccagctactcaggtggctgaggcaggagaatcacttgaaccccggaggtggaggttgtagtcagccaaaatcgtgccactcactccagcctgggcaacagagtgagactccgtctcgagaaaaaaaaaaaaaaaaagatatttgagtaaatcgggtctcaggaaaaccaaccctgtgttctcttaggagcagtagaataccagtaaatctcatggcctgcccacacacagtcggtgtgttttcatgtctttcttgcatgctgtatacctgtctcctcactaggtgaggcagtaggagggcatttctgagtagccattgactgctgtggctgccacctctggtctcaacttccagggagaagtggacagcatgtccctgcctgtctgaggattgactatgaatccagatgccacattgtgggcctggagactggtgtgttggttgggtgcaggcagccctggcaagccatatttgtggccagtacctggcttgtccccccgacctccactccccatctctcctggcctccctcacagccatccacaatgggcagcagagaaacatacacagtggggctggggctttgggtcttatggacagggagactcatttccacaaatgcccagcctgctccttgcaggtctttgggcttgtggatggggaaaaagtcactttcccaggctctaggattctaaataagtgtctgtgggtgtctgcaggtgaaagtgtcgggagacatactgtatcagacgtgtgtaggtcccaggtatgttttacagatgggcctggcccggaactcaggaaggagctcaggtgctggggccaggggtatctggatttaaagtcctgtgctgtcacttgctggcgggatgacctgggccaagttgtctctgtttcttcatctgtacagtgggggcggtactatgcactgagagttgggggcacagtgagtgctcatagatgtatcactgtggttactgtggttgtttttgagactgtattgcactcacacagggtttatgctgaacttgttaggggcctccaggactcaggagacctggactcaagtccaagttcacgtctaactgttgactctgggtgagtcagtcctttttccagccctccatttcccatctgcataatgagttatgacaataaatatggcttgctttggcagccgtagaggcctctgcgttcgggttatttcatcatcttcatcgggctttatctttagatttcctgtagtcaagcatcagatcttagggtggggtctttgctcccagtaatagcattcatttttcctctggggatgtcacaaataagagaagaaaggcatgccccttctgccaggcccgccgtccccatcccaggtttggacatgtgtgtacggcgttcctggaacccaggcagcgtcctggcacctgcttcacagccttcccgcttgcctgctttgtggtgagtcgctggccgcctcccctcacaatgaggacctctgttctcaggcacctcccatcatgagtggcagcacaatgccctgaggcctgtgtgtgtcttccaggcgaacacagaggcctcttgttggtgatcctggaaatacaaatcaaacatttgctaagccacttgtcctacaggtacctgaaaggaacctacactcactgggcaggtggggtaggtgggtgagcaaaactcactcttgaactagagggaagaaggggcctcacctctctgggcctcggttgtgtcatctataaaatggtaattctcatacttgtttgggaattctaatacttgttttgctgtgtgttggtgagggtcagatgagatgatacagtacgttgtttggaaagctgaaacagcagaggcccattgtcatgtgaacagggtttcagtcatctacagatgttagtgcattgttgtgaaagttgatggcattttcatagactccgggggtcatgtagtccaccctacctcccaaaccaatgcataatctcccctccttgccccttcctggggtcgcacaactacctgggcagcagtgccttctgggctctccacctcagctctccccactctcacccacctttccccctcaccaacaccccagagtcccagcctagctgttggtgctgtgcaggaacccctgccagggactgtgcaaggccttgggcaccttgactctgcctctgtacattcgtgaaccaacaccagggctgcaacagccttcaagcccctcctgtcagccacatatggtttacaaatgtggcccatgttcattccagctcatgtgcagaggggctaagaagcctgtggcggttgagagctccttgcaagcagtctacacacggtgccttgtttttcatcattccaacctttattgcctctgtttaaaggaaactccatcttatactggagaactgagagggtcatagacttcaggccagaaagaagcagccagacagtcagagcttggagaaccatgccagtctcctctgggtcctgttgctccgttccagttctctttgaatgaccccctatccccgggggccactgcccgcacccttggtcaatggtgaggacaagaggatgtgcggcagactgtcagctcttctctcactgcacctccgccggggaaggcactcctgggttggggaggctgcccaggactgcagtcccaaagcagagggctcaagggctagcgctgggacccattgcctgtcatagcaacctgttcctattgccctgggcaacttacctaaccataccgggcgtcacttttaaaaacgagggcagtaatagcactgacctcataggtttgccacaacaactagaggagaacgtggactttaagtcccccatggtgcctgcccatgagcaggaatcactaaataaagagtaagctaggccaggcgtggtggctccttcctataatcccagcgtttgggggagactgaggtaggaggatcacttgaggctaggagttcaagaccagcctgggtaagatagcgagaggccacctctacaaacttaaaaaaaaaaaacttagcccagcatggtagcatgcgcctgtagtccctactgcttgggaggctgaggtaggaggatggcttgagcccaggaattcaaggttacattgagctatgatcgtgctactgcactccagcctgagcgacagaatgagaccctgtctcttaaaaaaaaaaaaaagaaagatgaagccatttttcaaaactgttcccaaaatcacttgagtgagtccagctcctgagtttcctttgttgactgatgaatggaagatttacagtcctgctgagccaggtgcaggttcattccttcaactgatgttgagcatccactgtacatcagacactgttttaggtatcgggaatttagccttgaacaaaacagaatgaaatgccctatcttcttggagcttctcactcaggaatttcagcaggagtcagaaaaaggggtggtttctgatacaggcattgtatcagagcgtacatgtgaccatgggtcagggtctcccgcttacagggggcctgcctggaccttggtacatcatctgttaccttcacggtacaggtattgtcagccctggtttgcagatgaggcagctaaggctcaaagaagtttaagaaacatgccccaagtcactcagtaatgacagagacaggattcaaacccaggtcctcctgactcctaaactgtgagtcgagtcactgcagctcctccattccctgggtgggtttcagccacgggccattcatcggagctagctgcaggtcagccatggggagactccgaggagactgaggcacatggccccatctctgcaaagtgtccaattctgagaagacacctacatgcctcagtgttgcagaggccagtgccaggacagtggtgcagactttggagctcagaggaggagaaaggaattctacctgggggtctagagcaaaacctaccccaggagataacgttggagctgagctctgaagaatagctggggtttttgcagagaaatagtgaagtaaagggattctagagggtagacttagccaaacaaagccctaaagacaaaaaggcagatgatagatctggggactggctgtcctttgtgattggaacctaagggtgggtgtggaacccacaggggttttgtaggggaagttgcatcattacatcaaattcagaggaacttgagcgccagaatgaatttgtcctttgtcttggggcactggggagcagggagggtttgcaaacccaggagagctatgctttagaggtccatcggctttttggagtttactctctggccagctctgaacagtggacaggacagtggaaagagatccaccctgaaggaacacatttatctcatccaagcaccttctccacatgaaacttctgtgagttaggggcagacaagagactggagagggcaaagaaaaataaatcccaggcgcagcacccacagcacccaggctgactgagaagagtggtgtggatgccccctgagctacaggagatgtactgagggctgggagccaccaagagggagatgataattctctgcaggtggcatcagggtaagctttgtggaggaggtggcgtttgtgccagacctttcctagacatcattcagatggagcagaagggcagtaattccaggcctagaagtaggaagtgcacagcagggaggccagatgaatgaggcccagctcctgccagaccagcagccctcaggtattcttgtggggaatgaagacccaagggtggggtgagcctgaccttgcaggcctgcagtcctgggcttgaccctcaccctgctatttggctttgagaccctggaggagttcctcctactactcctctggaccgccgttcctcacccattacccacgtggcagggccagtaggagggatagagctaagctaggtgtcttggatgctgtcttctgttgttggcagtgaccacattttaggactgattggtgtaaaatctgtcatacaatcagaaaggggaccaatccagatgggagggccaggaaagcttcctagaagcaaggcacttgagctgggtctcaaggaatgagtcctgccaccatggcagaacttttggaaaaacattgaccagcctctctcttccatcaaccaccagggtctggtccccatcattggaaccaaagtcagaagggctcccagagcctcaacctgcacagctctgagtcttactttcctccttcagattccaacttccatttttaattgcccataggtgaaattaattaggttctgtcattctaatgactcatgggggtagcatattttttctctaaatgcagatcttcttttgaaggactgtgtctttatcttttgcagaaaaatcactaaattaaaagaattgccatgttaaattgcagattaaggagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttaggctgccaaatcactgcaacttggaagtttgtatatttgtattttaggtgaaatgatttgcctaattaagcctgtcactcatcaccacctgttctctctaagatatatggctatattattaagcttgccagcaaatgtgtaaattatttcagtggggaattacattgttgactaggacgttactagtttttatccaatttatctggtatgaaaccgatttttttttcccaataaagctaaacagcagttcattaagtttcttcatttaatcacttattgagcacctgttatgttgccggtaatgggctaggtatgggggaaggggcacatgatacagcccctaccctcagggggctcaccgggagccaggtaggacatgcagttagggtgctaagatcaaggtgagtcttgggagaggtgaggtccaggaaggcttcctgaaataggtgacctctggagggtaagtggtattagtgaggtgaagagattggtggacctgaggctggacaagcagccgggtcctagagagccttttgggttgtgccgaaaagcttgggctccctccacaatcatgttctgtgctccatgcctctctgctcaccttctgtgtcgggatgtcgattgtagagatttatattggcagaaatcccccaatcctgattttagccagtggagccccaggatgtcaggagtgaaagtgacttataattcatctggtccctcggtctcctgagcctgtggcaaaactaagcctagaacctcacttccagcttagtccccttcctatgccagggcaagccgcagcccttcaacactggcagccctatgggccaggatgcctgctgagttgtatcctctctattcctgacaaccagaaaattagcagcagggaggcatcatggagaagtgcaggctagtcccatgctccctgaccacatccccttctgtgcccatcccaatgggggcatcaccctcccccaagccagaaatctgggcatcacacagcagttatcccggactcactcccacaagtagtcaagcttctacatccctcccgtcattgagggggtcagcctccatcacctttccctgactggtcttcccgtcttcagggattgaccccaaacccaccctccaccagcactcagagaggtctctaaagcccattctctgattatccccatctataagttcaagtccaagctctttagaaaggggctccaggatgacatggccccaatttgtctgtctagccccagtgctctcccctgcccaaggtcacccatggagggctctgcaaagtaggggctcgggtaagaacctgcttcacctctttctctccttctcccaaccccctgtccaagaccatatgtcccatgattggttgccatcagggtgccgtcattcagccagaaccccactgggagatccaggctactggaaggccagcgaggggtagatgctggtggtgatgtgtgtgctggggccccagctccaggttttaggccactatcacaaaagcccccttattagctgatgggaaagggccttctcactctccagccccaggacctgtcccctgggaaggccttgaggtcattgctgtctgtgtgtagttggacacaggaaagaactgtggccagaaggaagggcaggaacccccagcgagtcctcactctgcctcctctccacaccaccagccctggcatcacggagctgtgggtgtctctaggttaaggcatggcctccatgctgctttctggaagcttaattagggcctttggtgagtcttcctctcataggtaaggccagcccatccttccagcgcttaggtcaacagcctgtggtcaccagtagtcgtccttctctgatgctgcacttcagcctgtggtcacccgtagtcctcctctcatggtgcactttgcatgcacaggcgagtcctgccatctctgcctgcagaatgtggctggatctgaccactggcgggcactgcctcgctgccctcctgtgtgcccgtgtacacatgctctctgtccctctaattagccagctatactttctagagcagttttaggttcacagcaaaatcagacagagtccagagtgttcccatacaccccttgcctccatctcttttcagcacagcaatcctgtaaggaagcgcccagtcagaacggctctccacgtctctcagaacaaagccagagtccttcccaagactaggaagcccagcttccttcccaactcccttccagtcactctggatcattttgtgtctcactctaggcacagtcccaccccagggcccttgaacttgttcttccttctgcctggagtgtccttcctacagatgttccttcctcccttcagatatttattcagatgtcacctttggagagggctttcctgccctgctgtatttttctcagtggcacttgtccccagccactgataggcagattgatttattgcctgtctctcctcacgaggaccctgcgctccataaggcaggtatctctgtctgttgtgcccatcactattttcccagccttgaagtgtgcctagtacatgtggataagtggttaggagtgtcatcgcgggtggactacctgtcggtgtcactgctgggtagcaggctggccacacgctcagcacagtccagaaagtgggtgggtccggtgtctctggagccttctgttggcaagagcctcccttcccactgttttccaaagtggttgatggagaaagagtgtcttagagggacagaaatgccccacagtccctgatagggaagatggttcagtggctgagatgtagaacaggttcatcacgctcctcggtttcagcagacagcacgttaccccgccagcgctgaggtttctccaggaccttctgtgagcatgggggttgattttcgtgtgtctggccgggcttggaggatagcttgccacaatcatgcttgctggttagaggagaggtttacgcctttgtgtggcacagccagggacatgtttgtgagcctgcagctggcctcggcttcaggaaccttcctctgcaggctctggcctcgtttcttaggcaccctctgtgtgtcaggcgctggagtatcctcttatctgaccttcacagcagcctggggactcaaagaggttcaatagcgtagccaaggctcgcagctaatcattggcaggcttaggagaagaactcaggttggttcagttgcttctgtgaggtgactagtactgtgtgtgcattgagcagacacaataagtgtgatttataataacagcacagactaccttccacaggtacaggcacagtgctaagatttctaggtgtgtcatctgctttaatccccatgagatgggtgctgtcattatccctgtttttcagagaaggaaacaggcccagctggataactggcaaggtggtctccaggaaccctctggcaactccagttttagctcagcgctttctgctctttgtgatgtctccagggtctccctcaaggagcatcctcccccagcctgtgggggtgaacgatgctcccacaggcccagggcggggagaagagcatgtggaatggcccttcctgtgctatgggcactgctttagcctcacctgggcgctgggtcctgggcccatgcgggggatctgaatacaggggatgtagcatgacccctaagtggcactctataggagtatcccagggaaaggggcagatgtggccagtatggcctgaggtgggatgagaggaggagaggagccacttggaggcagatttttggcccaatacaagaaacagctttttcccctgagaactgtccagaggacagagctcccccaaggcagtgcccccacaaggcagtgccatgccccccgctagaggccacagggaggtttctgtgggggtaaggctgagcccagtggcctctggaggttcagccagcccctcacacgcaccattgggctgtgatcacgtgggtgtcctgtcttaggaagccaaaatcttttgtgccatgttatgtcattgcttgaaacccttcctcctgcaagctgtaaattgccaactagaccagctgaacgttacccttctgtgcctcacagtagctccctgggctgagctctgctaaccctgcactttctctctctccccacagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatgtaagttcttgggagcaaagcccaacctcacctcccagttcacctagtttttgccctctctttcatgtcatcttcttttaaaaatccacagactgggccgggcgtggtggctcacacctgtaatcccagcactttgggaggccgaggtgggtggatcacttgcctaggagttcaagaccagcctggacaacatagtgagagcctgtctctacaaaaaaaagaaaaaaaatacaaaaattaaccaggtatgatggcatgcacctgtagttccagctacttgggagactgaggcaggagactgaattgaggccaggaggttgaggctgtgttgagctgtgatcacactactgcagtcgagcctgggcaacagagcgagaccctgtctcaaaaaaaaataaataaatacccagactgaggcatgctagaactccaggggccttctagcctgcccctacctccccctctgtgtatacatgggcaggttaaggctcttggaaggttgaggctcccacccagccagtggtaggcccaggattagaacacatacctcctagcttctagccctgaactttttctctccacactgtgttgccacccttaccttcaatggcaggaggaactgcaaaagagtctacagggtgcactcctcctttttacatcctagtttctcatttcatcatgcagcaaataagtccttggaaaaactaaatataaactaaatcctttcccctaagtgtaaaactatgtgtaaattagatttattttctagctacagtcgtgttcttgctccatgtctgcttgatactgttagagttgggcgaggcctttccactcttgatgcgggttttcccagcccctttgcccagagatttcccacctccagtcagtggccaagtcccatccatgctgcccccaaggtcccacatccctttccgttcttgctgccccccagcactgtgcagggctgggccctttattgcccctccccttggccatggttatcatctccctgctctgccaaatcatccctgggtgcagggtcctgctctgctctgaaaccttcagtggctccacattacctccaggataaagtcccacctccctagcctgccattcattctgtgaattgtctgcaaactatgttttcagtttctaaccgtgtctcataactggactagaatgagcttctccaggaacttgacaaagcaggtgcaggacttgtgctggtgtcctcaggtgtcttgtctgcttaaacaagcaaatgtgcaataaagggttgtcagcccattgcctagatgagaacatcagggcccagagtggtgcagagccttggcaaggactcacggctcagagtgcccccaacctcatgacccagaccccaccctctcccctcccctctcctccacttactctttgctcattcccaccctttgcctggtatggagtaggcacacatgaggccacaagactcactgacaaccacacatggttcgtgagccttccctggtgtgtgtcacgtactgtatttgtcttggggattctggtcttggcatggccggcagggcataccctcacaggaaattctcactcggtgagcaggatgcagggttttccgaatgacatcatatgctgcccttttaagcaagtgctgtcacctctggaggcttctgccacctttgtgagtgctcccagccggtgctgtgaatcatttctcacagccatgcagatcgtctgacaggttttgcttatttctgatcaaactgtgcacttttaatcaacaaactgtgactcacagatgttcggcgtgcgtcctgaccagcagtggccaggtctgcctgggtcagtctgggcccagcctgcccactcccacccccagactcagccttcatctcaaggtgggagggttgggctctctttcctttcccattcccacttgatggggcccccagccaagtccagaggcatgactggcttttcctcccccatcgtctcatctccccacgattaactccccaagatgagtcagaagtcctgactcatcacccgaggggtttgcttaaggtaaaatcccatttcggttagagcctgatgaccccagtaaagaggatcacctagtcccccacctgaactgatgctgttctagagttcaggaggcgccttccagtctgaacctctcctccaccctagcacagagggaggtaggaggggagaccgaggcactggggtgtgccccaggtcacacggggtggccatggatgggcaggcacacatctgcctaggtgctcctaccacctgccttccctcctgggacagcagaaaggtgctccagtgctcagggtctgtccccactgcctcctggaggcagccccacctgcacccctcttccttcctccatcattaccatcagtatatgaacgtgtcccagtaacaaactttgccaacataagtaaaaaaaaaaaaccttgactcaacattcctctcaactgcccctgctgagaacagaaactccatgagggcaggaacttgtctaggtcaccactgcatcccctgtgcctagaacagtgcccagcaggtaacaggtgctgaataaatagctgttgcgtgaatgaacagtctccaaagagctgccagcacttctcccctctctgtcacctccccttctctctcacccaccacagccagcctcctttttctgccccggtccccagacgaccccctctgtcctccgtggcagtcaccacagttgaccactctccttctgggcctctgggcctggtgctcctcctgcctccctggccactcttccatctcctctgctggctccttgcctctgcttgacctgaaggtctgactttccagggctcagtctccaactacgtgctctccctgggttgtctctcccaggatcctagtggtgactcacagacatgtagcatcagcccacacctctcccagagctcctgactcctacgtccagttgcttcctggcatctccatttggctgacaagtgggcatctcaaacttaatgtgttcaaaactgggctcctgatcttctcctcgaaacttgcccctcccccagcttccgcacctccataaacggtgtcacatctaactagttatggttcaagccacaaacccgtcatcatcttgattcctttttttgccggacaccagcatctgttgctttaccaaattctgccagtgctccctcctaagtaccaccagaatccattattcctccatctccgcggccacctgccgtgtgaactacttcactagcatcctgacttgtctcctctggcccctcctcacgccaacctgactgactgtctgtaagatttcccagggcaagtaacatctcttaaaactcttattgctgtggatgaaatcaaacttctcctcctgggcacaagaactgggcctacctcctgcccgctgctcacagtgcctgggtcattcttgccgcctttctgctctgtgagcactgcaagcgcattcctacctcaggacctttgcacttgctgcctgttttgcagagatgttttctttggctcttcacgattggctccttctcatgttctcaggccacatgtcatctcctcaggggcctcccctgcccattcatttctaagcgggcatctcatacaaccccagtcactgccttatcataaccccaggatgcctgcataacccttgtcactatctggaattgtttcctgtatctctctgttgactcttcctctcccttcatcagccccgtgagatcaaggatatagtgagtggtgagtaaatactggatgagctcatgggtattggctggggtgaaggacgatagttgagtctccctaatccccctggttctgacctgactggccaaccccacgaggtccagcccatccctgagatgacctcctgcctggattctctttccaggtgaagcaaggcctacgtgggcccaacagttggctgtagccccccacaggaccgcccagcccagcctgactcctagtctccagcctcctgctgacaggctggccagtgccggcccggcccccagatccagcaccctctgctccttctctcctttgttcctcagccccttgtcccctgcccttgactctgtgtggagcagttggggaagggactggtagcttatcctgttaaccacctgggattccccttaacaagaatccagaggccatgcccccatctcagagcagagcttgctcctgagctcagggagggtggatggcaggcagcacttccccagagaccacttctaggcctttccctgaggacggctcagcttcaaatggctgggacttgttttcctagtaaaatgtttttgtcagctcactgagggtgtgttacacagtgaaatctcccagaggacagccttcccaaacctgttaactcttacttccgaagtcaatgctgtctttgtttctcctgattacagccatgtagcctttctaaagcataacatggaccttcatgtctcaggaaatgttttacttgtggtgttttaattgtggcaacccatgcataccccaacttcacattcctctttacatatttctctgtacctttagaaagaaaggggtctgtggtctgcatgctcttcctgccttctcccctggaaagtctcccctccggatgtccagcttggtggccactgcctggactgtccaccacttggccacattcccactggacaaggacactcacatttactctccagtccttgactttaaagttgattttttttcttagggttttaattttgctgtggccactgctactaactgttgagctctgcctcatgagtggcaggaattgcatggggacgggtggtttgggtttttctctgaggagaatgtcagtgccggaactctcagaggcacggtttgcaggacactctgagacaggcaccaggaggcagcatccccacttgcacctggaaatgtaatgtaaaatgcagcctctggatgggcagcggcctgcaaccattgtaggtggggatgtcaccacacagtctgcgagggcaatctctttctgctaacgctgcagctgccgtcggttaagactcgccccacatcaggctctacattggcccttcctgcggggccacttgttacattcccacaacccaagagaggttggcatgatcctcgcttaatagaagccgcctggtcagtggcttgcctggccagcaggcagcagagccaccattcggagcagcatccatgtctctgtggacaaagcacactccaaccacagtaccgccccgtgcctctgcctctcctggctgagtctcaccccctccactaccgcgcagagaccatcatgtaaacaggaatgtattttgagtgtgtccactcatgggcagtgaggatctttattctttccctgcagttttaccgtcagctcttccagtcatgaaaatcagtgagccagacatggcggtgcgtgcctataggcccactacttgggaggccgaggcaggaggatcccttgagcccaggaatttaaggctgcagtgagccgtgatcacaccactacacttcagtcagggcaataaagtgaaaacctgtctctaaaaaccaaaaaaaaaaaaggaaacacacacacacaaggaaaatcaggctggatgcaatggctcacgcctgtaatcctgacactttgggaggtggggtgggaggatcacttgagctcaggaattcgagattagcctgggcaacatattaagaccctgtctctagaaaagattttaaaatagccaggtatggtggcacgcacctgtagtcccagctactctggaggctgggggttggggggattgcttgagccctggagtttgaggcagcagtgagctattatcgcgccacggcactccagcctgggtgacggggtgagaccctgtctcaaaaaaaagaaagaaaagcattgctcccatttcctcctctgatgggagatgagggatgagtcgggccctctgcacggcactcctcccctcagattctgccgcctgccctcctctggcatgcatggcatctgggagcagtaatgctgggattcccacatgcccaagtggtgctagagccgtctggcaggagcatggacagctacctccctgcccaccatccatgtctgcacacatccctgagtcagagcgtggccctcccatcagcaccctctgatggtttccatgttgctcaaacagagaaaagcccctgctgcagccccatttcgggacgtcttgcacaccccttccccttgctgcttctgtccatgctggcccctagctgtttccagaatacgctaggcagccttctgccttggccttcgctgctgatttgtctaccaagaaagctcctctctggcttccctccttgcctcctgcaggtctgcactgaaatgtcactttttttttctttcttcttttttttccattttcttttttctttttcttttttttttttttttttgagatggagtcttgctgtgtcttccaggctggagtgcagtggcatgatcttaactcactgcaacctccgcctcccaggttcaagtgattctccagtctcagcctcctgagtagctgggattacaggcacccaccaccacgcccggctaatttttgtatttttagtagagatggggtttcgccatgttggccaggctggttttgaactgacctcaggtgatccaactgccttggcctcccaaagcgctgggattacaggcgtgagccacctcaccttgagaaggcttccctggccaccctgcctgaaatagtccctcaccagcccccagctccatgagcctatgccacttcatctccatgatgcctgtcctcacactgtgctctgtgatgacttgagtgtctgtggcctgactccctgcaccagagcataagcttcccgtgaaaagagactgggttttgttcactgtgctctccccaggacccggcagcagcaggcgggcagtgggtacccatggaatgaaccagtgcatgcctgcttgtacagggaggctctctgcgggtgctgagtctcccaaggcaggtcagggccatgggaatcccatcgcgctgggctctgaccactctctgccctctccacagatggtatcacggagccatcagcagaggagacgccgagaacctgctgcgactctgcaaggagtgtagctaccttgtccggaacagccagaccagcaagcatgactactccctctccctgaggtgagtgccgccccgagcacccccagccctcctcggcagcctctgcgagcgcagccggccaccgtgtctgtggcagaaaaacccgccagtgtcccctgggaaacttgccagcacacgttattttaggcctgggtttttcaatttgatcctattctcctgggatacagaggagtttttatgttcactgttgctgcccttccagaagatgaggggcctttttctaggattttgtattaactatccaagaaagctttcacatctgctgtgagccggggtggtacgaagttcctagcatgcctcatcctgctctcaaagcccacgacgatggtcctttgatttttttgaggaacatatcgtcgccaatttgcagatgagtaaacaggttcacggaggtgggtgtggctggcccaagtggctgggccaggacttgtgaccagcccatgactctctgccactgtgagcatgacctagctctggcttgcggtttgtgtgggcctgagtttgggtgttgcacaaagtctaggaggagcactgggaagaggtggtgttactgcctatcgcagctttggaaactttcaggtctttctgacctgtgaggcatttctgtcaggatgggcaggcccagaaataagaaaagcatgttttagttgggtgctattgctggacgggacccaaaagaatgcctaaacccattttacagaaaaactgaggtccagaaaaagaagggatttgccaaggacatatagagagctggtgacataactggggtgtaaacccaggctcttcagccagcacagatcccccagaagcagtgaatccctctgcctggcatcctctctgtcccacttaccgctgttagaggccatgggagggagagccggcctgcagggacacggttgtcaggagagctcacacacatgccggccctgtagacagaggcttcagtaaaaccaaggaaggtgaaactggcctgtgttctctgctcacgactgacccctccccccacaacttctgggctttgccctgagagggacagtgacaaactgcagagtcaggagggcggcaggcatgggcagaggcaggtagggcaaggcacacaggctgtgggagtccacctagagaagagagagcatgtggacacggggtggggaccatgcatctctcaaggactgtcagggcagagggagctgatgtacagacaggggacttgtgggcagacaatgcatagacagattccagctctgcaagaggaaaagtttcctaatagccagagcagatcaagaattagagctacccaagctgcctcaaggtagtgagcctgtcatcactaggggaataagaccaaaggctggaccactgcctaaaccagagaggatgcagagggaacttctagcctagcgggtagggcactcaagacaaacaagaaataggtaccttgctcttctctaggctgctggtgcctgcataattcgttgtctgccatcagacctgatggctgaaagaatcgggtcagttatggcagccgaggaaagttcaatatgctaaactgcaactggggccgggcagaaggtggccaaagccagaggagcggaattggactgaggagaggacagcagcaggggggcgtgcacaccaccaggcatgctgatggggccatcaaggtgaatggtgctcttctgggctgtgagaggtaaaggaagcaggtggcatcagcgacaggactcaagtgtcaccagccttccctgcatactgggcttcctcagtgctccagggaccctctggggtgctggtcattgggggttatcactctgtctccctccccatctgtctctgagttcctcagtgaacctcattcctcctggaatccccgtggctgggggcctggcctggaggggcctccacgaaaggatcagggaggacaggacagagcactccatgccaaaccgggccgttcatcctagaggaccagagccccatcagctgctccagcttcctgttcttctaggcagaggtggggaagtactgagcccttgaactaaggtcctgccgggctggcactggggccctgtggtgactccagtgcagacctgccttcgagggaacagcagcctattgagtatccaggatgtgccagggctgaggtcccaaccagggagcacacaaggaacctagacccagtggcagaagtaatagtgccagctgtctcctgcagaatacatttctcagtcccctgtgcattgtaccctcagttataaaagcaggcccagatgtcagctcacagtggggctcagagggccagaagcgtcatttcccctcctcactggggtgtgccattccctagagggtaggaccacccttgacgacacgttgattctgccctcacagcgtaggcatgcagtcccaagggcccagctgtgtttggtggggaaggtagaggacgggcctcgtgcctggcctcctgcactcactggccttgtggccttggccagtcacgccataggggcctcagtgtcctcatctgtgcactgcgtatggcaatgagctgctgacagacagtgttcccagcccagacagtgctgtgtcagtgttatctagtgtgattcccataaccctgcccctgtttcctggggtcagccctgcagtttgattgaagtccatttttaagagccacaggaaggacccattgtccagaattctggataggagtcctgtcctgccactcgctgctccctgtgtgaccaagtttcttcccctacatctgtccagtggggagttgggctttgatgggctctaaggccacctccaccaatgacatcaggggttctctaactctccccatgtccccatctgtgggctggaccacctgcacctcccaggtgaggggaggacgtcgagggagactgggaaggcagcccagcagcctctaccatcaactctgtgtttgccttcccgcacccatcccatggacctcattatcaggaactgtcatttgggtgacccatctgagcccaaaggagctggaggtgaggtctagttttgcatgcagatctagaggcattagatcaccacctccaaaggccggggttgttctcacctgcccagctttcccctgaagaatgccagaattggggaggtgggctgggctgggcatcctatggctgagccaggcaacccactcaggggagatgaacttgcttcccagaggagccccagctcccgatggccagtccagctgctggttggggagcaatgccctggaatgaatcacctcaaccgcaaggggaaccgtcctggtactgcatatcctggctgcctggagcaagcaccatctttgccagccaccaagtgaggggcctgatctctcaaatactcaaggcttgcctggcaggggtgggtggggaatggcattcttgacactgtcaggagcttggtgcaaattgacactggaattccagctatgctggttatccgcctctggccattttcatgtgagtttgtcctgccctgagggtgttctaggatgaagaaaggatctgggggagttcagcctcagaggacaccccgtgcacccttccctcagcagatatttttcagagccctccgtaccagccactgggctgggcatcagagagagtccagaggtgagaacagtcaggcccagcctccaggggctcagcctggccaggccagcctgtgtcttgttgtacacaggtctgcacaggggggtcttgggagcccagagctggcatgtgggtgggcagtccctgccacagagagtcaggagaagctgcagggagaaggctgcacctgaaccttcaagagaaggcaggtgttccccagacagggacggctagcagggcagctcaggtagaggggacagcccaggcagagccatggaggtgcaggagagccttggcgggtctcgggggctcccagaagagttgagatgcagttctcagtgatggggccactgacgtgcaggttgcactcaccaaggtcctgcgaggcattttcttcctcatcttaggctgggggaagccgaatgcctgccagggtccacagcagagccaagactggagtggaggccatgggactcccagccatgtcctcccatctcctccccggcattccttacactcagtcgaaaggtcttctgacgtcagacctagaagtgtttgagacccatttactctagtccctttgcctcatgggggtggggaaactgacacccagaagggatttagggttggtgtaaggctgcccggctggcagctgaccactgaccacagagatggtgacagcttcccactgtggtgaccagacaggtccctggatcagcccaagctgccacctgtcggcatcccaccccccaactttctgcacttgcagtgacccacagtggcgcctgcacacctcatgacatctcagagccccctccatggcaggggcccctacctgtgaatcgtcttcggcgattctgcctgattgcccttgaacactttcctcatcccctcctgcctgcagaactctctcccttggctgcccgccaactcattgacctggcacccaccactggcccctggatactctcactccagcctcagggagcaaagggttgagctgagaaattggcaagaaaatgtcaaactcttaacacagtttcctgtctctggaaaggctggcagtggaggaaagggatgaaaagccttgaaaaaaatctcattaaaaggctcttcaggcactttggcctgcgaatgagtcttggcaagttctggtttggtgagtttttgcaaaggaatgtggacaagatgagggaaggacttcaaagactgggggacttctagctgggggcagacagcagggaggcggggtgagtgctgtggcctccagttctgctgggcaggctctgccctcatggagcagggatcctgtgtgacccatgggaaggggcaccgagtggcacctctgaggcctctgcagtcagcagctttgacaaggacccagcccctgcttggttgaggtggtgagagtcccaaagccagtggggctaatggctgcatacagtccttacggagggacctttggctttctaatccccgaaggcaaattgcctggcatcttgcaaacgtgacctaaggagacacctctggggtctggcctgtttccatcatgctgtggcacttggttgttcacagcctctccagcccagccaatgagctctgccccgtccagtgtcagttactgaatgagctgtagccctgcaggagctcacagcctcacaaggaaaggaagacacttacacctataactcacggagaatgtgttcagggctgcccgaagtagaaagtactctttctatgaaagtttccaggctatgaaagagggaaggaatcaggaaggggaatgtgaaggatgagcaggtcttaaacccatgcacaggggagaaaaggcaggctgcagagagaatgggcccagagacagggcagggcggagcttgcctaagaacaacaaatgacacattcatctgagcccaagagagatgtagccctgatcaccaggtggaggggtcggggctttacctgtgaggcagcagggagttctcaaggtttgaaacaggatgcagtgctattgtcagggctgtattctagaaccatgagtgaactagggggcccatgagtactggcgaggagggatgccagcttctgcctccctgtccccccagtgatcccccccttcccctccatgtccctacacatgccacgtgaactggcacagaccgagagctggggaggggcctgatgtaggagtccagaaggcgaacagcacgtgggcaggcatcccaggagaccgaggcagcccttttcaagatggagagggacaacacaggctctgcagtcagatatctgaatccaagtcctgcttccatctctttccccgcacctgatgctgggcaaggtactgcaccttcctgagcatcacgggatgcttgcctcagcaagaagtaaggcttggcagataagccctacacatagatggtgctcagtatataccagtctctgcttctcccagcttttccagagccttcagaaatcaccacggaagcagcagagtagacagagccctgggtgagtccaggctgtccctgctgcactaggtgacttgggcaggtatctggcaggtatcttctccacttgcatcgataaaatgagggtctggggtctgattagtaaacttgcttccagtttaagggttctatgactagaccactttcctctcagtccaaggatggcaggaaggtcccatctcctccaaggagggaaggaggagcacgacattatcaagaacttgcctcctgtccttcagattgcttgatgacgtctatttgtatccggcttagagcagccgggtttgtgttgactgctgggtactcagtctttagccggcaaatacctcctgtagctccgaaggaggttgggtgggtgtaacagggccaagaagagctgaggggcactgggggtgcgtggcagttagggttgtttttcttttgtctgtcccttcattgattaatatagcaaaggagagagttttcaaacagtaggcatgtctgggtccaggcaggcaagtgattaatcttagtttgttgctgctgacagctaggagaaagaaataataaaggtttaggggccagtgggagtggggatatgaggaaaggctgctctcccctcatctatcagcagggagcaagtctccacttccttctgccgtccaagcatccccttgttgggttaacatctgagactccagacacctagctccgtggtggttgcttgctcccatgtgtgagccaccagggtggtccctgcaaggccacagtgggacctccctggccattgttgagttccccacacagccccagcatacctgaatacctgacagtggacttagtaggtcactgtattccccagccaggcccctgcagggatgatgaagccttttaagagcaaacttcagggaaggcaggtgtgtgcagctcaggtacagtactgcttgcctcaggacccccacactgctcagcagtggttgcaggggccctgagctcctggccatgtgccccatgactcccccaacagagggagctctgcacagcggtgaagacaatggctctgggtcttggcttaggctcttgaaacccagctccgccacatactaacagggtagtgttgggcaaagggactgaacatctctgagccttggttttctcatctataaaatgggtttcacaggtgtattaatgaagacacaatatatgtgaagtgcttagcatatgctccagcatatagtgagtgctctatcagtggtagctcaaatgtctttattatggacctcagagagccacgggttgttggggaaagagctcggtgtgtcccagtgcattgcaaattgtctgggttcaacctggaagtctccatctgtgcccacatccactgtcctttacgatgatgggttctagattttattggctacagctggaaagaatgctagagaatctcacagaactggagtccaatccaggctcccctcttcctggataacctgtcttgaacctctcacctctcttgcactctgtacgttgtgctttggtgtgaccttggatgaatgagtgaacttctctgacctcctagttgctcatcaggagctggagatgatgaccactcaacaggtatcctttttcatcaccatgctgctgcccctccagctctcctgcccatcttccgaacttgtggtctggcctcctcatctcatagggaagcatgttggcagccagtcaaggtagcagctccaggaataccctaagcagaaatcttggggtttagggaacagaaagagactttttcaattttctggtccaatatcttgaacaagtggagatactgaggcccagaaagaggaagaagcttgcctgcctctggctttcccagcaggcaagctgtttgctagcagcatttgagccagcctgagtcagggcagcaggggtggtgggggaagagggggtctgtctctttgctcttatcgcatggaggatttcatgtcctttcagggctcatggaggaaaaatgaactttctgctcaattagcgtgcttcgtgttttctccttctaaaaggtttaaaagaaatgccacaattagaagccgctgctgtaggcaaaacagagactcctcaaacactctttgcagaggactaaatgagaacagtgaactttagaatgtgcagatgccttgcaggataagagagtgcaccattgaggggacactgtgaggaatattagatgacatttccctttattcagaattactgagaaaatgtgccctgctggtggtaaaacattgccaaggacgccaccctcaacattagactggcacctcttctggactctgagcctggtgctttggtgattctggtgcagtgggggtggagagtgtaggaacagccctgggcctatgcccaggagacctgggttcaaatcctagctctgcctctgacaagttacgggatcccaaactagtcaccatgatttgcacccttcctttctgaagggttcagacagaccctagtttgagttctgcatattctctgagccctctgtttactctctagcacagcaagtgtaaatcctgccccgccacctgctctgggctgctgtaacatgtgagtgaggtgatacgggtcagcatgcccagcacagggcctgatatttgggaatagccagctttcacactgtgatagtatgttcaagaagagtagcaaccattgccatcatttttacagataaagaaactggtgttcacattacgtcacagttaatgagtaaagagatgagattgcaacacagctcgaggcctctttctaccttgtggggtctctcggaatagaaacacccccattcctccctagcaggccctgagaagcccagccaatggccaactagttctctggaccaaagctggattttctgacaggacctgtgaccatgagccctgtgcccagcatttctcagacccctttccccaggcagtggtgacatggagaaagcccagagacctgaaaccagaggggctggttctgagccaacagtgtcagcatccatgacccaaatagaagagtctagtttcttctctgggtccagccctcaaggagctgtgaagaaagcgcaactcattgctcctactttacagaagaggaaacagaggctcaaaggggcttaacctgtcttaaggccgtgttgtcagggaggggcagaggctgagcctgcccagctcctggaccactgttctttcctgacccttctcagccatttgctccagctaagcttagaagttctccatttgcactcaggtgctaggctgatgatgctgagactatctggtagcaaactaggaggccaaggccaattcagaggggccagtggcaggcggcctacatacctgatgagagagaagtttaggaagccctatctggccctgggtgtgtgatatagatcaggagagaaggactagggcagtgggagtagaaaggagaggtgtgtggaggtagaattgatgagagggaggaggagtgaggagtcaaggaccacatccagatttcggagcagctgggtggatagtggctctcccggctgcaacgtagacctggaaaagaccaggaaaacagactccctgcagctcagcttcccccttcccaatgctgcctaaaacgcagaggcaagaggtgcctgctctcattctgcctcactctgccagttcacggcccagtgcaccaccccccaacccggcagtgccagacgtgcccgtcaacaggctggggttccctccctggactgctgcgtctcccgtctgagccagggatggagcagtgccctttgttttaccggagctccttggtcttctccagcatctgagcagccgcgattacatttccagccggtttttaattgtctcgtatcagcccacataaatctgcctgtgcggctccgccaccagggaagcattccaactgcccgtctgtctccaggaaacctctcgtgccccgggacagttgccttctgaggcattgggtggtctctccaaatgagaaaaacatttctttccaatcacatttctaacatcttgttaatttgaattatttaacaatatttttgcaaaagccatctgggaatgagttggttggcgacttgggagaaggcatagagggtgctgcagggaaggccacgaggacagctgcagacgtcacatctgctatcagtgaaagggtggctgcatggagaggaaggctgtgatcaggagcccggggattacagcctgaatcccaccattcctaccagccaggaggtcaccagtgagtcacttcccgtctcagcctctgagccctgaggcccagatttgcaatggcagtggaagctcttgtaaactctgagaggctgcacagatgcaggtagggtggtttgcagagcctttgtgctgtaggggcttattttactgatagctgggtaagcgatacaaaggccccacaggaaacatgattggcccttacctagaggcattcggtggggcttgaagcagctaacttcacgtggtaaaatcccagtgttaaggcagggcctgactgttccccagacttttggggagtcagagcccaaagggagttgaatcatccaggtcaagaccctggtggggtcaactgaggcacaggaaggcaagaggaccttcctgaggtcctctggaaggctgctggtagagcccccagaagtcccagctcccaccccagggttatcaccctttggagccccgtaagcactgtatattcttctctcattttctccacagacattgtcagtccttgaggcagatttataaaatcagatgtcaaattttatagcccttgtcttcgctcccgcagttcaaatgctagggctataaaatgaggttttgttgtgtatgcggcacactcgcacgcaggcgcccttgccctctgttggagcagaggctgttccatccgcgggtctatgtctttcacctgctcttctctaggaagctcccctgtgagcagcctccatcctccttccagcacgagtgtttgccacttttaataatgctttgctttttttttttttcttatctttttaaagattatttcacccaagaggaatatcagaaacaattgggtttggcaaagctagcttattccaaatgctttaattaaaaccattttttaattttaattttatttttgccatttcttttggaaaatccacactctgcttatggcctcaggcagcttggagatcaccctgccacgttttaagcacaggctttcagggcggagcttatagacaagtcagcagcatggctttcaccactgagctcttatcgtgccctgggctgtcagctgggtgaggagacaaagacatgtcagcctctgagctcacagtccagacaaggagacaggacagtagggaagtactgtgatgtacagaggtgtggcagaagacaaagcgagggagaaagaaagtaagtctgactaggggcatcttggaagtcttcctggaggaggggccagttgaggaggacttcagatgttaagatgtttgagaggagaaaactggggaagttatggggaagcaacaggacatttaagcaacaaggacatttaagttggagattagaggaaaggccgtatgcagtgtccttcctccctaaggtcccaacttggctagggtagctggctgttcagttttcccttggaagtgacagagcctctctctgttttgtaaaatgtcacccagtttttgtttccagtttgaggtgcataaaatgttacagctcttctagaatttgtctagcagattttccagtttttactagaaaccccccaggaaaaaaatctaggtacataaaccctgggaccttgctttctaaatttgccatctaacatctgattttgaccctcagggttgtagtgtgaaatgatttgtcatctgctaggaacctttcttggctgagcgttctttgggaatgtgtcttttggtctcaacaccccagagggcctggcacatgataggtactcaggaaacgtttggagattatatttgggagaaaagtaatcacaacattcaaaatgagccatgattgtaataaaatcagattgcaaaggtcagcccagtcggtagccgtatatcacatgcatgtacgcatgtgtgtgggaaaaatataggaaggcactatgccaaattgtgattaaccactgtctgtggtgatgaaatggcaggtttttatcttctttttattttagatttgtgttttctggattttccacagtgaatctcttttataatggtgttttgtttggttttgttttgttttttgagacagagtcccgctctgtcgcccaggctggagtgcaatggcgctatctcggctcactgcaacctctgcctcccaagttcaagcaattctcctgcctcggcctccagagtagctgggattacaggtgtgcatcaccacgcccggctaattgttgtattttttttttttttttttagtagagacggggtttcaccatgttggtcaggctggtctcgaactcctgacgtcaggtgatctgcctgccttggcctcctaaagtcgcctggcctataatagagattttttttttctttaatgaggcagagcaggaagctcattggctatggagttaggaaacgcatttctggttccggctctgtcttgagattttctttgtaacttctctgtgcctcagttatttgggggtactttaattggctcagtagagaaaaagcatagagtatcgtggctaagaaggtagaccacctggagccagaatccctccctggttcagatctcgattctgcgtcttactagctgtatggcctccatttctgcatctgtacaatggggagagtaatagttcctacatctcaggatcgttgtgaggcataaatgcaatcgtggtccaggaccacgattttgtacactctgaagccctagtcagctctctctgactccccacagcaactcactttacgctgaaggagacgggctcagagagatgaggggctcacctgtggccatagcagtgctctacatcccagccctccatcccttcaacaactccccaccacttcccagtctgccagagagcaagccgtgtgcccgtcatttcctcctggcactaaaggcgtatgccccaccgaggccgaacacaacctcgcagggagaaatgcatttgcacggtgccgggcaggcttttcttagctcctggtatagcttgaacaggcgtctgcagagtgttctcagaggcaggaagaatgatgccagtaacagtgattagaaactcgaggcagtgtaggattctgacacatcgatggtaagatgactgaggcaacaaacgcaggagatggtgtgacccggacacccacatttcagactcacagtctccaaatattcgcataactccatgttgagttcagattttcaggctaggaaaatacattttcctgttctgaattgttccaaccctaaccaaaatgtcatctctgaagaagctagggttgcctgttttacttctgtgggatctgtgttttcaggaagcaatcagttcctatagtaagtaactttgtggaactcaattacttgcagacgtgcagggggaacaaaaagcagcaataattaatgtggtcaaacccaagccaaataataaaatgaaagctttgttgtctgtcaaggcagaaatcaatttcattagggagcaaagagccagagatttaattttgagaaaattctccaccctgtggaaagaggttgtcaaaaagctgccagaatgagtgtccaacatgagaggatttgccccccagaaccgtgaccacaaagagctgacagtgacctttgaatgttccatttccaaaccttccaagtgtggccaaagccagtgggcttttgcttcttaaaattcttggacccaactgtacacagtggctcacgcctgtaatcctagcactttgggaggccaaggcaggaggatcacttgagcctaggagttcaataccagcctgggcaacatagtgagacgaggtctctacaaaaaaaaaaaattaattagctgggcatggtggctcacacctgtaatcctaaactactcaggaggctgaggcaggaggatcacttaagcccaggagttagaggttacagtgagttatgaatgtgccactgcactccagcctggacaacaaagcaagacccccatcctttcccaccacagaaaagctctcggccccatgcaccttttagggtgctcaagagatgagtgttactatacctgatgacacttgcatgtcaataagaccctgtctcttgggacttgggaggggctgggagagggggggactcaggaggtccgcagaccccaaaaaggagttcaaccgaagctcaggagtgtctgtgttaatgatggagttgtgtccagccagaaggactgatggccaagctggacagaccccacgggaccctgtttagttgctgactcccgctgtgtgagagatggtgactgcctggggaacgggcagcagaagcgaccaggatgggaaaggacaggaaattctgccccaggggcacagctggaaaagagtagcccgggtcttcctgtctctgagggaccttcacagggcagaagcagtggccttggcctgcaggagctagagctcggagctgggctaatctcagcaagctgtagttagccacatttcagctcaggacatggaagaacttaaccacaggcaaagctgtctgtttggaatgggttgtcttggtggggaatgagctctctggtgatggtggtaagtagcaaagctggacagtaaatattgcggatattacagaggagtttccatcattagatggaactagaatgatgattctcaaacttgaacatgcatcagaatctcttagagggcgagtttacaacagattttgcttgcaaagagatccagggggccacaggcttaacaagtaagtctctgggtactggtggacattctaggacacacttgaataaactctattttttaaaaacctccactccacttccagccctggggctccatggtgtctgtaatgaaggcgagtccttttgtttaatatccttccttcccatgtggtatgagcatctcctatgtgccaagcttcaaaggttgtctcttcatcatgtagatggggaaaccaaggcctgagaaggcagaagccaggaccccaacacccagttctgagctctttacttagctttcagtggacttcagggaacattgtaaactattctctatttcacagatgaagaaactgaggcctagattcccaagaactattgggagtttttccaccaggaaccacggtcattcatataatttgcaaaaggtccttggcagggtttctgggtggttcccagtcaacccgatgcctttgaaattccagggaggaaaaaccaccctcaggttagatgcagtggcctttgagcaggcagatctgtcttaatttgcagttttaaaaggcccctctggattttttttcttcttttcaaataaagtttattgtgtataatgaagatatacaccatgatgttatagaatacatacagatagtaagaaggttactaagagctagatgcagtacctcatgcctataatcccagcgctttgggaggccaaggcaggagaattgcttgagcctgggagttcaagactagcctgggcaacgtcgtgagacctcattactataaaaagttttaaaaattagccaggcatggtggcacacccctgttgtcctagctccttgggtggctgaggcaggaggattccatgagcccaggcatttggggttacagagtgagctgtgattttaccactgctctccagcctgggcgacagagcaaaacaaaaaatgttcctatagtgaaacaaattaacatatccctcaccttacatagttacctttttttttttttttttttgtggctagagcagctaacatctactcatttagtatgaatcccatatgaagtacaatttgtttattacctgtggtcctcgtgttgtgcatcagctctctagacttgttcatcctgcatgtctgctcttttgtaccctctgacctacatctccccatctcctccccaccctgccccaaggacccactgtttttttctccatctctacatatttgaatttgttttagattccacatgtaaatgagatcaatcatacaatatttttcttttcttttttttttttttttttttgagatggagtttcgctcttgttacctaggctggagtgcagtggcgcgatcttggctcactgcctcctgggttcaagtgattctctagcctcagcctcccgagtatctgggattacaggcacccgccaccatgcctggctaatttttgtatttttagtagagacggggtttcatcgtgttgaccaggctggtctcgaactcctgacctcaggtgattcacccaccttggcctcccaaagtgctgggactacagacgtgagccaccacaccaggccatatacaatattttatttctgtatctggcttatttcactgcccctaatgtccttcaggcctattcctgtgtggtgaatgacaagatcttttttagggcggaatagtattctgtcatacatacaccacagtttctttatccattcatccttgacagaccttcagttgttttcatatgctgactgttgtgaatggcgctgctgtaaacatggagtgcagatgtctttacaagatggtgattttacttcctttgggtatatgcccagaaaagggatcgctaggtcatactgtagttctacttctaatttccttacaaagctctttactcttttccataatggctgtaccaatctacattcccaccaacagtgtataagagtttccttttttccgcatcctcgccaacatttgttatcttttgactttttgataatagccattctagtgggtatgaagtgatacctcatagtggttttgacttgcatgtccctgatgattgctgatgttgaacaccttttcatatacctgtcagccatttttttatgtcttctttggagaaatgtctattcaggtcttttgcccattttataatcaggttatttgttttttcactatggagttatgtgagtcctttataaattttggatgttaaccctttatcagatgcatggtttgcaaatattttttcccaatctgtaggctgccatttcatcttattgtctcctttactgtgcaggagcttggatgtagtcccatttatttattttgagcttttgatatgatatccaaaaaaatcattgccaaggccagtgtccaggagcttttcccctgggctgtaagagttttatagtttctatttttatatttaggtcttttatccattttgagttgattttttgtgtgtaatagaagatatgggtccagtttcattcttttgcatgtggaaatctagtttattagcaccatttattgaagggattatcttttctccattgtgtcttcttggtaccctcatcaaaaattagttgacccatatgtgtttggatttgtttctggggtctctattctgtttcactggtctatgtgtctgtttgtatgccagtatcatactgttttgattactatagctttgtaatataatttcaaatcaggaagtgtgatgcccccaactttcttttcttcttcagcattgttttggttactcagggtcttttatggttactcagggtcttttatggttccacatgaattttaggattgtttcttcttttgctgtgaagaatgacattggggttttgataaggattgttgagtttctcatctttactttttttcttaaataaaactaagttagataaggtgctttgtggatagtgagtccgcttcattgctgtgctggtgaacacccttggtcagttggtgaggaggcccccaccagggtgggccaggaagagactggtgagggtgagcactgtgctttagcaagagcaaaggtccatggggtgactcgggatgagaaatgaggagcagggggcattgctgcttccttcccctctcccctccctgcatgtcccctccccctgccacatcccccaccccagcttgtcacaccccattactgcagactctagtctgctggtcttgccagagaatcctccgcaatagaggcatggggcaggggctgtattgcggaaagagagcaaacctctgcccttctctgagcctcagtgtcatctgtaaaatgatgacagggaaccaaatgatctcagagtatctggttggtgtcttgtctccctcagaaatgttgcatttagagcagtgcacacagtagacacttaataaatgccattgaccatctatgaccagtttcctgtttagttcgttttctgttttgttttttgagacagggtctcactctgtcgcccaggctggactgcattggtgtgaacacaactcactacagcctcagcctgccaggctcaagcaatcctcccacctcagcctcccaagtagccgggactacaagcgtgtgccaccatgcccggctaatttttaaattttctacagagatgaggtctcacgatgttgcccaggctggtctcacaaactcctaggctcaagaaattctcccgcattggccttccaaagtgctgggagtgcatgagtcaccacgcccagcttccttttctcttttcatgtggatcctgtgtgcaacagtgtgccttagagactgtggtgaaagaacacttgatgtttcaggaaatcgatctcagggcagtaaacgccttgccccgtgtcatccggccacagagctgggccagaacccaggtatcccaccccagccaggcaggctgcccaactggaggagacgctcctgcagccacatccatggcttctgggctgccaatgcagccgtgaatgacagagcagacgtatgggaaacctagctcagtgctcagcccagacagcacagagccagccaggtgcaccagacacaccagacaggcggccactggtgcagtggctcctgcccagcagatgagaacaagacccacgccaggaccctgagtcctgcactggcgtcagtattttctgaaaggcactgttcttcatttaaaaatttaaaaatgcattaagctggaatctagtgccagccccctgtttcacgtcatgcttatccgaggggcctgccaaagagtgcagatttgtacccaggtgaccaggctccaacgacatcctgcatactcggcggcacctccgcacctggcgagccttgcttccctgctgtccagacctcagactacccttgtgggtgaacagtgaaagctctacttcccagatgaggacctgaagctcagaccaggcacagttcagggcagggactcagatacaggtctgggtggccctgagcctgggctgcgtacagcaccatcctcaggcaccccaaggcccacccccctctccagccctgcctgggtcaaccccagggcgctggccccctttgggctataaaagccattgtgcgctccaagtcctcccctcggcagctggggcttcccccgaggctgccttggcccagcctctgcatggtcctgctctggagtctcctcagatgtggtacatctcccaccatgtgctgctcaggtgggactagggggtcctgtccttggaaacagcctggagccctctggaaccaagccatttggcagattccgctctgtgtcttacacctttacataaggggccaggcgagccgggattcgtcagacgttcacacttcatgtggaggttctcatctgcccctcaccacagcagcaagggtggactctggttattcccatgttgtggatgcagaatttgaggcactggccgtctagcgagtggtgtggctttagcctaggcactgtgggaagctgggctacattattctttgttgtgggggctgtgctgtgcgtcgtagggtatttagcagcgtccctggcctcctcttacttagatgccagtagcacctatgtaccaagacattgcgagtattccccagggaagagggagtgcaaaattgccccaggtaggagccactgctttaaggagcctaagggctcagatagccttgtcctcagtaggaagagatcacccttggcctggattctgtccatcctgttggcacaggcatgagaagcctgcttttgtcattttgctgtccccaagcccaggatccactgtggccagtgtacccacctgtctccctccatgaggggagccattctgccctgccttgttcctcctgctgtggtgctcccacccacactggcatgtccgtcactgacttgagaactcagcactgaagggatcccctccagcttttccagagggagacgctgaggcccagggggaggggacttgcccagccaatgatatcagtgggatcagactttgaacttcctccctttggggaagcgcccagggctgaagagtggagaaaaataatttccgacacacaggccttcatgttcctagaaaagtcctcaattagaggtagaaaaaaaaaaaagagagaaagagaaagagaggaaggaaagaaagaagccctagaccctgtttccctttcctgaagctttggcagcatttcaccatccccctccgcttctgcgtccagccctccttgcagtttccacgtgcacttggctgaggctggtgggaaccctgaggggggactacaaaaggcatccagcgggatccacccaccaagtgtcattgccttcccacttacacacccctggtaatgggaggcttactccctcagtctgagcgctcatcatttaaaaacttcttgtctaataatgtgttggttttctcatgagaaaaattgcccaaaatgggttcattttgacatacctactgctttgtgtgctaaaacgagccttatgcctctacatgttcgccaggagaggcatctgccagctctcctgcctagagatggctttttgtcatgatttactgaaggccttcaccctgggccaccaacttagagcttgagaaatgccctggcgtctcgggtaggctaatcgctgctgatgcgtctattgaaagtctaattatttggttgtaaatcacgtcattttgctcagcagcgtttacattgagacgtttgttcacaataacttggtgtgtgtgtctttggcttgtcactgtgaaggctgctttggaagctgtgggcaggatgcaggtgttggccacgtggcctcctaagctcctttatcccagctgccttgactattagaacatctcagctagaaggagcctccatgccccctgccccacgcctcagacagctggagaaaccagtcacacagtgagatgcacttacatcctggtcccctggcttgggaagccctgatagccttgcatcgtgactgggcaagttgcttctccctcagacccttagtcttctcatctgtgcagtgggtatcttgcatataatgccagccctcccagcttccttgggaggccacaggttagtccagtcatggaccaagggagcatttaaggtcttctcagccatgccagaggtaggccaggccctgtgtgagtgggatctgcctgggctctgggtgagtaattggaccacagaggtggactgttgaaatatttgctgtggagaagccacatctctcacagtgttggggcagtgtctgtaaggaggtagcccaggtccaggctacagctctccatgcatttgggattgttggctttctgctaagatagcagggccctctctttgctgaatgctgtactgaaacagtggcctaattctcttcagagatctctaccgcctctttatctaccacacattgagggagaacggggtcgtgtgtctgcctggcaggcgggcacccactctggctctgtgaagattcaatggacttgtgttcagtctcacttctcgcctcagtggctgcatagtcccaggccagtcacttgagccctctgactctgtttccccacctggaatctgtaggcccatctcttggtgttgctgtgaagaggtacatagagctcttggcagcatggccacagtcggtaagatgggtaatgctgtgcttctcgaatcttctagcactagtgttgctgaagtggctgcatcctgctcgcgggtgtgaggaggagagtttctttagaggcatagacctagcaaaatgtcccacttccctggaggtcaaagaggcggcaggaggagagcagaagttgtgagtcataaaggcactgctttcaagaggcagaattgccatcctcagggtgggggtggggttatggcaggaactacccattttgcaggcttgtaggtgaccacggaggtaccttgccatggtcaccctccatgctggctctcacccacatcacagcaggttagcattagagctgggcctgactcccttcaattccgcacaaacttccctgtttgcctccaccctgttggaagcaagtacatgtctgtgggggtggaagggcccttccccatgccaagcatagaggcagtgctcccagggatcagagtgtgagcactcgctgccctgctccccaaggccaagggacctgcgacacctccctcacctgagaattatctggcaactgatggttgagtgcactttaaatgcacaagctcattctgtctctccttccaacaacctggcccaggaatcttcgcacaatgtaagatttaaatgtttaaaatggcccaacagctttgtgccacattctttggggtaatggaaaataaagtcataagaaagagtaggggtaaaaaatagcaaaataaaatagcccaacaagaagaaaagacgcagccacttagagcctgagtagggaggggcagggccagcgctcacattaccccttcaagaagaccatgattttgcaagggaacttgtctcactttcatgttttatttaggcctgggcaggggacactgggcggctgagtggcctcaggaataagtcctttccaaatcctaagggaagagggctctggtgcattcttccctgtggcctccctgggggagactttctgatttgaaaagcgtgtgcctgtgtactcacctcatagggatgaccctccggaagctccccagtccttcccactctgccagttctcactggctcgtcctgggactgttgctgactggagaaagcatccactgtatccagcctcagagtgggcagcttctccctttgctgggctgcagtcagggacaaggtcgaccagccaccagcctgccctgggaagcttacgtctggaggggaggatgcatggggcctcattgccccggctctgggcagaccctggtgggcgggtggatggatggatggatggatagatgggtggatgggtgatgggcacagtgccccagctgtgtgccaggcatgtatgtgtgcccagaggccagagggggctaaggctcagcctgctgagaaacatcacaatgggctgacaggattcttaacctccagttctcaccaagctgcagggaagccagatcttggggcagaaagaggccaacgggtagctgagcagaggaagatgaggctgtggtgggagcttcagggccttgaatgccaggctttggagttcaacaaacataggttcaaatcctagccctaccatgtcccatgagacacaattttcctgagcctcagttttcccatctgtaaacagtgatcattctaacaacttaaagttgtttgctctacagtttaaatgagataatatgtggcaacagctcagctcagagcccagtacccagtaggggctcttgaagtactgggtgttgttatatctgttttggccatggggagccttagatggttttgacctgagggctaatgttctggggacatctgggtcaggacagcagctccccatgcacctttcaagctaaggtaaaccagaaatcccctctgtgtctggagtcctgtaactgggtcccacacattagtcccaaaggccaatttccatccttctcctgcataaatattatatgcaagtatttttaagtcatttcatcatgaaaagaagcgatttaacataactattacccaggattcttcatgaaatatgcatcaagcaattaggtctaaaagcgagaggtgaggcctcgcaccctgctcggcggccggcagctgcaggctgagtaatgttttattaaagcccgtgattgcgctgcaaggtggggcctgttattagccctgcgtgcccggcacatttgataatcctgatgatgaggaggtgctttttgtgatgataatgagcgatctgaacgcctgtgacagctccagcaccccggcctctgccagccttacaagactcattagacaggtcacccaccagagacacctctcattgtgactttgccctcgcaagatgtcctatcaaaggagatgtggctgatgcaggagcttggcaggcatagcagcctgttgaagctccccgggggcaatgccctccctgaacgacgatggtgctgatgacggtgccgaggtgtggaagcccatgctgccttgaagaagggtgggaggagatgtggctcggagcccggctcagctggctcgggatgcggggccggggctctgggttcacctgcagcctgccttgctgtgcgccttgggccagggtagtgtactctctggcctcagtttcctccacggtaccccaggggagtgagaggtgacccccaggctgcttgcagctcagaatacatgctgcctggagcagccatactccttgcctgatgaacccctctgttctccacagaagtgctcatgcttcctttgctcatgctcgcgtctccttttgtgtgaaggtgggagtcactgaagccactcctggcagctgcttttaaatcttcaactgttagatggcatctccctcatggggaccttaaccaatgagaatgtattgtcacagcatgtctcctggctgtgtgtggacaaggcgtcacctgacccttgcattggtcgaggattggcagatagtctcgggacctcggacccctgggggggcggtcaccaccctgcctctcaggctggggggctccaccaatcagaacatgccatttccaatcctcggcacagccccttgtgtgggtgccacacattgtcttttactcccagcccctctgctgtctctgacctgccgtcagccctgcaccatgggcgctgtggaggcggaagatcagcgtggaggggatgtttgctcagagtctgacgcctctcatccgccccctctgcctggcttcacatggaacactgagggttacatgaggccctctctcaggtctggggagtgctgaggtcaggagcactgactctgggcatctgctgctgataatcactgtgtgactttgggccagacacctcccctttctgcacctcggtgcttcaggacatagagcctggcctacaggaaggattgtccctgaaggcaatcctggccaatgccccagtgaaagcaggactggggatgagggcagcggtggagggaaggtgtgaggctgcttgcagaccccttcctgcaggaagccctcagcgggtaggcagcagattatgttttgcacatgtggaatccaggatctagggctggaagtaccccccagggtcatctagtcagcctccctgtggatgcagcaggagaagggacagagcccagcaaggcacaaggatagcctgagggccagggaacccacggggtgcagtgcttgagcccaggagggtcagcatgtgaacgcgcctttctccctctgcctgagaatggtcaggccacagactagaggttcatggagcccaagtgctggtcccagctctgccttggtctctgagcttcatgaccagtctgccccatcggcacagcctggctcagggtggtaaactcgtgggtgcttacacaggcgagataggagtgtgttgggggtgataaacagcaggctcagacaggcaggagggacttcccggggacgtctagactctcttcagcctggcagctgccccacctcgctatctgtcggcagccaaggtacagaggacattgtgtggcttttagtacttggtggccattctaagcccctaacctgggaacagaggagcttagcttctgcttcggactctgtcagagccattgctgctatcactgtccacttcccttgccagatgccgtagaacaaattcatatgaaatgttgccttcacccatgtgagttactctcctaaccttgaaaatgaaactggcttgttcccctgcagcttcatacctgcacactggcagactcagttcccgccagcggctgtgaccctctgcctgacacctcctccactctgtcccccaggtatagatctgtgagaatcacaaagcctgctggtccagcaccccaaaaacgtaaggccactcagtgcatgcacgcagaggggaatgatgtgcccagggtcataccctcctccctgctgagtgtccctggcacctgcagcccctccttaccagccctgctctctcgcccttccacaccccttctccaggcaaagctgggcatgtggctctgagagctcagctttttaactcttctgctgttttctcagccacacagtttcagcgcattacttaagcaatcacagccctttccaaactggcacagatctgtggtctcttcggcgtggtgggtaggtgagtctttgctggaatggagttttacattcttcttgtaacacacatgccgtttcctttctgcagcctaagcgagtgcgccgcctgcttctcagacgtgtctaggcaattctccgatgaaatgacccttcactgaggagcagaacttgccacaggctctgtaattagaacattgccagccttaaaaaaaatcttgatttaaattccagttctttacaggaattagtctctcttgaaatgtaattggctctcccaacgatttcctttaagctaagggtgacatctctaaatacattattatgagcagacatattgcttagtgctcgcacttcattaagcatttgttctgcccatttaaaaatggtcctggagcccaaattaaggtgttaatagagtgggcacttgtaagcttgggaagcccagtcctgactggaagagatgtgttcaagccctgagagcccctgtgggagcgacagcggctaggggcggagctggagcggaaaggctgcaaaccttcaagtctgcttggagctcaggttgggggagtctgctggaggccgtggagatgggggcaggtgatttgtcagaagctccagctttctacctaagggacagacacccgataaagtggactgtgctttggaaaatctaaagcatccacacgtctggtggcagaatcacagtagaatcataaaaggcgtggaactgagtgggcaggcagaggacaggctggtggaggggtgagggatccagtgtggctgcagccctggtgagagctgggagaggtctgctggggctaggcaaatgctggtgggaggactgtggctttggccctcgtgagctgatgcaggcaggctgcaagggctgtgtgctctgatctctgagaaacccacccactgcttttccttgagcagacttcaggtggctcctcccaagcaggtctgaagccaagcatggtggacatagactgggccctgctccatggcatgctcagaggagccgggatggtggctaagtacctacagttcaggaaggcatgcgtgtcctcagtgccaccagatgaaggaaggagctctgcctgtgggagcctggaaaaccacccagcagaggcaacacaggctggaccttgcaggagacagggtttataaagaagggcaggtagtacagactttctgcccaccttccagtggctaagccaagtcacatggctaactgcctgcaagggaggctgggaaatgtagtccctggctgggtggccccttcccagtgacagtttcctactactgaaagggaaggacagatcacttgccatccctgccacacagtttcctcctctggaaactgggggtgatgacccctgccctacccacttgtcatggcattggggacatgaacacactttgcacctgtcaggcaaggcttaaacagggatatgcactggtaatagaaaagagggactaagttttgttttgttttgttttgttttgttttgttttgttttgtttttctgaagaagtccctagaagcgctcagtgttggaatgctctcttgtagcagtggcggctgctgctggttccgggtcagatgccggaattgggggtgcgcttgggtgcagctgcatttcatctggtcctgggcctcggtcctggcttggagaggtgcagctcacagccacttcatggctgggatcccttctgtcccagacagctgaggagacccttggcctcagcctgagtgtcaggggggtagttctgataactctgtgttttgttcacaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaatatatagccttatccttttttgatatactgcagagggtctctgagggggcagttctggtttcactcccagagcaaggcgtgtctcctctgggcttgctgctgtggcaggccccagggaggggagggaggccgaggcctcagctccagccctcagcagctctggacacaagagccgtctgctctgacaactgggctgaggcagtcggtagcactctgggagtcaacccagagctcagagttcaggcttcagcagtggacatagtcaggagcctccagtgttgaccaaaaaaccagtctttccctcctgcagtgggacgtctgtgttgacacccccccaacccctggacacagcacccagctggctacaaagggctctctccccactatctgttagcaccacctgggaggtatttggcatgtagggaaagggagacagagaaggaacgtcatttgcccaaagccacacagctcaccagcagcagagcggttctgcagccaatgctctttcgttggttctgcatggccttgctgtcaccctgcccatggaggagggagaatcctgacctcccagggacatagagccctcagtggtccacactgcttccacacacaagaacacctacacacacacacacacacacacacacagccctcagtggtccacactgcttccacacacaagaacacctacacacacacacacacacacacacagccctcagtggtccacactgcttccacacacaagaacacctacacacgcacacgcacacgcgacctctctcttgcttgccatagcagggtcctcccacacaggccaggcagccccgatgaggctaagagtttctcagctctcctgctttttccacccacccagtagcatgaagatgtggctgccctctcctgaatgagatacaagggttccagagccttcgccaggcaccagctggtctgaatgaactagaagtttgacgactgtcatccctggcccacctgggcagagcacaaggggccgagtttgaacgtcatcagcaggttcagacatcagcgctgctcatgtctttagagactgtttggaggtggttccagctcactgttcacatgcagagacacaggcccggagaaggaggactcgccaaggccacgtgtcgagctgggactgagccctgcccctttaggtagctgcgtggacttcagcggtttgtgcaaagccctgcccttggtgacccgcctttagtgaccagtctgcctcttgggtcttcctcccaggccttgtctggcacgtccacgtggcccagccctcatagagaccacgctggctgtggcctgggtttaatctcttaaagaagccaatcctttccttgcctgtttggcatttcctaaaacatccctcaatgagggaggaaggcagggacaccctggaacgattcgtgctttcctttgggggagtgggaaggtaggtgggaaatgacaagatgagtgaggagttggcacttggccaaacagaggagcctggacc

SEQ ID NO: 12175 - DNA, 60424 bp, Human
cctacacccaatcacctggacttccagtaggcaatctcctttctccctatgtaaatttcaagagtcatacgtctttcttttcttccgaacgcccacacccgttggtccttccctggctctggatactgtaggctcccacagaacatcatctctacagatgagggacatcctagtgtgtgtttgtgtgttttgggggtgtgaggctatggtggaatcctttcctcattctctctatgcccgagagctggctggaaatgaagtgataaaattccttctcaggattggctggcagagtgacaaagctcttctggaatgagcactaaggggagatgtaagagttaagcacagcatctaacacacttcaagtgttaatgttgttaatcaggataattatctatctatattttaattctctgaagtaaatctaagggtaattccaaggtgagctggggggaatacgtatttttttttttttgagacggagttttgctcttgtcacctaggctggagtgcaatggctcgatctcggctcactgcaacctccgcctcctgggttcgagcgattctcctgcctcagcctcctgagctgggattacaggtgcccgccaccacgcccagctaatttttgtatttttagtagagacagggtttcaccatgttgaccaggctggtctcgaactcctgacttcaggtgatccacccgcctcagcctcccaaagtgctggtatcacaggtgtgagccaccgcgcccggtaggaatacgtatctttgtttttttttttttggtcactttccagctttgcctgtggcattctccggaagagcagtggcaggaagccgtgggtggcaggaatgggtttgggactgttccctgtgtccagcttcaacccatcttctcctgacacccctttctcctgtacttatttttctcctgtccttattgacgcagatgtgtcttctgatctctctgtcccttcctggcctgtagtttctacttctcttggagaactgtttcttccacctcctccagccaggctccttccctggtgtgaaggatgctgtgctctttggtggggcttagggccctgtaagaggagggatgtgaattggggtggtttggagtgggagtggggacctgattgcctcattctcacccttgacagtgtgctgtgttaacaagccctgtggaaaggggagacaggacagtgcttggctatgagccatcggtcttggtgtggtagatggcatacgtagagaacaagccgtgaccagcatgtcctcttgttcccttcttgcctggtagcttcctgatgtatcatccaggttgaactttattccccttttttcaccagctttgctcttcctcttggccctgctctgcatccattgggaccacttacttcccatccccacttcgctagctccagtccacagctgctgtagcagaggatgctaatggcccaggcttactgtatggggtagcggttgggggtggcctgggctggggccagccagctttcgggcatagagagggtgggggaattcgagtgtccaaccaggacaggaagggaaatgctgagctctgagatctcctcccttttccacccccagctgcctctgtttcctccctcattcccctgtactcctgcctggcttcctgccccctttggcctgcgtgtgtccggttttgagtgacccagacctcctatctccttcctttccgtcccactcttccatccttccctcccacccccactttacttctccccagattactagttgtttgtatagggcaggggagaggggcttggatagccctaccccctgctccagttcgaggttggggcggggtgggggctcagcccctctgagcctgtgagtcagcactgtcctcacgattggtctctccccttagctccccgcccctggggaggagccagaagcgctgggtccagcctgttctcttctcagccagagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcgggtgagtgaacatcctcctctccattcccccgcagaccccctccagttctaatgctcactccagcttggccggaatctcttttttcctgctgttccccaacaaccccgtttcagtgtcctatttcctaaacctttctcatcccttccccgattctgtagccccttcccttccagctttgcctgggcccccttccttcttttcactcccccacccccaccctggcatgcttagcacaatgcccagcatggcagaagctcttaataagtgttggaatgaatgacttcttgatctttcctccattctcctcccgctttctggagttgtcactccatcccagccaatgcctgtcggtcccctccaaactctctccccagtgtgtgaggtccttctagcctgccttttctttttctcctcattccctgttgtctttcaccttggttgtgggatgtagccacgggaagtgggcagaacttcttcctctttacttcccttagggaccatatgggtaaagtcctagggccctttgtgaaggggctggggtgggggagccgctgacctgctgtcctcttctccctccccttagtacatgggttgtgtggaggtcctccagtcaatgcgtgccctggacttcaacacccggactcaggtcaccaggttagtggggagggagtggattgtgggagtcctgggattagtgaggccatgggaaacagaggaggggagtgggtcacttgggtgctgctgctgggggctgatctttgcgtagtaaaggggattgagagaaagctgaggtagtgattccgcctcttactgaaaggaggcccctttggcccggatcctccttacctatccagccttgggagttgtggggaaggtggcagaagcagctggcaggtggagctggagtagaaaaggggggtagatggaaggttgctgctgcctttgggaagggaatgggacatttggtagctggaagggggtggggctatacccattgaggccctaacccaatcagccaggaagtggcctctcagtgtcatcaaatattaaaggcccttaattcaatccaccatgacaaagagcctggagtgccctgggagtctggcctggctttcccctcccccagccctgtggcagccccagttgagtgggaggcaggcaggcaggcgctgggtctgagtacccctctttccccagggaggccatcagtctggtgtgtgaggctgtgccgggtgctaagggggcgacaaggaggagaaaggtacttggggtccttggggatagggatgctgctgggaaatgtggaggggcagtggggaggcaagtgtggggcatgtggggagagggccaggaggcaaaagtgtggtttgcctgtgctgggaaccctcaccttctgagaccctgggccctaccttagccctgtagccgcccgctcagctctatcctggggaggagtaacctgaaatttgctggaatgccaatcactctcaccgtctccaccagcagcctcaacctcatggccgcagactgcaaacaggttggtgaaggtgggcagacggaccagaaacactgatgggggtgctaaggggagatctagttaggaggccaaaatctaggaagagggcttgagagcaggagaccagtagggaaggaggaaatgaggatatgggataaggaacccagagaatgagactggggcaccagggttctgggccctgaggctgcctgacacatggcattcccttccttcttcatcccctgccctaattctcagatcatcgccaaccaccacatgcaatctatctcatttgcatccggcggggatccggtgagttggggaacagagcaaaggcggtgggagaagagcaaggggctagggattgggaagacattgattagagaagtgggggtgctaggattgtggggatatctgaaaaggactgggttttaggggtcaggagtaaagtagaactgtaaaattttttgaccttcctccccaggacacagccgagtatgtcgcctatgttgccaaagaccctgtgaatcagagaggtgaggcatggtggggagcactgggtgggtctggctgtttgaggaggtgagtaggacctttggtcatctgtacccactctaagtagatctcagtgggggttcctgcagaggaagatgagggcccctgtctgtgcctcctcccagtgggctcagctcactgacagcctctgctgtgccctcagcctgccacattctggagtgtcccgaagggcttgcccaggatgtcatcagcaccattggccaggccttcgagttgcgcttcaaacaatacctcaggaacccacccaaactggtcacccctcatgacaggtgagcaggtggggagagtgtggagcagctcttggattaggattaggaaaggagggctgctcttcctacacttgagttgagaggttcagggagggaataacctgtgtgcctctgcttcccacttcctgctattcttctgtttcctgtggcccaggaggaaagacttttgaggccctgcttgccgcaggaccagcttttcttgtttgctcatggtggagttgtagtccggggcctccaagttacatctctctctggctaggtgggattttctactcccatccctctttcttgctcatttctctgcttggcattatgtgttttcctgcctctagaagccatcaagaatttgggtttgggaggatatctcttttccctgagattacaacctttcccacctcaggccttgagggataagcagtggagccagtagggattgaatatttaggagaggttaaaatattctggagctggagtgcctcccccggccccccacccccctacatggtgcttcccttccttgttgggagatagcacagagatcaagagcaagagcattacttatttgagacagtcttgctctgtagcccaggctggagttcagtggtacaatcacagctcactgtagcctccatatcctgggcttgagtgatcctcccaccttagcctcctgagtagctggggctacaggtgcatgccaccacacctggctgagtagtagtatttttattctggtagagataaggtctcgctatgttgtcctggctggtcttgaactcctaggctcaaacaaccctccctccttggcctctgaaagtgttgggattataggcgtgagccattgcacctggccaaggggatgagctttaaagtcaaacctgaatttaaatctgagctcggccgccttttagttgtgagaccttgggcagatcttttcacctctgaccctcattttcctcatctgtaaaagtggggaaggaaacaatacctaccttacggggttgccaggagaatgaaatgattatgtatataaaacactcagcctcaggcttaatccatagtaaatacccaatagatggctgctgttctattctgtccttccctcctcctgcccaccacacatttacagccacagcttcactgtcctgtccctcaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattggtaagttgcttggatggaggcgggctggggctagggtgggagtggttggttagggcttctggtctcaccttatttttatccctgcagcctgtaggacagcctgttgggggagatccagaagtccgcaaacagatgccacctccaccaccctgtccaggtatgaagggagccgagataggcagagctggggagtgttggaggcagggctgggatcactgtagagcctccctttcctcagcaggcagagagctttttgatgatccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttctcctgcctatctgctctttccttcctgacttcccttccctgaagtctgggtcttgggtgtgtgttgtgcctgctacttcccctcaccctccctctatacttccagagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagtaccctacagtgtatccctcttccttccctcattgctttgtagacattcccgctgggcagctgtctatgggcctctcttgctctttaaagtgtctggcatcttcctccagaggctcatcccttagcctgaactatgttctttatagtcctggcacagggccaggcgtggtggctcacacctgtaatcccagcgctttgggaggctgaggcaggtgaatcacctgaggtcaggagttcgagaccagcctgaccaatatggtgaaaccctgtctctactaaaaatacaaaaattagccgggtgtggtggcaggcacctgtagtcccagctactcaggaggctgaggcaggagaattgcttgaatctgggatgcagaggttgcaatgagctgagatcacaccactgcactccagcctgggtgacagagtgagactctgtctgaaaaaacaaaacaaaacaaatacagtcctggcccgtcctcaaatccccaagccttaagcttatcagagctagaaggcagtcatctcatctgtgcccctcttttgacaaataaggaaaccaccctgaagaggttgtgatgcccaatgtcagatggttagaggctagacactgcaagtttccttttgtaagaagatccaagggcttctccagctccccagactcaggactcagaccactgtgctttctcttatctgcactgcctcactgttcttcaaaactttccttgtttagccaggtgtggtggttcatgcctgtaatcccaacattttgcgaagctgaggtgggaggattgcttgaggccaggagttcaagaccagcctgggcaacatagcgagaccttgtctctagtcaggaatggtgacacatgcctgtagtcctacctacccaggaggctgaggcctgaggatcgcttgagcccaggagttcgaggttacagtgagccatgattgcgccactgtactctagcctgggtgacagagaccctgtctggaaacaaaaaaacttttgtttgttttctacagtaatctcagcttcctttctttttttttgagatagggttttgctttgtcactcaggctgcggtgtggtggcacacctggctaatttttgtattttttttttggtagagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtgagcgcgctgcgaggggcgggggctgaagaggcccaggacttgggaacctcagaggggagggatggtgggcggggggtgtttcacagtctgaaggcttgaagggaggctcaggtgaaaaggatgggtgggtgtaatcctccaggggttgggggcaggtgtcacacattgaggactctagggtttggagccacatggaattcagtactcacttggagcttgaggatatcgaaagatgggatatctttcatttaaaggaagacgtagctgagagtatgatcatcttcacaatctatttttcatattgcaccccttgttagcatttgttgaataaataagcaagtatgtattgacgttaaaggagttcctcagagcatggctgagagaaaagaggttggggaaacctcagggaaacttgtctgcgtcttccttttgccgctcttccaggtctgcaaatgaagagtccagaaaagaagcgaaggaagtcaaatactcaggtgaatggtggttggtggtgggtttggttcccagcagccccttggcggcacactgtctactctgccattccagtatctgtttgtatcttgtatcagctgcagggaggagagagaaaactgtctttcttgctttgcttcttgttctttcgctgaaccttataacaagtttaggggaaagtatcctctcctaagagatgattcgaccaaagttcttaccacgcagggttccagtctcctccatgtttcctgtcctggtttcctcctgatgataacgtaacacctaccacttactgatcctttttttagtgccagggattgcgctaacatgctttaacagtttggggagataggcattatccctattttacagatgagaaatctgggggttaaaaatgttaaatacatgctccacagtcttgaggttgtttttcagggtcagagctgggattccatcctagttctgcctgtttttaaaacatagttactgcactatgttggttccactctccaccctctttttcttgtctttttttttttcttttttcttttcttttcttttctttttttttttttgtagtaacagagacttgctgtgttactactcaaactcatgggctcaagggatcctcctgcctcggcttcccaaaatgttagcattacaggtgtgacccactgtgcctggcctgtggtccatttttttttttttttttttgagacggagtcttgctctgttgcccaggctggagtgcagtggtatggtcttggctcactgcaagctccgcctcctgggttcacgccattctcctgcttcagcctcccgagtagctgggactacaggcgcccaccaccacgcccggctaatttttttgtatttttagtagagacggggtttcaccgtgttagccaggatgatctcgatctcctgacctcgtgatctgcccgccttggcctcccaaagtgctgggattacaggcgtgagccaccgcacctggcctgtggtccatattgattttagacctgagctgcccacagtatcagcctccaaaatgtgtattgtgttggtagtgctctcttggtttagctctgtgtttccctccatgaccctctttccctcaactgtttctcactagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccagacaaggactccttgctgttgctgtgtgaaaaggctggaatgagccgctgtcactgctgggtagggtgcttaggggttgaggatatgtatgctccccagggtccctgggagtgggaatggcagatttggcccctgagctgaccctggtataagctgctgagccaagggaggcctgtgtttccccgcccatccccctgtgtctccactgtgagaaactgagtttcctttttgagcatattcctgggccaggcctggagccaggcggatttggcaccacagcctctggaagacaagtgcttgagctcttctgggtttagcaccccacccacctcccagttgtttgggttagggagcaagtgtcgctctaagggtgaggggaggggctgcttctgtcctagcaaatttcattttgggatgtttttcagatcgttcccgtcccccaaccgttttttaaagtagcaatggcatcttttaagcagtctgttttggagcagattggggagaatggcaggagggctatttccacaccctggatttgcgacctgtccctctcccttcccccatctcacagctgtctctgtctatcctggggccaacctggccccttgtcttcgtcatctcagaagacggcaccgtctgcttttctctcagtttgtgggggttccctctagaaactgtttagacactgggaaagaagggcaggaaactcaggattcggttagctgggaccccggtcgcccaccaggaggtaagcccaggtttagggccgtgtcgctagacctcccttcccctcccctggctctcaattcctgctcttattggccaaaagtttccgcccccttggggaagttgacttttcattggtcagtttctggtcacatgattttcttctcgggctgcaaacaaagggaagcctgcaacaagttaagctgaagaccgaagcaagagctggttcaggtaatgccttagctgggaaggggtccacagattcgctttgaagggggtggaataaggaaaagggaaggcggaactaatctagaaggaatgagctgcttttcatttctgggctgggggaggaaggccaggtgccgacgctaacacaacaggaacttgctctgggtaccccaggcaagtggccctagatcctttgctttagcggtttggaggagcaactgttagaggagtttaaattaactagaggcgagacttcctagctttatgctgagtgggagagctccccctttagctgttttttagaaatagcagaagtctctgtcataatccttacaggaggtgtttgttgaatcctgcctgaatgaaaagaagggggtggagggagggagtggaggtgggttttcttccagaaggtcgatgaaaagaaaaagatctggaaacacagcagggaagggtggagattagacagcagaaggaacttcctaataaggcagtgagatgctggcttgggagaagaggtgtttttttgaaccctgggttaacctaaccaagaaagaggtatcagggtttggaacccagagtataggagtttcagagtgtctcctatttgggtctcataagtatttgttttgttgacccaaatacctttgctggtttccatggagacagtgggtctgacatcactgtggttgccatggtgcctggttctagaggacctgagcaggctgcacacacagctagggataaacagggacttcagcccaagctgctgccacttccttcctgccaccacctgttaacagtcagcaactggggatggggagatgataacaagggcgggggtggagccacaagcggaaggctgaacagccatggctctatggatacttacagatgcatgccagggtgtcctgttggatttggtacagggaggtcattgcagccattctcctgtctccgtgtggaatgggtgcatgtgtctgggaggatgggcattgggaaagacctatccaggacttggatcttgactggcaggagccacaggaggttacttagggcaccacgcaggacttgaaaacagctcaaacagaaggggataatgtggttggtttcaaaggtagaactgccatactctcccagcctcacttcccttttcctgagttttcttataaagtgctcgggaagcagtcatttatcctgttctgagggatcacaatccagtactcttgagaggtcagctcatctatccttccacctttatgcctggtcccaacaggagctgcctgagggaactgttttagccttggatgaaggggcggatccctctcttcttaccctgctttgtgtcagtcaggctttggaaactggagtgattccctcccctatccctgtcaagtcagagcagattaaccgggtgcaggaccatagccctgatttttgtctattttttgcaagctataaagtgatgtatatatacatgatagttgccataaatccattttcccagtcaccttcaagttccctaagaccaaactctggcgattactaagaaggtaaacagaatttaggatgaagactgagagtgatgaggagacttataaaaggtgcatccaggtggatctaagctatgccagtggctcttaaccctggctgcgcatgagaatcatttgagtggttttttaaaagacccacagccgggcctaccccccaactcaattgaatcaaaatcttaggtgattccaatgtgcagccaagattgagaaccactgaactagaccataccaaggacttatgctgggcaagtggtgggacacttagggctgaaggaggccattgagtcttcccttccaggtcctgggggagaaggtagtgattgtgtaggtacctggtgttgtgaagggagggctgtgttgtttccctgctcttcttattaacaagtcttcttattggcaagttgagtctgtcaaccttgctgggcttcatcttccctgactcaaatgtcagggggctggactggaattccccagagcctttccagcctatgctactttgacctttcaaggtcagttcagttttccaaggccctgttggtccctggaagaggctggcttctctgtgggtgttggcagattctgatttgcaaggcaaatactgcttagaagagctggggtgtcagggagagaaggactggaaccaggcttggttctggaggctgctgcccagcacttgaaccttggaacccagccaaggctgctttctgcattctgcccctcctgaagggagctcccatccttaagagagctttcttctgcaggtggcagccacagcagcctcagggacctcagcaactatggcctcctgcccagactctgataatagctgggtgcttgctggctccgaggtaggaagagcgggcctgggaaccatgggggtggggttggggggtgtttctgcagtgctgggcttctttcttggtgggtccttttccttagtcctgatggtcacctacatcacttcctgctggctgttagaggaattccagtagcaggaagaagtagatcaggccccaggggtcaggtgttggcacttggaccatgccatgaaggaagggaccagttgggtaagctgagacaagtagggatggatttcgaatggagagaccaatgtgaacaaaggtcctgaggcgatagtggggaacgccatgctgggggagactgtgggacacccatgggtgatgtggagacgtgggttggagccagtgttggagtgaggttggggacagagcctgggaacccctggaagagaccggaagagcctggctgaggccttcaggcctcatcctgatgggaaatcagtgtggggctttgggttagagggatcaggacaatcattgtctcaggcagagggtgaagccactgtgcatgctgggtgggaacagggagagagtgtttcaaagaccccctgcagcagtccaggtagcagctggtggggcagaagcccactgaggagggagaagggggttggcaggatggggaactgagtggctagagaagggatggcaaaaatttgtcaaaggcatctctgagagttccaagacgtagcgactttgtatattagagccaccaggaggggaggaggagagaagctcagtttcaacatgttgagtttgaggtgcccttgaggaacccagctgggagtaaggagttgaccttggggatgacgctggagcaagataatggactggggctcactggcagagggaaggcaggtatgagcagacgggcaccaggctctcagagccctggcctcctgttgaggtgtctttgttgacagctgggggaccttgggcatgccatttcacctctctgtcctctcctgtaaaacgggcgtcatgatttttgccttgtaggggggaccatgagaataaaaatgttttgaaaatagcaaagacataactaaggtgaagcattactctcagagggatagttggagccacggggcgggtggcaggccagggccctatggaaggggagtaggcagagggaggaggccgaggctgtgtggccagggctggatgtccaggctgagagtgccctggagacaggctgtctgtggttggggtgggttgggcttctgtgagcagctgctgggagacgggtgtcgggggagtgtcaggggccagcgggaaaggccagaaaggcttgagagatgtaagtagttgtccagttgagagggcagctgcagggacaccctgggaggcataactgtgacccgtgggcacccaggggactttgttctcttgccttcttcccacccttaatattataatatctgggttgttcatctgtggggaaggaagtgctgctgatcttgatgggagggaaacgtaggctctagctcaccttctggaggcggggcaccaggtttgtactgcaaccagtgccttggtctggtggtgcggcgctgtgtagcggaaacctggcccctgaaagttcctcctcgcagtgagtgaggctggggaatgccgagcacttggtgctgccccgagcccctttttgggccagctcatgactgaatgtgtgtgtttctgggatgtgggctggggccccattcttgggtgcagcccttctccttgcacttctcctcccagagcctgccagtggagacactgggcccggcatccaggatggacccagaatctgagagagccctgcaggcccctcacagcccctccaagacagatgggaaagaattagctgggaccatggatggagaaggtactgggccctgcttaggacatagcttaccggacaaagctattctccatattttggggtttctcagtttcctcagagaaagggaggctggttcgttttagttcctccattaatctcagttgacaaactccttttctcattccatcctggctttttcctgcctcttccaacctggtaggggcccgtgggatggacagagggctgcaaaggaaattcagctggggcagtgggtttttctgcgccttttctcctaccgcagggacgctcttccagactgaaagccctcagtctggcagcattctaacagaggagactgaggtcaaggtgaggagatttgctgtgggaaggaagggaggcggggagggctagcagctgctcactgctgcatctgcattagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcaggtgagagtcttccttgcctctcctgtcactctccttctagaaggtatgggagagggatcagccatcactactgagcacatgctgtggtccaggccctagggctgagcagcttggtgctctcctttctcaccactacccctgggacgttgaggcccagaaaggttgaatgacttgaccaaggtcacactgctggtaaggggcagggcccacatctggttgactctttcctctctgccatggggacctcctcttttcttgcttccagaattcaaccctcatttctggagtcccttccttgtgctggccctgggcctgggcagagggaagatggttggttaccgcctatgtaagcggcagatcagactgagccaaggtgcatatcagacctaagagtggtacagaactgtaattaaggtactcccaaaggaaggagaggccattcagtcaggggactggttgagggcaagggagaggctgggacagtgagaggtgacatttgagtggagccctgagcacagagtaggcttttggtacgtagggcagggaaaagagaatgttttaggccaaggctgcagcatcagcaaaggagtggggaccacctgtcttgtgctaaggagctctgttccaggcttgtggcagaggagtgtaggaattggtccctgttgagtgacaggatggagggcctgggggccatttaggaggcaactgcagtggtcaggcaaagatgatgcagacctgggccaggcatggtggctcgtgcctataatcccagcactttgggaggctgaggtaggaggattgcttgagcccaggaattcaagactgcagtgagccatggtcatcccacttcactctagcctgggcaacagagggagaccctgtctctaaaggaaataaaaataggcggcagggtgcagtggctcacgcctgtagtcccagcactttgagaggccaaggtgggtggatcacctgaggtcagaagtttgagaccagcctgggcaacatggtgaaaccccgtctctattaaaaatacaaaaattagctcggtgtggtggtgcacgcctgtagtcccagctacttcccagctacctgggaagctgaggcaggagaatcgcttgaacctgggaggcggaggttgcagtgagccaagattgtgccactgcactccagcctgggttacagaggtagactctgcctcaaaaaataaaaataaataaaataaaataaaataaaataaaataaataaaaataaaaataggctgggtgtggtggctcacacctgtaatcctcacactttgggaggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgttccaggtatgggaggtggaaacaagactgtgagagccacacattggctatccttaggtgaatctaggaagtgtgtgcttatataaagatgtagatgccgaggctcaggatggaatttggggatccctgtgtctcattcatgatggagatggggtggaggatgaaaaccaaatcctctgggtgttccaggcaggtggatcacttgagctcaggagtttgagaccagcctgggaaacatggcaaaaccccgtctttacaaaaaaatacacacacacacacacaaattagccgggtgtaatgatgcatgcctatagtctcagctactcaggaggctgaggtgggaggatcgcttgagcctgggaggtggaggttacagtgagttgtgatcgtgccactgcactccagcctggacgacagagccagaccctgtctcaaaaaataaaaataaataaaaataaataaatattaaaaaaaaaagaaagaagatgcagacctgaactaaggcaggtacagtgtgggttgtgaacaggggtggactgtcaagatgtttaagtgtagaactgtgaaactgtctggatgtgaggtggagagggagggcttaggttagctagatggtggaagcagtgccttcccctgaattggggaaacaccagaaaagaaccagtttgcagagcagtgtgttgaatgtttggtcccagagggagtggccagcaggcagtcagacatacaggcttggagctctgggaggccaagtgaggagttacacactaaggactcattgctgaaggggggtgtcagtggtgtgggtcagagaattgtgactatgtgtacagtgagaagagcagagaacctgaaatggtgccagggagaccactgactttaggatcagggaagagccagggagggagaatgggaaggagtggccagagagtttggaggcaacccaggagggtggtaatagctgcagaagtttgatgcacagcgcacactgaggaaggaggatgctttcaggatgaaaatggcttttatagctcgtagattgacagcactggtctcctgcctccagactgggcagggacagtcatcaatgcccaggcagaagtgggcaagtgggcaaggtcttcatgtgcccctctctggggtcagggctgacgacctccctccctgtgccttcctctgattcccctctctccctgtgtctccccatctctccagtcacctcactgccctgtccctgtcctttcccctagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtgagtggtacctctgaggctggggctttgggcttccatgcctgcctgccttcctgccatgttctcaccttacctcacatcacccctccccgagggcctcatcagactcctctgtctctgtccttaggtggcctctcagagtctgagactggtgagtagggaggagcctgtcttgtgctggggagttgtatgtgttctctggttctgtgggtcaggagtaggggtgctgggggctcacatttatttctcagttagtggccttgtcagctgttcagggtgccccttggccctttatctcaccaaaccgctcagccacagggtgggtcctgagcaggagtggtggctgtgtgaatgggaaggtgtggggagaatgggctctgtgtgcctcaggaccagtttcagggtttccctttcccacagggcccatggaggaagtggagcggcaggtcctcccagaccccgaggtgctggaagctgtgggggacaggcaggtatgtgtgaatgtctccagaggcaggtggggcctggctggggagaacctgggctgtggggtagcatggcataacaggctcttctgccctcaggatgggctaagggaacagctgcaggccccagtgcctcctgacagtgtccccagcctgcaaaacatgggtcttctgctggacaagctggccaaggagaaccaggacatccggctgctgcaggcccagctgcaggtgggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgttccaggaaataagactgtgagagccacacattggctatccttaggtgaatctaggaagtgtgtgcttatataaagatgtagatgccgaggctcaggatggaatttggggatccctgtgtctcattcatgatggagatggggtggaggatgaaaaccaaatcctctgggtgttccaggctgtaaaacgggctcaggccacctgcccactataatagaatggaattggggtagaaggcattggggctatcctgacaagaactctttgtgacttcctttgtcccaaaccatattctaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtgggcagctgtgggggagttgggtcgggtgggacagaggcagtcgggaggatgtgaagagcaaggatcattagtttgagtatccttacttttggtccccagctggcttcccttagagaaggcattcaggtccgcttcctttcttcccttgagggtaggaagctgcctgtgcccaccccagagtggtcctgagcagtccccttttgggcagggggattctttctcctgagttgccctgccctacctctacctgcatggcccaggggacgagggagatccccatcttcctgtctccccgactggagcctttatcctgggagaccaggtttttcccacatatgcttggtggtgcctgctcaagtcagcttcattgggaggagcagggtcctctctccttggggaacccgttttcattgcatggtattgtcccctaaaggcctcttcctccccacaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaatgcctctcctgttttgggcactcaaaagttattgccttctttagggaagggtgtggaggagggaaaagaacccaggcccagaaggaagagcttctggggctggggaggtgagggaaccactaggtggcaccctggctccattttgctccagacctcgcctctcccactactcactgtccccaaaatctcagaccctaccccactgaccccagcgcctgctccactggccagctctcccaggatgaccagactccccttggctattctctaggaagtccttcctgagatctaaccttagtcccttcggcaatacactgggctttttgatgaccctggaaatgcccaggaagtacaggagacagaataatgtggtgtgactgctcaggcaggaggcgggggactacaggttctagaaggggctgtaactgatttctgtattatttagcaagcgaatatgtaactctgtttaagggcttaaaggtattagttcattgaattcatgtgtgggtggggcaggggttagggcaggctggggatggaacaaggaccactaattcagcaaacatttataaagtctactgtgtaccagaaacagagaggcactgggaatacagaggcaccttaagaagcctaaagttgggtcgggtgtcgtggcacacacctataatcccagcactttgggaggccgaggcggacggattgcctgagctcagcagtttgacaccagcctgggcaacacggtgaaactccgtctctactaaaatacaaaaaattagccaggcgtggtggtgggcgcctgtagtcgcagctactcgggaggctgaggtaggagaatcacttgaacctgggaggcggaggttgcagtgagctgggatcgtgccactgcactccagcctgggcgacagagcaagactctggctcaaaacaaaacaacaacgacaacaacaaaaaacagagaagcctatagtccagtggaaactttctacagcaggaggaactgcagttagatctaaggaagaacttcctttcaggtagaaggtcagtgatatgggctggggaggcttaggatttggtacccaggcctgtgaaccactgctccttgaagaagcctagttttaccctgttcacattgctcaccttctgtaggtgctcaaaattcttgctgcctgaacagctgactggtaaagttgggttgctgagagacagattcaggctagaaggtaggtaggattcagtgtcctggggcaggtggctgggcctgggaaaggggatacaaactggcctacctgagttcccagagggtggtgactctcactgtggccccttggggcttctcagtttcatttttagggctcatttccttcgtttgcataacgaacgctcagggaggctgccaggttcccctaagccccctcctgttccttacccactcaggaagtagatatgctgagctggaggtttctgaagctgctgaatcaggaagaaaaagccacgaacccaaggggtatgttggggagggctgggatgccagtgacattggctgctctgatcgccctctctctgggatgcccctgggaggcgatcctcgcactcatcacaggccacgaggcccctctctctaacacacccatgcagcactggtggtgaggaggagcccagggtccaggtcttcggatgatctcctgaccatgggcccagtgtgtagagatgagtccagggaggctagagccaagggacagcattccctccttcccacaggccttggggatagctctggcctgggcagggcttcggggagcttgtgggtagactcactggatttcaccacgtgtctgtttggcctcccagggtttgggctgggctcttccagtttcagcacttggcatttttagcacttggctttctgccttttccgctgggagctccccaagtttgcccaagtagggcctgcttccctgagagctgagctcaggggtccttgggaagaatcactagagttaggggtggccttcttgggccttctactctcaaatggaaaaattctatttcctttggccagtcccaaaaactcatttcctggtagtccccagtctgcattcccccctcccgtccttatctctcattcttcagcctcacctgcttcccaggctccttcagccaccctttccccagtgccctcagcccagcctctgccacccatgccctgtctggccctgtgcctcctccaggatctcccccgtctcctgctgcctccccaggtcccctaggccccaggctttccccattgcctggcattcacacccatcctggggtgacaggtggtggagacagatggggtgggtgggtcataggtggtagtgggtcacttcgcttcccagcctgaccacccctattggcttctggaaggtcagaggcacattgctccttttgagagtggctcccagcctcgtccggctgggcccaaggacacacactggactggctggctgttgccatgggaacctcccagggttaccctgacacaggaatgtctcctcatcctgcctggttctgggccacagatgttcctggccccttcacatgctcacagcaggggtctggtagggacagtgcaggttgcagggtaggggtgtggagggctgttgcctaaatcagacaacaggttcttcccctccccaactcagctgcctgagccacagaagccccttgttaagcacttatctgagttccctgtcccacctctcccaggtctcccttaaggtggccacccatctctttggtaacctttggcacccaggataggtgactgccgctcccaaatggagaacaacagtgaaccccttccccgctcacctgttcttctggctgggcctgttcctggctcacctgttcctgggccaggggggctcccagcccagatcttttctaaccagagctttgacctgagcgagatttgaagtcggaaaccccagagtggcggtctccaccgctgcccacctgtgggccttgggcaagagggctctccttgcttaagggctcagctttctcatcattgaagtggagaccacagactctgctctcagaggctgtcccgagggtgagatgagtcaatgtaagatacatgaaaaggctttgcaagctaaagggcactgaaacagagcagttatttttattgtacttaacctctaagggggaaactgggagccactgggagctactgatatgggaggaaagggtgttggttccccgatgtggcaggagctggcgggaaaagatgctaactagcattcaggtctcaatactgtgctagatgctgtggggccccccaatccttgccccgaggctaattggattagctgcatacaaagcagaattttaatagtactctcttaatggtgccaggagcagtctgccaactgggtgaagaggaagaaaggggtggcctttgagttggatcttgaaagataataggatttcagagatgggagaatgggggaaggtatttcaggctaggcaaaggtgaggcctgaggtaagggtgttatagcctatagctagatggttcacagagggggcaaattctgccactggcagcctgcaggtctgaggggatggctactgtaggaaatgggaggggtgccactaatcctcaccattccccccaccctccacttcctctccagagcagggcccctttgcaggagttctcaccagcatggggcacttaccttcgctcagccccaggggaggcattcagcagaggggagggtcatccattgaggtcatcactgagactctgttcaaaatcaaagggacaggtcatctggctagagcaggataggcagacacctgaagccacatgctgtggagaggaaagtgctagatagctccctttggaaggtccattgcccatgggtcaaacaggctggccatcaatgcttgctcatctggaatgacaggactagtccagaaatagtggcatgaggccagcaaaggaacaggctggctgggcgctgtggctcatgcctgtaattccagcactttgggaggctgagatgggaggttggcttgaggccaggagttcgagaccagcctgggaaacatagcaagaccttatctctactaaaaattaaaaaaaaaaaaaaaagtttaactcagcatggtggcacacacctgtagtcccagctactcagcaggctgaaggtggaaggattgcttgagcccaggacatcaaggctgcagtgagcttatgatccgccactgcacttccagcctgggcacagagtgagaccctgtctcaaaaaaagaaaagaaacaagccatggctgtcatctaggtggatcattaacttttctttcttttttttttttttttttgagatggagtctcgctctgttgttcaggctggagtgcagtggcgtgatctctgatctccgctcactgcaagctccacctcctgggttcacgccattctcctgcctcagcctcccgagtgtagctgggactacaggtgcctgccaccacgcttggctgttttgtttttttttttttgtatttttagtagaaatggggtttcaccgtgttacccaggatggtctcgatctcctgacctcgtgatctgcccgcctcggccttccaaagtgctgggattacaggcatgagccactgcaccgggccacatttaacttttttcccctgggttgtggaaggcaggcagagcatgttatataatgtaaccagttccaccagctagtggacttgggagggaagtgctactttggggagtatttgagcaagtgaccttggagggttgggtggatgagcatgtgagtttgcaggttgagcagcttctggtgatgacaaagcccagggtgtgtccataggagctggcctctgaggaggagaggggggaaaaggctttgaacagccagggccaagggattgagcagcggggtgttggatgggctggccatgaccgtgatgtcaccgaggatgatgacagcaactctgtagaaaaggagactgggagccagtggctgagtctcagaaaatgagaatgaggctgggtgcagtggcttacactggtaatcccggcacttttggaggctgaggccagagaggactgcttgagcccaggaattccagactagcctggccaacatagcaagaccccgtctgcataaagaaacaaaagaaaatgaaaatgaaccaccaggattgctgggctgccagtactgaggaaagcaggagggtagcgcaggcaggtggcatgagccttagaggaaccatagttttccaagaggcaggatgagtaatggtgtggaaattaaaatggggaggaagggaggccatagactcaaagcggatgctgagggatgagggctgggagactaaagcctccacttgagacaccagtaagggacagtggagttcagttgaggcatactaggaagcctagtatgggggaagtttttttttattttttgagacggagtctttttctgttgtccaggctggagcgcagtggtacaatcttggctcactgcaacctctgcctcccaggttcaagtgttctcatgcctcagcctcctgagtagctggattgcaggtgcccgccaccacgtccagctatccagctaatttttgtatttttagtagagatggggtttcaccatgctggccaggctggtctcgaactcctgccctcaggtgatccgccttggcctcccaaagtgcggagattacaggcgtgagcctgggggaagttttctgatcgctcactaggtattcagggagctggatctcagagtcagagagggaggtaaggggcgtgcattgggtcaggtgaggaaagagactccgggagtaagttctgactccttccatgtgactcaggtaaaacaggagatgtggactttccgtggaggcccaaatacatgtttattgaagatgagctggaaaatctgattctgtgttgaatgacgaagtgctaagaataaataacaaccccttacatctggatgatacttgagaacttacaaagtattttattgtaccttgtcatatattttcttcattcctttcttattataaccctgggaagtgggccttatcagtggtaaactcagagtgacttgctaagtgtccaagctgggactgaaaatccactctgtgctgccttctagggcgttgatgagtgcagtgttttctgggttgctgaaaaaaaacaaaaaaaaccccaaaaaacaaaaaaccacctccttaagtctgttctttttgcatctgaccactctcctgtgcctcttttcaacattcaggaaattaatggtttctccctaagtctccacactacactttttctctagtggaggcagtaatgagttgcaggctctgttctgacatgctcagaaaaatgcaggacggcaagtcatagccaaaaacaactcgacgtactcagctggggcaacccgtcacctactgcgggaagaggcagaaccggggatgcagggaaaggacagattattcttatcctgcctctcaaacttctggctgggagccagacttcggatgaaaccaggcaatctcatctagggattcaacgctcccttactattgatgtcacccacgccgtttgcttccgaaaacctttgggccggaggctgcggctagaaaagcaatcaaaggtttctcgccgggcttaaagggccacatcttagtgacgtctcgggttataaaatctgcttgacaatgaaatatcgtgtgcgcgattctgctcctcccccgacatgacgtggccagacacgccgctcgcgtcagggctgccttacgcccccaggaagacccattcccactctggggcgcgcgcagatttgctgtggcacatgtactataacgcacaggcaaaagggcagtttccaaaacgtctccaacgtgatctcactccagagattttttttcctaaagttttagggctgcgcggaagggaacatggggttcacctcaggaaatttcagacgtcacccccctcggaggaaggtagtcgcgtccggttcctccccgggtgtcagttaagcaggccaggctgtgagcgaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcaggtgtccgtgaggcgggaaaggtggaagggggagctctccgcatcacgtgacacgaggagtgcttttgggtgtcacggagtgagctttggagtacgggtcgtccgtttgcaaggcaggaggagcactgggctggggaaggtggaatgccaccattacataaaacagtagtctacacaggcgagcctcaaagaagcaggtgaccacctctccaaagaccttcagctgcaggtctctctgagaagcattaataatggttcctacgaaggcactttctatataccaggcgttggataccagcctgggcaacatggcgagaccccgcctctacgaaaaatccaaaaagtagctgggcgtggtgacgcgtgcctgtggtcccagctattcaggagcctgaggtagaagaatcgcttgagcccgggaggcggaggttgcagtgaggcgagattggccactgcactccagcctgggcgacagagcgagaccctgtcttaaaaaaacaaaacaaaaaaccctcttcacctctttgttaggtactgtgtgccattattagcatctccatttcacaggtgaagaaactgaggctcttaaaaagttaaacaggccgggtgtggtggtcatgtctgtcaccccagcactttgggagacagaggtgcgaggatggcttgagagcccagtagtggagaccagcctgggcaacacagtaagaccctagtctctacaaaaaaatggaaaagttagcctagtgcgatggcgagcacctctagtccaagctactcaggaggctgaggtgggaggatcgcttgaacctgggggctacagtgaattgtaatcatgctactgtcctccagtccttgcagcagagcctgagaccctgtctcgaagtaaaataaaataaaataacatacgaagttaacaacaaaaaacccttgctggtcacaaagtaagtggcaaatccaggattcaaattcagctttgtggttcatgatgggcatctcagcaattaatatataattgaaacaaaaagaaaaaaaacccaaacaaattcaactttatcttgcgccaaggactggtttctttctgttttatctggctgcctccccaaataataataccttttgcacagtgttttctgtcaaagcaagatcttctgtgcaggagcattttgctgagacctgggctaggagagcagaggttggggagaaagtggggctcctctcctcttgaaggccagtgtggtgggggtaccaggaagctgcttttgggtaccacgggggttctatgaaggtgtgggagagcccagagcagaggtcaccacctgaatttttcatcactaagtatctcaccaccttttcctaagttgcatttctcctcacctccaaaccctgacgtcaaatagtggtccgaagcacaggctctggaattagactgctgggatgcaaaccctggctcactgttgattagtgtgtgatcttgtacacatctgtcattcactctgtgcctcatgttttttttttttttttttttttttttttgagacggagtcttgctctgtcacccaggctggagcgcacccaggttgcggctcaccgcaacctctgtctcctgggttcaagcgattttcctgtctcagcctcccgagtagctgggattacaggtgtgtgccaccatgcccagctaacttttgtatttttagtagagacaggtttcaccatgttggccaggctggtctggaactcctgacctcaggtgatctgcctgcctcggcctcccagagtgctgggattacagacgtgaaccaccaccgcacctggcctgcgtctcagttttgtcatctgtaaaatggggatgataatagggtggttgtggggattaaatgagataatgtgtgtgaagggcttagaataattattggcacctagcagaggtgcaggaactaaatgttggctatatttattttaccaatcttggcttcactacttgcagtgttgctttgggggagtcaatcctcctttcacaacctcagcttcctcatctgaaacatgaaaataagaacacttacagccagggcaacatagtgagaccccctctctacaaaagataaaaaaaattagctgggtatggtggtgcatgccagtaatcccagatactcaggaggctgaggtgcgaggattgcctgagcccaggagttcaagattgtagtgagctgtgatcataccactgcactctagcctgggtgacagcaagaccctgactcttaaaaaaccaaaccaaaacaaaacaaagaacacttatcgttgggcgcagtggctcacgcctgtaatcctagcactttgagaggccgagaagggtggatcacttgagctcaggagttcgagaccagcctgaccaacatggtaaaacccttctctactaaaaatacaaaaattagtgggacgtggtggcgccggcctgtagtcccagttacttgggaggctgaggcaggagaatagcttaaacccaggaggtgcaggttgcagtgacctgagattgcaccactgcattccagcctgggctacagagtgagactcagtctcaaaaacagcacttatcttcctgtgcgttaagtgtattgtgagcatctcaaggctaggacaggaagcatgtatcattcacatttgtatcacctagatccaaatatggtacccaataaatggttggttaagccaggaggcagaggttgtggtgagacgagatggtgccactgtactccagcctggacgacagagtgagactctgtctcaaaaaagagaaaaaaagaagggccgtgtgcggtggctcacgtctgtaatcccagcactttgcgaggctgaggcgggcggatcacgagatcaggagtttgagaccagcctggccaacatggcaaaaccccgtctgtactaaaaatacaaaaattagccgggtgtagtggcgggcgcctgtaatcccagctacttgggaggccgaggcaggagaatcgctcaaacctgggaggcggagattgcagtgagccgagatcgcgccattgcactccagcctgggtggtggagcaagactccgtctcaaaaaaaaaaaaaaaaaaaaaggttggttaagtaaattaaataacgaatgagttatttttatttttattttcatttttgagatggattttcactcttgttgcccaggctggagtgcaatggggcgatctcggctcactgcaacttccacctcctgggttcaggtgattctcctgcctcagcctcccgagtagctgggattacaggcatgcgccatcatgtccggctaattttatgcttttagtagagacagggtttcaccgtgttggtcaggctggtctcaaactcctgacctcaggtgatctgctgcctcagccttccaaagtactgggattacaggcgtgacgaccacacctggcttttgtttcagttttttaaatttgcttttcttatttcatttttatgagacagggtctcactctgtctcccaggctggcatacagtggtacaatcatggctcactgtagcctggaactcctgggctcaggaatgctcccacctcagcctctggagtagctgggagtacaggcacatgctgccatgctcagctaatttttaaattttttggtggagatggtatctctgggtcttattgtgttgcccaggctggtcttgaactcctggcctcaagcactcctcctgccttggcctcccaaagtattgggattacaggtgtgagccaccatgcccaaccagtgaattaataaatgatatatgttatggtgaccaagtcagtggagacagatacctctggctatgagagaattagtttagggtctgggcaataacctaatccagctagaatattgtgcgcctgttcacactgtaattagcactttataggttttacctgttagtttcagggctcttttatattctttagagtttcataataatcctgtgtgggagacagaacagaaagtgttatccccattttctgatgaggaaacaggatcagggacattgagacctaccaaagttacataataccagtagtagaaatgggacttcaacacaggcctcttgactccctttctgggacatggaagctcctggaaattctaggctaactggattctgatctccctgtcctgcagacttggagctgatgtctgtgctgtcctccggctctctggtccactcaaggaacagtatgctcaggtaggtggtgctttgtggcatccggtgtgttgggcggggccggctccaggactttggagctgtggctgctgcctgagtcactggcatgattcccgtcaccactgctggcagggtggtggccagctcttggttttctgtgagtggacctttcgggggcattttcagcttatatttctttcctaatagcctccctcccttcagagtgagttcaggaaggtgtgcccaggaaaggctgtcgacactcgagttggcagctctgatgctgtgtgattagtaaggacctgcctgtgcctcctcacaccaccctctcactcagctggcctgacacagcccctagaactttgctcctagaaatttagtacaggccgagcacggtggcacatgcctgtaatcccagcactttgggaggccgaggcaggtagattgcttgagtccaggagttagagaccagcctggccaacatggtgaaaccccatctccgtttctttaaaaaaaattttttttaaagtaaacaacaacacacaaaaaagaaatttagtcccagaagttgtcaaaatatatcattaagtgaaaaaaaaaaaaagccaataccaagatatagaacagtgtgtagagaatgctacatttgtctaaaactgaagaggcactttgtgaccaagaattgtaaaagaattctaaatatatctgctcatatatttggctatttaacaaatatttacagggtgcctgtctcatgttcagcactgtttcaggtgcctgggatgtgttcctgcactgcatgggaaagacaggttagaaaccgtaccattggttgcccccagggaggggacagggtgagagagagattttcgactgtaaattaatgtgtatctttgaattttgaaccacatggattaaaaaaaatagaatcgttaaaatagaataaaaaaaataagtcaacaggaactctcagaatcttagacttcagaaagggaacttggaaggcaagatcagcctcccacatggtgaagagccctcttgtcgccacattttgcccttgacctctaggtgcacccttctgggacgtgtgctttggcccctcaattggccagagtgtggtttccggaaccacataaaatgaattgtccccccttctatatgccatctttgcctccatgggaagcattgggtcatctctcaccagctgaacagacctattcatagggtggcagcctgaggaattgtaagaataactaaattaagtggtttatttttttttctttttgagacaaggtcttgctctgtagcgcaggctggagtgcagtggcgcataatggctcactgcagccttgacctcctgggctcaagtgatcctcccacttgagcttcccaagtagctaggaatacaggtgcatgccactatgcctggctaagtttaaaatttttttttgtagagatgggagtctcattatgttgcccaggctggtctccaactcctgggctcaagtgatcctcccactatggcctcccaaagtgctaggatttgggcaggagctactttacctggcctggttttcaaaaattttaagcaggattctttcccaaatgaaactggatacagaatttctttgtatccaggagacagactgggagcgatgctgcagggtggtggggtggtggtggggggatgggaggaaggaaggggtgaaggggaaggcactgagccttccctagtggggcctaggcacttccaaaggcctcccaggagcactttcaaaactgatcttccaaagttcccagacaggtcttgcttctgtcctactgagtgagactggtggggttgggtggggggcgggaggaagaaggagcaggagtttgcatttttatttatttatttattttatttatatttgagacggagtctcgctctgtcgcccagcctagagtgcagtggcacgatcttggctcactgcaacctccacctcctggggttcaagcagttctactgccttagcctcctgagtagctgggattgcagccatgggtgaccacgcccgggtaattgttttgtatttttagtagagacatggtttcaccatattggtcaggctggtcttgaactcctgaccttgtgatctgcccgcctcggcctcccaaagtgctgggattacaggcgtgagccactgtgcctggccagtttgcatttttaaaagctccatggaagactctgataggccagactgcccttgctctgtgcaagtccagcaccactctatcccccactcccattaaaaaacaaaaccaaaatgaaatgttcatgcattgatttcctaagtcacaagaagaaatataaccaacaagtagaccacaacgctcctggagggaaactggttcaggagcaggaggtggctactgacctcctcttgcagcaaggggagcaggtgggtgatcaagaaattgagagcctgaggggagaaggtcttgttgcagtgagttcatggaggagccagaatctgaacgaggtgatgcttttcagacccctcctatcctggatccctttggatggacccctctgcttggaaaggggagaaaggagttccccagggtggtcagagtaacctctcctgccttgggggtcctctgggtgtgggaggccttgcaagtgcccagagccagatggagtgatgctgtttcagcaaaggcgccaggaatttggggatgggaaggggtaagggggagagaaaggagacacaatctccgtgggatttgggatgggggcaaacaatgctagtgggaggacatggagtgcaggattttttttcccccctcagatttcccactttagttgaaggctaagcctttgcccaggggatgcaaactaatttcagtattagtttaagccagaaataattgggaaggtaaaacttgcaaaagagaaaccacgccacatatttcaaagacaaattgaaacaatttctggattatccccagacctttcttctgtctaccagtgatcgggatttcttagttgctgagactcttgcccttgcagacctttgtcctggctgaaacctcattaatccttgcatcagccctgggggaggcaggtgagggtgagggatggctcttccgctgttttaggagagaccactgaggttgaaaggccggtgacgtagacataatgtcctttgggcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctgggtaagagggctccatggcagcatgaagaacacctgtttccctagctcttcgctgtgtccatctctctctgtctccactgccaccatcctggcccaagcccccaccatttctggcctggacagtcgcagtagcctccacactggtctctagctgtggctcttgccctctgtggtctattcattacacagtagccagactgaccttttattatttatttatttatttatttatttatttatttatttatttttgagatggagtctcacacttgtcgcctgggctggagtgcagtggcgcaatcttggctcactgcaacctctgcctcctgggtttaagtgattcttctgcctcagcctcccaagcagctgggactacaggtgtccaccaccacgcctggctaatttttgtatttttagtagagacgggttttcaccatgttggccaggctggtctcgaactcctgacctcaggtgatccacccaccttggcctcccaaaatagtgggattacaggtgtgagccactgcatgcggcccagactgaccttttaaaaacgtgaaccaggtgatgtcactcttctgtttagaatactttggtggcttcccattgtgctcatgaacaaaatgaaaatccttcacatgaacttctgggccttgtgtgatccagtttctgctacttttttagcctccttactccttaagctgtagcaacactggccttcttggtcctcaagtcagtcgaactccttctggaatcagggcctttgcacatgcccttccacctgtctggactgccctttctttctctttccctggttagcttcagctcagttgacatgacacctccacagggaagccttccctaatattcaggtcttaactggtgctccctggcaggtgctcctatagcaccctacccctttttttcctcattcattctggcagtgaatattgagtgtctacttctgccaggtgtggttgcatgttgtggggatatattggtgcaaaagcgcaatgaaatctcttccttcagggagcttacattacagctgagggtggcggggagataggcacagaataaatacagaatatatcaggcagtggtaaatactaaggagtaaaataaagtaggcctaggatatgaggagagatagggaagcgttgctgttttattaagggtgcctgggaaggctacactgatatgatgatgtttgagcaagacctgaaggaaataagggataactgaatggatatttggggaagtagctttccagagagagggaggaggaagtgcagaggcttgagtggtgagtgtgcctggtgtgtctgaggacaagccaggtggccagagtggtggaaggtcaggtcagacttcccagggcggacctttgggagagctgggattttattctgagtgagatggggagtcactacagcgttctaagcagaggagagacatgatctgatttcagattgagaagcctggccatagctgctgtggggaagatgggagcagaagcacaggggccgggtggaggactttcctgtgttttttttttttttttttttttttttttgagacagagtctcactcttgtcaccaaggctggagtgcggtggcgcgatctcagctcactctaccctctgccttgtgggtttaagcgattcttgtgcatcagcctcccgagtagctgggattacaggcatgtgccatcatgcccaactaattttttttgtatttttagtcgagacggtgttttaccatttggcaaaatttgaactcctgacctcaagtgaaccacccacctcggcctcccaaaatgctgggattacaggcatgagccaccatgcctggccaggacctttctgtaacagacaaaatgactatggttggggcgcagaggggagcaaacgtagagtggagagaaggggtcaattttgcgtgtattttgaagagaaaaccaacaggatttgcccttgggttggctgtggggtgtgagagactataccaaggattttgttctgagcaggtggacaaatatagaattatcattttctaagacagggaaggtggggaggaacaggattggagaggaaatcaggagttgagtttcagccgtgttgaggttgagacacttgttgacatacactgtaatcacatggttatttgattactgaatacttgttcagtgtctcccactagactgtaagctctgagagggcaggcacagggtctgttttgcttaccagtctagccttagcacctagcacagtgaccagcgtacagtaggtacttactataatacttgtttaattggattaatgaacttgtcagcagcactgcctgacatgtagtcagcactcagtggtgtatgttcaatgaatgaatgaatccgtgaatagtgagtctagctgctgacatgctcacgatgatgggggggtagagccacaccccacactgccctgggttctgtagtcctcccacctcccctcacttctatcatcctgtcctgttggtcacctgtctgtccctctcctgcagctggtgagtgacacacggagagtgtctgacatccagtggtttcgggaggcctatggggccgtgacgcagacggtccgcgttgtagcgttggagcagagccgacagcagcggggctgggtgttcacgccaggtgagccactctatgtgtagggcacaggaggacacaggctacccaccctgtggtttgtctaccgggcaggcctgggggaagtgaataagggatgataaaggagaatctgaggcctcctgattagggagtagcatggtggacagaatcctgagggtcaaggttcccttggcttaacctaggctatcttctcatggccagtgggctgctttggtggtctggctgggacccacccccatgattcttcacctttgctttccagcccagtaggggctgacagtggtcaggggcaaacctgacaaagctcacttctgtttaacacagtagtggagttagaagttagtagtggagaggaagttctgctgggagcttcagtggtgcaagcccaggacccgctctgtgggcttcagaagcacagctcaggcttccttcctgccctagatcactgtgacttagagcagcagttcagatccaatgggtatgaccactactaatgctgctcatttctggggcactcacatgtccaggcctgtgctaagcattttatatgcactgtctcactttaccatcaaaacagattcagcaggtagatgctgttattagtttacccatggttggatgaggccctggcctgaaaggttaagtctctttcccagggtcacaaagagtgagaggaggagctggcctcctgaccctctgcttctgactccagcacatgctgcctcctgaggggattgagtcagacagatttagggatagaaaaggacacaaccagcttgacagaaaatgaaaacacagtgcccttttgggttgtgtgtggttttagatgacccgattcaccctctgtaggcagtagcaagtgaaggattaagtcaggagggatcagctgagaggcccaggtggctatgggctactgaacctgccatcacagtgtttcaggggtagggaggtgccttctgggtgggtagcccttggctctagggtagcagaggagaggccgggagggcccactccagttggggttagcaggccttgatgcctgctgtctgtctggagggctgaggcctgacctcaccatgcttccttcataggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcacactctcagagctgcttgtctctcatttccttgatgccaagctggcctgggtggggtttagaaggcgttagggtgtcatggtggctggagggtccctgttccacctcccacctggctagaatgtattcttcagaggttgacctatgctgcaccccacaggcaactggcctgtttatgttggaggtgggattgggttgaggcccttaccctctggtatagcgccatgaaaggctgtgatccatagaaagtgccaccagcaagtgccccctccccccgctttttttttttctttgagacagggtcttattctgtcacccaggctggcatgcagtggtgtgatcatagctcattgcagcctgacctcctgggctcaagcaatcctgcctcagcctgccaagtagctgggtctacaggcacacaccactatatttggctaatttttttcatttttagtagagacagggtttcgctatgttgcccaggctggtcttgaactcctgaacttaagcaatgctcccaccttggcctcctaaagtgttgggattacaagtgcgagccattaccatgcctggccctgcccttgtaatttatatagccttttataatttccaaatttcttctagattcttcacagctaccccctgaaatgggcgaggataggattttcatcgcatttagcagatgccaagaactcaaagaagtgaaacaacttctccagggttagagggcttagtaagtgtcagtgctgtgtggaacccaggccacttgactcctgaccaggccccttctgcacattcctatggttgtggtacaaagtcccaaggctccttgctgtccccaggccaagcctaagccctccaactctggccctggcttcgtaatcctcccacaaattctgttctcacagataaggggacagccaaagaaattacactttcagtgtgacccagactgaatcttgtttctgcccagatctcctctgctctgctgccatcatccttgctgggtgccaggcactgggcacataaagatgaacaggtcacaggactgttccttaaggaactcttgacctcagtgagaaatagacaccctccaggtgcccaggaacctgaaggcagtgccaaagacaacttcagttctctgggaaggagggtgggcttccatgacacccaggcctgccgtgcctgggtgagcactgaccccttgtcccaggggcactgccattgctgcttggaaatccctctctggagctgggagcaaatgattgtgaacaatcccagtcatggaaatgtccaaaagtcactggggccaactctgatgaatgtgggaggcaaagtttttgggttacaaaccttaacgagtcataaggtttgtaaagaagtcgattaggggctggggtggggtggctcatgcctataatcccagcactttgggaggcagaggagggtggatcatttgaggtcaggagttcaagaccaacctggccaacatggcaaaaccccatctaccaaaaatacaaaaattagctgggcatggtggcaggtgcctgtaatcccagctactcaggaggctgaggcaggagaattgcttgaacctgggaggcagagatcttgccactgcactccagcctgggcgacagagcgagactatctctgagaaaaaaagaagggcaggaaggacacaatcaaaccagggagaacatagagtccacggggccagctaagaggcttctgcaagattccaagcaagaagtagcacaggctgaaggagagagggtcactggaaagcagatgggttggtggtggcattcaactttgtttctgacccagcccacctgataccgggcatattcccatcagtgaaactggctcactgcctgaaggggagcagaggttccgggcacaggagccctgtcagaacctccgggttggaggtgaggaaacacctactgcatgacatcattacctgcttgattccagcatgtcttctgtagtcctgtctcaccatgcattcaatcacatccacttcctgagcacctgctgtggctctaggagctagggacacagctacaagagagacatgggccctgccatcacggaatttacctttcagaaataatcctagacagggtaggttccacagaacttggggaccgattagccacagcagctggggagatggaggagttcaaacttgtgccagaaaccctgggttttatcgccttccctgaagggggtgtcttcagcatgtgggaatgtggtagtaccttctcagtttggaagccagtgaatccctgccttcgtaggcaatgagggtcaaagctccagatggatgtgaacctatcaagtgtggtactagagtaagagttgatgcagacaggggggtagggactggtgggtctcctgtgccctccgggaggggtgctgccctgctttcttggctctgggtatttagaggagacacaggattatgacttgggagccagtgggtctgtctacctggtgacaggttggtagtgatgccttttaaaataggaagcccagtgtctgccggattcgaagttcataatatttttttttttttttgagatggagtctcgctctgtcacccaggctggagtgcagtggcacaatctcagctcactgcaacctccacctcccaggttcaatgcttcagcctcccgagtagctgggattacaggctcccgccaccacgtccagctaagttttgtatttttggtagagacgaggtttcaccatgttggccaggctgttctcaaacttctgacctcaggtgatccacctgtctcggcctcccaaagtgctgggattacaggcgtgagccactgcgcccagcctcataatttttttttttaagcaaggtcttgcgctgtcatctgggctggagtgcagtggtgcaattacagctcactgcagtctcaacctcctgaccccaggtgatcttcctatctcagcttcttgagtagctgggaccacaggtgtgtaccaccatgccaagctaattaaaaaaattttttttttagtgatggggtctcgctgtgttgcccaggctggttttgaagtcttgggcccaagtgatcctcctgccttggcctctcaaagtgctaggattacaggcatgagccactgcgcccagctcataattttttttaactgatatttccctaaatataaaaaccaagaataaccctcacttttgacactatatgttatgatgagagccttagctgctttttatttcaagacattctccccacttcactgctacaggttgaccatcccgagtccaaaaatctgaaacctgaggtactccgaagtccaaaactttttgagggctgatatgacgcccaaaggaaatgatgagtggagcattttgtattttgtgtttttggatctgggatgcttaactggtaagtataatgcaaatattttaaaataaagatcagaaattcaaaacacttctggtccccagcattttggataagggatactcaacctatagtctttgctcactttgtctgtggttataatctcagagtataaagctacttatttatttttttctttaagacagggtctccctctgtcacccaggctggaatgcagtggcatgattatagcacactgcagcctcaaactcctggactcaagtgatcctcccacctcagcctctggagtagctaggactaaggtacgcgccaccatgcttggctaattttaaattttttttgtagagatgggggtctcactatgttgccagggctggtcttgaacttctagcttcaaacgaagcttccactttggcctcccaaagtgctgggattacaggcatgggccaccatgcctggccaagttatttttaatattatgtgtctgttattttactacttcttctttttttatttattacccacccatgaatgtatgtatatgttattttagtcatgatttgtaacactaacagcctctttaaaaatttattattatatttctaaacaactttattgagctataattaaaatataataactacatatatttaaaatgtacaatttaggtggggtacggtggctcacacttgtaatcccagcactttgggaggctgaggcgggtggatcacttgaggtcaggagttcgagaccagcctggctaacacggtgaaaccccgtctctactagaatacaaaaattagctgggcatggtggtacatgcctgtaatcccagctacttgggtggctgaggcaggagaatcacttgagtcaggaggtagaggttgcagtgagccaagatggcgccactgcactctagcctgggcaacagaataagactccatctcaaaaaaaaaaagtacagtttactgagttttgacatatgtatacatctgtgaaaccacagtacaatcactatggacatattcatcactctcaaacatttcctcatgtccccttgtaattcctcctctcgcctctccctgattccccaccctcacccccaagcaaccactggtctgctttctgtctctatggatgtttatattttcaaggattttgtataaagaataataaaatttggcgagatgcagtggcttacgcctgtaatcccagcactttgagagctcaagggagggcagatcacctgaggtcgggagttcaagactagcctggctaacatggtgaaactccatctctactaaaaattagccaggtgtggtggcgaatgcctgtagtcccagctacgtgggaggctgaggcaggagaatctcttgaaccagggaggcggaggttgcagtgggctgagatcgtgccactgcactccagcctgggtgacagagccagactccatctcaaaaaaaaaaaaagattaataaagttttatacaaagaacagtatatattctttattgtcttgtttcttttcattgagcataattattttgaggttcatccacattattggtggtatcagtagttcattcctttttttttattggtatgtggtatgaatataccacagttgtttaccagttcacctgttgatgaacatttaggttgttcctagtgtttggatatgacaaataaagcaactatatacattgatgtacaacatgtataagtctttgtgtggacatgtgctttcatttctctcaggtaaatatcttttcaacttttttttttaagacggagtttcgctgttgttgcccaggctggagtgcaatggcacaatctcggctcaccgcaacctctgcctcccgggttcacacgattctcctgcctcagtctcctgagtagcttggattacaggcatgtgccaccaagcccagctaattttgtatttttagtagagacagggtttctccatgttggtcaggctggtctcaaactcccaacctcaggtgatccacccgcctcagcctcccaaagtgctgggattacaggcgtgagccaccacacccggccgacttttgtttttgagacagagtcttgctctgtcgcccagactggaatgcagtgacaggatctcagctcactgcaacctccacctcctgggctcaagcgattcttctgcctcagcctcctgagtagctgggactacaggtgcctgccaccatgcccagctactttttgtgttttttcatagagactgggttttgccatgttgcccagggtgatctcgaactcctgggctcaagcaatctgcctgccttagcctcctaaagtgctgggaccacaggcatgagccaccgggcgtggcttaactttatttttggagactgtgtctcattctgttgcttgggatggagtgcagtggcatgatcacggctcactgcagcctcgacccccctgggctcaagtgatcctcccatctcagtctcccgagtagctggtactacaggcataaaccaccatgcctggctaaatttttttgtattttgtagacaaggtgtctccatgttgctcaggctggtctcaaactcttgggctcaagcattcctgagcccaggagtttggcaggctgaggcctgcctcatcctcccaaagtgctgggattataggcatgagccactatgcccagccacctttttaacattttttttttttgagacagagttttggtctggttgccgaggcaggagtgtgatggcgtgatcttggctcactgcagtctgtacctcccgggttcaaacgattctcctgcctcagcctcccgagtagctgggattataggcatgcaccaccatgccaggctaatttttgtatttttagtagagatggggttttgccatgttgtcaggctgatctcgaactcctggcctcaggtgatctgcccacctcggcctcccaaagtgctgggattacaggcgtgagccaccatgcctggtcttaacttttttttttgagacggagttttgctcttgttgcccaggctggagtcaatggtgcaacctcagctcactgcaacatctgcctcctgggttcaagtgattctcctgcctcagcctcctaagtagctgggattacaggcacctgctaccatgcctggctaattttgtatttttagtagagacagggtttcaccatgttggtcaagctggtctcaaactcctgacctcaggtgatccatctgccttggcctcccaaagtgttgcgattacaggcatgagccactgcacccggcctacctttttaacttcttcttttttttttctttgagtctgtgtttcacgcttgttgcccaggcagaagtgcaatggcacgatctcagctcactgcaacatccgcctcccaggttcaagcgattctcctgcctcagcctcccaagtagctgggattacaggcatgtgccaccatgcctggctaatttttgtatttttagtagagatggggtttaatcatgttggccaggctagtctcgtactcctgacctcaggcgatccacccgcctcagcctcccaaagtgctgggattacaggcgtgtgccactgctcctggcttacctttttaacttttaaagaaatccctgccaaattgttttccaaagtggttgtaccacagtcccaccaattgtgaatgagagttacagttggtgtgcattcttaccaatactttatatgatgagtcttttaccttttagccattatagtaagtatgtagtggtatgtcattgactttttttttttttttttttttttttttgagacagagtcttactctgttactctgtcgcccaggctggagtgcagtgccatgatctcggctcactgcaaccttcacctcctaggttcaagtgattctcctgcctcagcctcccgagtagctgggactacagatacatgccaccatgctgggctaatttttgtatttttagtagagacggggtcttaccatgttggccaggctggtctcgagctcctgacctcaagtgatctgcctgcctcagcctcccaaagtgctgggattgcaggcgtgagccactgcgcctggccctcattggtattttatttgcattttcctaatgactaatttggtacaaatcctgtattcacatttgatgaaatctgtcagcaagcttgaaataggatggtgatatagtttggatatttgtcctcacccaaatcgcatgttgaaatgtaatcccagtgttggagctggggcctagtgggaggtgtttggatcatgggggcagatcccttttgaatggcttaggccatcaactgagtcataagtgagcttttgttctgagttcacacgagatctgtttgtttaaaagtgtgtggcagaggccagggtaggaagatcacttgagcccaggagttcaagaccagcctagcctgggcaacatagtgagaccttgtctggattcattaaaaaaaaaaaaaaaagtgtatggcaccttccccataatctccctctctcttgctcctactcttgccatatgacatgcctgttcctcctttgccttctgccatgattgtaagcttcctgaagcctccccagaaactgagcagatgccagcaccatgcttcctgtaaagcctgcagaacagtgagccaattaaacctcttttctttataaattacccagtctcaagtatttatagcaatgcaaaaatggcttaatgtagatggaatatactcagcctcataaagaatatctgtaaaagccctactgctaacaacacacttagtggtgaaatactaaatgttttccccctaagactgggaataaggcaatgatgtttgttctcatcacctattcgacattctactggaggttctagccagtgcaataagagagagaaaaaaaaagccatctaaattgggaaggaagtaataaaactccttttattcatagatgacatgatcatctatgtagaaaattggatggattctccaaaaaagctattagaacttataagtgagttcaataaagttgcaaggtcaatatacaaaagtcaatatttctatttcttagcaatgagcaatcaaattgagataaataatgccaattacaataccatcaaaatatgaaatagggataaatctgatagaagacataacatctgtacattgaaaatgacaaaacattgctaagagaaattaaaagactaaataagcaaagagattatactacattcatatattggaagactcaatattgtttatttttttgagttggagtctcactctgttgcttgggctggagtgcagtggtgtgatctcggctcactgcaacctctgcctcccaggttcaactgattcttgtgcctcagcctcccatgtagctgggattacaggcacatgccaccacacccggctactttttgtatttttagtagagatggggtttcaccatgttggccaggctggtctcaaactcctgacctcaagtgatccgcccacctcagcctcccaaagtgctgagattacaggcatgagccaccgcacctggctcaatattgttaacatatttattttttaaattcaggtataatcacacacagtgaaatgtactgaccttaagaatacagtacaatgagttttgacaaatgtgcacacctgtataacacaaacccttatcatgatagaacacattttcattatttcagaaggtttccttttaactcatcctactcaatccctgctttcccagaaacaattgttttgaattctttcaccatagattagttttgcctgttctagaatttcacacaaatgactaacatccaactttaaaccaaatttacaacaatgatttataatttagacttcaccggtttattgctcattttcaatccttttatagtacctcaacttccccatttttgaattttgtattttgattcctctccagatagttaatgtgtcttgaaaaattttttgaaaatggtatgtagatgatttttttttttttttttgagacagagtcttgctctgtcgcccaggctgcagtgcagcagcatgatcttggctcactgcaacctctgcctcctgggttaaagtgattctcctgcctcagcctcctgagtagctgggattacaggcatgtgccaccacacccagctaatttttgtattttagtagagatgtggtttcaccatgttggccaggctggtctcgaacttctgacctcaagtgatcagcctgcctcggcctcctaaagtgctgggattagaggcatgagccactgcgcccggccatgatctattttctgaacctatatgtatgagagaatgacattctcttgcctctatatttggacaatgacttggttggcataagtttcatgacctggttccactgtctggagagtatgaggtcaccttgacttttgttcctttgaaggtaaccttctttttttgcctggatgcttttggatattttctttcttctttttgtcttcattttcgaaattcaaatcctggcattctccaaggcagagatatggacgtgtcttaacaggaaaaagttggcatcttattgttcctggtaaagcattattgaataatgagatgggaactgaaatggtcttgtgcatccaactgtctgctgtaacctaaagtagtcaccttgggcatttgggctgagacacttcagggctgttgcctttatcaaatggctttgggagctcctctttgctttgaggacctgccctcaactctgccaaattctcatccccaaaagtgcatttgggttttggaaacgaccaaagggaatttggtactaaactctggtgaaagagacatcttatggccaggaaaaatagtcctgtaatgtaataattctaaaacttaccaaagttaattctcagagaggaatttttaaaagttgccttagtaatcaagcctctgtatcttcgcatgtgccattcatgctgcctaaagtacccttcctagttgcttgggcttggacccctacaacttgagcagagcaaggggcactccacttccatttccagaatgctccacagtgtacactttctcactcctccaccatgctgtgagcaagtaaggaaaggtttttttcctttcgagtctttggtacattgcacatagtagaggtatattagtcggttttgcattgctataaaggagtacctgagactgagtaatttatgaagtaaagagttctacaggctatacaagcatggcaccagcatctgttctgcttctggtgagggctcaggaagcctccgctcatggctgaaggcaaagggggagcaggcgtgtcacatggtgagagagggaacaagagagacagcaggaggtgccaggctccttgaaacaaccagctgtcctgtgaagtaacagagagagaactcactcattaccactgggatggcaccaagccattcatgagggttctggccccatgacccaaacacctcccatcaggctgtacctccaacattggggatcacatttcaacatgagatttggaggggataaacatccaaaccatatcagtaggtctcaatacatgtttgtgacaatgaagaaagtttatgtgttagaaaacaatatgacctcctaagcttattgtcatgaagcagttagcagtcatttggatgtattaagttatggcgaatgtgtttgaagcaagaacaaattgcctcccgttgcattactcttactcattatagacagtcacatgctggcaaatgtttaacaatcagctccctggaaggggaaaaacagccctgatttgtagtgtttgaccatttctgtagtgtaaatattcccactgtggctgatttcaatctaccagtgggatgtcagctggctagcaaaatccctgaacatgcaaaatgttggctcttgcaagccagtagaaggtggctgaagctggttccaatgcaccattgtacacattctacacctcttttgtttttccatcatcacccagttcatttgcgtgctccttgtacagcacatgtctatgactatattttatcccttgcatcaatctgatactatttttatcttcattttacaggtagtaaaataaggcccagagacaaagggacttgtccaaggtggcaaagctttcctgtctattcctgggttcagtttctcactgtagctccctgcctggagcccgacactgcaagggactagagagatgtcttctttgcccagttttcttttctctgatgttgagggaaggacccaagcaccctgtgcttgccaccagctctcatgcccaggacattcctgctggcagctgagctgtgatgaatgctggcatttgtcttgttcacttgctacctgataaacaggtgacagggagtttaacaactttcattagacggggatcagctctcactctcatggcctaattcaggatctggacagtgtcatgttgtctgacagccaagtgaagtgatgggtccccctttacagtttaggattttaattattttcttccaggtgagtcccaggaacatccagccaaaggcaagttctttgggagcccaagctcatggcagtgacagctcccccaggagacgagaggtgaaactgatgcctgcttcctgctatgttattttgtctttaacacttgccagtttctgggcttgttgaaggcctatgttagggactgtgtgagactttctgagagatcaccacctagatatgtgatgtcacacaaagtgagtattgtaatggacctcagtgatctagctcgaaacctcttgcttacagacgaggaaactgaggctcagagaggggaagtggtttgctcaaggtcaagcggcaatgactggcaatgccaaaagttggccccaaggcttctgactccccactccgtgcccttccctcaccctaaatgtctcagagagcatgaacctgtgccctttatcggaggagggcagagacggctcagcctgagcccatgggagttcagcccagttccctgcttcctgggtttgtc

SEQ ID NO: 12176 - DNA, 9964 bp, Human
  misc_feature (1)...(9964): n = A,T,C or G
nnnnnnnnnnnnnnnnnnnnnnnnnnnnnnnnnnnnnnnnnnnattcctttagtgttttcaatcacccagtactcggttctcttagagcaaaaatcctttggtgctagctcagtgttaggaaacgtctttatctcaatggcagagcgttctataccaattcaaaggagttcaacaataaaattgatttggcacttggtgcctgcagtaactggtgtactgccatatttttccaattaagaaaatatgtggcatgcgtggaatcacatatttaagcaagcaattaagttgtttatgacacggtctgttcctgtttagatcagtaattggaaatttggggacaaaaatagagattttattaagtctatggatcaacttgaaatttggacatctcctcgaagccccaaaactttgagtggcatccactgtgtagatgacatgtaatagacaaagccttcccacctcattggcagaatttgaagggtgtgttttcatatttaaatttcaatacaatatcagtaaaaatactttgctattaaattggcccataatgtttactataatgttccttcctaaagaaaggacaaatgtccacaaaactaactctgagaactagaaaatacggcaatatttaagatcaccgtagctagaatgcccggcagggccgagatctagcgactcttcttcctccaaaccagcaccaggtcttcctaaatttgtaaagtggtggagttaccgtcaaggtgcccagtgcagcctcccggccatgagtccacaactacaggcccgaactacaggttcgccagcgcgcctgacggcgaggttcaggtctgaacccccggcgggcgcagttcctgggattgttgatttccaagctcagggcaagtattaatttctctgcagaccggctcttccggaaatgatttttaacacccatgctggcctggatcctgcgctgggaagaactgcaaacagcctcgactatctaaactcagctttgacttcttaaaacccggagtctctgattcgggcgcagaggataaaggttccagggggatatatatatggtggctgtatatgctcacactagaagagctcctgtttttaaagggaggagaaggacaggaaagtggcaacggatgtgtgcaaacccagagcagaaaaattcatattttattaaacatccgagctgctggttgcatgaaaaggctttgagcaaccaatagaaaccgaggatcgcgaatattccgcttgaacctgttgatctctgtgggttaagcgtttagggtcgagtctgcgtttccacgagggagggcgaagagagaacagaaagagcggttgctttcgcccgccaccggaggctggttttccgcctcctgccttctggcccggcttgggcggcgagccctttgggcggccaacatggcgtgggcgcctgtgctcgtgcgaccccggtcgggcaggcgggacggagattacctggctgtccaggggaccttatgcagggtttggcccgagcccaggggcagcgaggggcgtctgcggatgcggctccctgtgcggcacaacaccggggtctgttgctctcgctgatacctttcggcccaattgttcctaaattagaccagcaagtttgcggtaggcagagagccagcggtggtgagagctggcctgagaacgagccagccttctgggaatggccggtgtgagaggccagtgggtggccttgccgcgcccttatgtccagactttgctctgtgagaggcctggcgctgcgcctttgatttctgtgagtgctgcggagcaagtgagtgcgaaagtgagtggaaagcatttggtgtttgctggggaaggccggtgactggggggtgaatagtgaggcggtgagtcgaggtacgtttgtgaaggaggtggtggatgactgcccaccttgccccaggcggccgctcagacttgacctttgcgcttctccgggatattcttcctccgggtgggttgagaagccggaccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtacccagctgccaggaggtcgagggcccagggagcagagagaacctggggttggaaagaggcttgggggacacactcgggaggtggtgcttctagtgtctggtgtaagatgagaaggaaagagatatctttactagaggtcttattttccaaagtagatcttagtcctatagcactcccctcctttttttttttttccatcctaacatatgttcccagaagaagaaagctgtgctgggctttctcccagagtttctataaaccacaccccccttgcctcgcactggctttaatgtggtttaatcctaatgggcctacttttataaggcttaaaaaaaaatcccacagaaaacgttttatctctggatgccttaaaagttccaaagagtattttgttctctggagttggatttccttgaaagtctgctctgcagggtctaggtttgtcaagcggatatcccaattaggtttatagatgtgcagactataaagaaaattagtaactgttaagtgcagaaatttacagtctgctgttagcggtcgatctcaaactgtgtgtgaaatagcggagaaataaacgcattttggtcactctttgttcattcatttaaccaaggcaacgaaactgaccctaaatacattagattttaaaacaaaccacatatattagtatttatatttccaaagcctgccctccagcacgtgccatacccaatgaagttaggactgaaacagattttctttattggttgtggaggcaaatgtaatagcaaaaataggctttgggggcatttaaaggagcaaattgtgtacattcacatacacatatccttctagctttagggggaacaaatttaaatgtttcagattgtatttccgctcaaataataaaatagaataaaatgatagttattattggtttgaacacatggagcagttttaggcccgcacatctgcagctgttacaaagtatcgctgtaacagatactctttcggtctctgggcacagagaccaccatctgtagcgaactatgcacaattcttaaggggcttccccacatcttgtaacgggatcaggaaaaaaaaatcagagcagtcacgttgaagaggaaaagtaataataggctgccttggtcatcacagcatcagcagcagagccttcctttttaagcctctcctgcttcgctctgtgcactgagatctccagaggctcagcaaccccttaaaaacatgatgataattattacagttatgattattagtatcttaattccaactcttctaggggaaaaaaaggcaagaagcctcaggccatgtgaattacacaaaggatgccaccctggcacaaaatccaccctctgttgtactaaatagcagagaaatttttgaagatttacattgactatgacacttgctttcaaaaacataccaatgaaagctctgaagcagtatttttactttaatggggttttaaaaactttaatttgtgagtcaatcaatatgctttattattgaaagtggaatacaaaagcaagctttatttgaattttaaaaaatctgtcatactgcctgtaaaagttgtcaagtttaagcaggtaacatccaggagaacaaagtacctaagagttacttgctttatatatacttcattctcctttcgctgagtgctcttctttttttctcttaagaagtgaactttattgttgtttcatacttttatttacattttagttattttctagatgttttcctactatcctaactgcaaacagtggctttttctaaagaagcaaattagattatcatgataatggtgcacaattattctgctactgtgtttcactctgctgcacagcagaacagagaaattctaaacttctttgtagtgaggcttttatgacactaattacctctccccaacccttacaactccttctccgcaaaggagtcattatttgctctggtgtttggtttttctttaagatgaagctaattaacattacaggctattaatgaacacattcttctcaggtcttaactgggcaaatatctaaaccattatcatgttggtatcaggtaccaagcagagttttaggccatggggactctgttatgtgacaagatgaaatcaggactaatagtaatctatcttgtgaaagtctataaaatctatctttctatttctgtagttaatttacatgtttaactttggaatttgaggctgttttatacaattcaaagattgcttgctgtatctcccaattcttgtctaaaccacgactcttttctctttgtacttttgtaatttaaaaaaatttttagtcataacatctaggttttattttttttccccctccaacctataggtttggtttcaaaatcgaagagctaaatgtagaaaacaagaaaatcaactccataaaggtatgcttcttatacaaggaacatttgatagtctgagcaaagagagaagtagtgaatattactattacaatgacagaaaaaaaggaacctcaaaaatgacaatagttcttgacttaataatcttcaaaggctgttaatggagtcctaaagtttgggagtaagttacatttatttaaattttggatgcagtttagaaagataatagtccattttcaaaggaattcgttctgtcttgtaccctttggaaccctgaaaaatgctacaaacgttaacctcacattatttttctcttgtactttttacaggtgttctcataggggccgccagccagtttgaagcttgtagagtcgcaccttatgtcaacgtaggtgctttaaggatgccatttcagcaggcaagtacagcctagtttcaagctgtttttaaatatgaaaatacctgaatgtttgcttgaactgttgaacatcacctgtctctgagcccagatgtcaatgtctgcatagttggagaatcattttgagatgacatagtggacccactaccctttaaaaacctatacggtattaaaggcctgaatgcctagtcccttctgtcctcatgggaatccctgaaggggcctgggggcagtaactggtcctttaaaaatacactaaagattgcccttagagagagaggaaggaaaagccttttgattaagattttgtcaaatccaatacagaggttagtcctaaggtatttctaaggcaaccctctagatacttttctaggtattttctacctcttagtcacattaaataactctgacagaagaaaaataaacacaagtactcccagctcatacttttgttttttcgttcttttgtttttaaatctgtttctgcaaacaaagcttcatctctggtaaagagagaagtcttggtcttcccagggctgccctgcctttgcaatcccttagccataaagaaacctttaagagtacattttaaaaggacagcctgcagcaatgatttaatcctgggaaatcccagtgctctgaactccccactttccaagcctgagggcgaaatcctttcccaaccagtgtctgaccttccctatcctcagccaggacccctgcttggcatggctgtgatgtcatgaattagctctcagtctccagtgacttggaccggggagacagataggtgtgaccatgaattgagagtcggtgttagggagatcttagctctcttggtgccacaggactctggcatcctgatgcttggctttggaaacaagagagaatgactgaagaaagagggaggggtgactttaaaaggagacctttactactcaaaaggtaatctttgggccagcagcaacaacaccgtctgggagattgttagaaattcagaatctcaggccccaacctagaccttgcgaatcagaatctgaattttaacgagatccctgggtaattgttatggcaataaaggttagaagtaccgactcacaattgtgcctattgtggtgaagatggagtaacttccctgaatgacattaaaaagttgcgtagtttgcttgttgatactccgttgttttggtagtggggtaagagatgcatggcagcatcaagagaagagggtaagggtcctcacccgcagtctttccaatataccatttcagcccagttcccaggggagacggccacattcctgcagaagggggttcccggggtccggggaaataagcctaccctaagcgagtttcggagacccaggggacactggagtatccatgtggaaccccagattcagcaacaggctgagaaggtcactgtcggaacaagatgcacagccaaatgccctctccccgtgcccaaacacaacccaactctctctctggccaagctggacgccgttaatgctctgtttctattctgttgtcaccctaggatagtcattgcaacgtgacgcccttgtcctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggaaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatgttacttgtattccattgatggtgtgtctcctcccacccccttatctcccatgcactcactccattttcatcttcactatgaaaaacaataccaaaagtatctggaaattgatatatatatatccatatatatatatcatatatttgccatatatatatatatatatatatatatatatatatatatatatttgccctgtctttgatcctggggaacaaaagaaaaaagtcagaaagggaaaaaattacactcattgtcctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaaccttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaattgaagacactttgcgatcaattgaatgaaaatatcgtttcatttgatggggttcgagtcatctttgttcctgttactattaaaatatccgggatagtctttcccttttgattaatgcgtatcactctctcgaatataccaacttggaaaagcgcttgcctctgctcttacgtgccgcagtcaaggggcagtaagaagggtggctctgtggctgtcgttagcgctgagcgcatttccgccggccccctccattttatccacccagcatagaaacagggttataccaaattaatgaaagaacagataagaagtaaaataacataggatagagtaacttccttccccaagatggactctcgttattcgttttgctataattccagtctttatctggggacacttttgggaggaaggaaggagggatcctgcggagcgaaatcaacctaggtttggtatggcataatcgacaatcagtcccagttcgttgaccctctctggagcggggcaggtgctgacttcggagcgggaaaagagccgcaaaggcgggcaggccagggcactgtggagggaggattccccatctgacactcctgtttagggttggctgaagcagcttcttcattggttaaatttagaaggtggaagccagaatcgggtttaggaaaagcctggccttgaaaataatgaggagctctctctccccatgtcgtggcccccttcttctggaagaaatcccactagtaaagcccaaaggtgctgcctgtgtggggatagttggagactttgaagactcggccctgaccatgtccaaggcaggaactttccttcccgcgcgggctcttgtgatgacgggaccttccgcaaagactgaaagagtcctggagcgtcccttgggaccccccaccctcgtgctggagggtgcgtaaaacccctgcctaagccccacatcctccagcagtgttccccaccacccccact

SEQ ID NO: 12177 - DNA, 59123 bp, Human
tcaccagaaggtcaatacagtgattagcaactgtagttggtgtgataaagcagagaggctcgcagtagcccttggaagggcctgagtagagggacataggatgaagagcactaccagtttgttggttagaataatctggtcagccgggcatggtggcttatgcctgtaatcccagcactttgacaggctgaggcgggtggatcacgaggtcaggaattcaagaccagcctggccaagatggtgaaaccacgtctctactaaaaatacaaaaattagccgggcgtggtggcgggtgcctgtaatcccagctactcgggaggctgaggcagagaattgcttgaacctgggaggtggaggttgcagtgagccgagattgcactgcttcactccagcctggtaacagagcgagactctgtctcaaaaacaaacaaacaaacaaaaaacaaaacacaccctggtttcaccatttacagtgacatcttgagcaaatgacttaaactctctgagtttcaatttctttatttaaaaaagaggattgttaataccccaccccacagggtggtggtaagaattaaatttggtaacatctataagacctgctgttcattacagttgattcttaaggcagcatccggtgatgcctttgaaacatacatcggcaaagtcttaatcagatgaaagccaaaacccctacacctgtgtaaggcgccacattatctggctgcccctgtgtaggtattttgctgttccctctacttgcaaccctcttttctcagaaatctgcatggtagcctccttcatctctgttaacagaaaaaccaaattctgtaaaatattttcaagaagtttatcctgaggcaatatgagttactgtagcttagagaaaacacaaacccaagaagccttgagtgagtggccctgaggcagttgggccatagtctggttttatacattttagggagacaggcattacaggcaaggatatctggaaatcagtacatggaaggtaactggtagttctgtccaaaaaatgtgagacatctcaaagtgggggagggtgcggtgttaggatatatgtattggtggtttttttttttgtttttttttgagatggagtctcgctctgtcacccaggctggagtgcaatggcgtgatctctgcccactgagcctctgcctcctgggttcaagtgattctcctgcctcagcctcctgagtagctgggattacaggagcatgccaccacgcccggctaatttttgtatttttagtagagatgggatttcaccatgttggccaggatggtctcgatctcctgacctcgtgatccacctgccttggcctcccaaagtgctgggaatacaggcgtgagccatcatgcctggactatgtgttggtttccatgcatgtttcctggcgcatagccccatagcccttgctacagtcttgctagaatgctgggctttttagacttcagggacaggccctaagaaacagtctctctcctgccgtcctttcacctgccccaaggcaaggtttttatgttttctggcctgactgtgggccttacaaccctcccatgaggccaggcatagtggttcatgcctgtaatcccagcactttgggaggccgaggtgggtggatcacctgaagtcaggagttcgagaccagcctgaccaacatggtgaaaccccgtctctactaaaaatagaaaaattagccgggtgtgatggtgggcgcctgtaatcccagctactcgggaggctgaggcaggaagaattgcttgaacccgggaggcagaggttgcagtgaatcaagatcatgctactgcactccaacctgggcgacagagcgagactctgtctcaaaaaaaaaaaaaaaaaaaaaccttcccatgagaggttcctaccctatgccctgggggaagaaatgctgacgtcaaggaagcttctataaaaacccaagaggacagggttgggtgaactttctgatagcttaataggaggaggttcctgtagggcggcacaaccagggagggcgtggaagctctgcatcccttctcccataccttgctctacacatctcttcatctgtatcctctgcagcatccttgatgataaaccagtaaatgtaagtagggtgtttccctgagttctgtgagccgctccagcaaattaattgaacccacggagaggggaaccccaatggaagctggttggtcagaaagaagttctggaggcctggacttgtgactggtggaggggggatgtcttggacactaagccctcaatctgtaggatctgacactatttccaggtagatagtgttggaactgaattagaggacaccaagctggtgtcgctgcttggtgttggggtgggacccccacacatatggtcacataagtcatcttctgtgttgattgttgtggtgtgagagcagaggaaagatggctacagagagttttccctacacagggacttggggggtagagggttaggggagggctgaggggccttacaagtcttaagtgcgttttagggattctttagctaacagtagctgagagagtcaagttattgtctagtgacttgaagtcagtaggaaggaatgcctgagtaagataaggaggttgtgggggcctaggtccttggagcctcatagatagcagccctctgggtgaatagatagtgattgtctcttctcagacctttgggtgtctgactctcagttagaatctctcctagatctgggaaaggcctagcaagggaagagacattaatatcgattctctggagatgcacgtttcccccaccaaagatggctttgcagtccaaaggctgtctggcagccttttccaaatatgtcaaagaaatgtattttggggcaaaatattttaatttccttcagagtctgctgtctgtcatgtgatactataccagagtcaggttggagagtaagccacattttactgggttaattaaaaaacccatttaatgagactgtattgtttctagggtatgacttaatctttgccttttatggccttaggtattgtgtatagtttggtatcttattgtcataaagggtctgtttggtcagtcttataatctctattttaccttaatgctggtcacttgtacctaaaccccaaaagggaggggtatgatgagggtgtaacctcctttctgtcatggctgggaattcagtttttcaggtttctctggggtgcccatggccaaaaaggagtccattcagttggttagtggggggcttaggattttatttttggtttacacctccttccaacccttgctcaaatgtcttcttctcagtgaggctttctctgatcatctgatttaaatctccacctcacccactccaagctgtccctatttctcttccctactctaattgtctgcatatcagttatctccttgcaaagcaccacggatttatgttgtttgactctttatttatcctcactataaggtgagtgctggaggggttagggatttctggctggcttctctactgctgtgtctgcagtctggttcacagtaggcaatcagcatttgctgaaagaatgaacctatagcttggaaccaacccaaatgtccaacaatgatagactggattaggaaaatgtgcacatatacaccatggaatactatgcagccatgaaaaatgatgagttcacgtcctttgtagggacatggatgaagctggaaactatcattctcagcaaactatggcaaggacaaaaagccaaacaccacatgttctcactcataggtgggaattgaacagtgagaacacatggacacaggaaggggaacatcacacaccgggactgttgtggggtggggggaacggggagggatagcattaggagatatacctaatgctaaatgatgagttaatgggtgcagcacaccaacatggcacatgtatacatatgtaacaaacctgcacgttgtgcacatgtaccctaaaacttaaagtataataataattaaaaaaaaaaaaaagaatgaacctatcgcatgagtattggtgtaagttttcttacaggccccggggccaccacaaagtagaagaactcaaccttccctattcatttcctcacctccaactcccttagactaccaggacttagatccttttgggtatatatatacatatatatgttttatatatatacatatatacatgttttgcttgtttgtttgttttttgagacaaagtctcgctgtgtcacccaggatggagtacagtggcatgatctctgctcactgcaatctccgcctccaggttcaagtgattctcctgcctcagcctcctgagtagctgggactacaggtgcatgcctccacgcctggctaattttttgtatttttagtagagacgggggtttcaccatgttagccagatggtcttgatctcctgacctcgtgatctgcccgcctcggcctcccaaagtgctgggattacaggcatgagccaccgcgcccagcctaaatgttttatatatatatatacacacacacatatactctatatatatatacacacacacatatatacacatatatatgtgtatatatatatatatatagagagagagagagagagagagagagagagagtatatgtgtatatattttaacaaaaaaagcctgggagaaccattgaatttgaaaccaccaaatctcaacaagccttgaaatctaacactcagtttaaggaaacacagagcagagaggagaacattaaacaacaccctgaggaagccgtgagccaggctcagaacataagccactccacaggagaaatgacttcattttttcaacaaatatatgccgtggaaaagaagaagtaagggagcgaggaactcttctagataagagagaattgaaaatggcacatcatccagtcatccaaacaaaatgtcctgtccttgtttggatccccttttgagcaggttagtgtaaaagacattattgagagaattggtaaacatttaaaggtgggttggatattgggtgatattggcattgtgatcatattgaattattatttatattcatatattctctggcagaacctggtgcgtgtgtgtgtgtgtgtgtgtgtgtgtgtgtgtctgtgtgtgtgtgtctcacagtgtagagaatctgagggtctacgttctcaattctcccaggggtggtacgattctgccaggggtggtacgtaggtaattctcgatgccatgggagttagttgatgcgttgcatacaatggaggtcttaggacattaaggcttaattttttgttggatccgcagttgggaagagctggtagcaggaaactgatacaaagtctggcgtttgctttaaattactccaagaaaaatcgaagcagtgtagtaaagattaggaggtgagacagttcctctttctgaggagatggcgggcccgttttcttctttgtctggctctctgtagcataggggtgtggtgtagtgtagggatgtggaggaaagagtgggtagctgtgttgctggggaggggtgaagtgttttttccactctctatataggcccttcctgcgctctcctctgcttaatgctgatttaccaagcggagtgcaaattgtgtggtgagcatgtgggagatgcctcctggggctggggtgtgtagtggggagtgggcattatacagaaagggaattcatggggcacgaaaggcctactttttgccaggcacctgtcaaataggaaggcagatatttctatgaatacaagtctgtctgtctgtgcatggggtgcaagggtgaagacagtagcaaatggctcatgatttccctttgccatggctgtgtcaatctggagttcagagctctcctaatcagttccgagtggttggctctggtcagggaccgcagcctgacctcatggtggggacacaacaccccccaacaaagttctgttctccagactcttagaaaacctctggggaaatgtactcagggaaatgttctgaggacttcattatcagtgctgcctggctgggaaaagatgtaatctctggtaagagacccttggcaggagtgaaagccctttatcttcagggctttgctctgggcaggatctccccctccccaccatgagccatgcaggtgggcctgtcctcaggtaaacacttgccaacagtcacagcctctcaggcactgcgcgcccctcatggcttcctttctttcactgtcttctcagattcaccagctacaagtcggtttcttgttgcatatcatgcttctgacctttgctgcgcttttgagcaaaacggtgacttgtcagaaatgttttgacaaatgattaatgttttgacccatgttggttcccgcttgatagagctcggtgggtaggagctggggtggtagagccagacagcctgggcaggctcctctggggactctgtgaagcacatggtgataacagtgctcgccttgggcactgttgttgctgcaggaattaaatgagcttcaccaaattacaggacctttactgcctgtaaattacttagcacatagtaaaagctcattaattattagctaaaataaagtgataaaaatctatcattaaattgtcagcacagccctgcagaggcaaccttttaagtattgttatccttcgcagatgaagacacaaggttcacagaaactgactaattggcctaagataacttacagtacaaaagccaggatttcaatctagctttttgagactagagcctgagtgaactgtttctccaaagccaaggcttctcaaactattggtggtgaagaaccaaattttttttcccaattcctctcacatcagtagttacgtaaaatacaataaaaatggggccaggtgcggtggctcacgcctgtaatcccagcactttgggaggccgaggcgggtggatcatgaggtcaggagatcgagaccatcctggctaacacggtgaaaccccatctctactaaaaacacaaaaacaaaattagccaggcatggtggcgggcacctgtagtcccagctactggggaggctgaggcgggagaatggagtgaaccctggaggcagagcttgcagtgagccgagatctcaccactgcactccagcctgggcgacagagggagactctgtctccaaaaaaataaataaataaataaaaaataaaaaataaaataaacaaataaataaaaaagcatggattccagaatcatgaaatgagaaaaaggacatttgaaatacaagccccattttaaaaagtattgatctaacaggcataaaattactctttaaaattactgtaaaagtcacttacactccatttctgtacttttctcatcttgcatcttgaaaagctttctcagcctagcacttctctgcagatctcactttcagtagcactgttctcagcgacctgtttctcaccacttgcctgagaattaattacctggggtgcttattaaatgcagatttccaacttccccccaatattctcccaacctcccagactacttgaatcagaatgattgagacagaattcaggaacccgcattttaacaagtgattttaataatttgggtgtgctctaagtctgagaatcactgtgctcctcagtgttgcctcctctctacagataacagataagagggtaaatagtgaagtgagtgcagtgttttattccggccccccttcttgccccgtcttcttttctcaaaaaaaattttcaaaggcttcctttctgtagaagctcactgacagaaccgactttccggactcagtgcacttcaacaaacaggtattgagctcaaactgcagggggctgggtaggtggagagctgaccgcaagatgctcacaagcagtagagggtgagtataggtagagaaagggcaggtctagggcatttctgtgcataaagtggggcagaagagaaggagccagcaacgagaccagtaaggcattaccggtaaggcagagaaaagccaggagaagtataggttttggaagctaggtgaagaatatgcatcaaggaagaggaagttatggactgctgatgagctgaataagatgaagactgaacattgaccatttggttagcaatgtggagatcgtggaggtccttgtgactctgacaagatcaggttcatggagatggggaggcctggttggagtgggttcaagtgagagtgggaagatagctattgcaaacaagactatggactgtctttcaaggagttttactgtaaaggaaagagaaataaggcattttaaagaagagaaatgaggtcaagaggtttagggtcagggcagggaagtggagtttatttagaactcatgcaataagtggctcaatatatgacttctctaaagtcatatatcttttagttaattccttgagtaaaacagaaacaattgtctatcgtgacttttttcttcaagctctttaaaactctccccactcccaaactatatcactgtctaagaagaaaggagtttgaaaatcagtcttgttacatagcttaatttgaatacatccaaaaaatgacattgcattattttcatatttgctgaatctattttttggctggagtattttaaagtagatttttaaagtagatttcatctcttactacttcacatgcataggactttttctttatataaccacaatacttttatacacctaacaaaattaacaataatttcttaataccatataataaccaatctatgttccaatatccccatttgtccccaaggtgaatcaaaccaagattcagacaaggtgtacgtattacatattattatatctgcgaagccatttgttttttattcccatttacttgttgatgaaaccagttcagttgtcccataggaagtcctaccttctggatttgtctgataattttcctttggcgctatttgacttgttcttctttcttctgtatttcctaaaaactggaattgtgtatgacagcttgataatatacagattaaacattttgggcaagaatttttcataggtggttagcagggcgtggtggtgcacgcctgtgatcccagctactcgggaggctgaggcaggagaatcgcttgaacctgggaggtggaggttgcggtgaacagagattgtgccactgtgtactccagcctgggtgacaaagcaagaccttgtctctaaaaaaaaaaaaaaaaaaaaaaagaatttttcataggtgcttcatgtcacgtcacatcagaaggcacacactatctagatgtctcactgttaatgatgctaaaagactgatcagggtcaggtcacggctgcttgactcacgagaggtgttttgattttgctttttaagagcagcagcgtgtctatatgttgatgggagtaatctttgagagagggatacttatcaattaaacaaaggggtgaggttttctagaacaactttcttaagtaaacaataatgtgtaggatctagtggacaagtgttggttattgcaagtgttggacatagccagttcatctatagtaatgaggcatatggacataaatgcagataaagggggctctgttagggggtttgaggaagttctaatctggcagcttttgttttctccatgaacaagtagcaaattcatcacaggagagggagattgaaaggaggaagtcaagtagtgggcgagtgccagatgaatagactggacaagtagcatgtgatttctgaaaagcattaaggacctcctggcagttagggatcgcgaacttgaagtgaaatcagtaagcattgttgtacaattttctctagccatgctcagttgcatgtttgctggtgtggagcagaacagagggttggatttaaccaggattgagttttagccaatcatgtgtgatcaaagagggcaaaggactcattttaatgattttgaccatggaatttaagctgtgtaggaagggaagtaagaatatgaggaaagtgaggaacagtgacaggtggaaggattaaccacagaagcttgttggagttggggtactagttggaataggctgcatatagacaggagtggtaattggagatgggatgcctgaactcaagattatggaaggtattgttgggaaataacaagatcagagatacaactctgggagtgagtggccgtggtcacaatcactggggtagaggagatcaaaggactgtgaggccagaggactagaatatcctaaaagtggatattaatatcacaaggagttatgatagaaacagtgttggagctaaaatattcaggcaacgaagcacggtattttgggtgggggagaagatggctgcagccaggtaagtggggtcataggtagcgctgtctgcacagggtctctgtgaggatgacatgcattgatgcatgtgatgctcttcactttgagcctgacaaatagcatgtgttagaggttcagtctaacacttgctagaggcaacaagtgttagaggttcaccatctgagtctatgtggctccagtgagtagagcttaaaacactgggtttatagttattcattttttattttattttttagacagagtcttgctctgttgtccaggctggagtgcagtggtgcaatctcagctcacttcaacctccgcctcccggattcaagcgatcctcctgcctcagcctctcaagtagctgggattacaggcgcccgccaccacacccagctaatttttgtatttttaggaaagatgaggtttcaccgtgttggctaggctggtctcgaactcctaacctcaagtgatctgcccgccttggcctcccaaagtgctgggattacaggtgtgagccaccgtgcccagctgcaacactggatttatttttacagggaagttgattttcattaactttaatatatttctaagaggcagagctactcacacagttgtgtgtggtctggggcggtagtaaattccctgtcattcagtgtatccaacaggcaaaatgaacatttgcaatgatggtgccgtcaaggtgattctggcaactgaaggtgatgggtgggtaggtgggagggagtggctgtagcaattgaaggcagtgggcagtggggagggatggtgtcaggagctagcttcattcttgcattcagacatgactgaacatttcctagttgtggcccaggagctctcaatctggttgggacagatctgcaaacagataaatgtcacatagtttgatgaggggaagaataggcaccatggagttatgctgatcatctctgtgaggccaaggaagcttgagagtcaaggagcacttgagctggtgttggaagctgagtgggcatggccccatgggaacagcacaggaaaccacactttgctgaagaacttcttgtgcagagctgcaaaggcatgaaagagtcttcgacatttagagtgccattctacttaatctgggcaaattatttatcttccctgtctcagtttccctgtttgtaaaaatgggggtagtaatggtatccacagaggaagggatggtgactgttgtaatccctttgagtggattatctttttttttttttgagatggagtctcgctctgttgcccaggctgcagtgcagtggtgtgatctcggctcactgcaacctccacctcccgggttcaagtgattctcctacatcagcctcccgagtaactaagattacagacacacgtcaccacgccccgctagttttgtatttttagtagagacgggttttcaccatgttggtcaggctggtcacgggcttctgacttcaagtcatccacctgcctcagcctcccaaggtgctgggattacaggcatgagccacagtacctggccgagtggattattttacttgattctgtaaatcacactatgaggtaggacttgttattattactatttctattttatagataaagatgtcttaaatcttgggtcttaaggggttgagtaacttgctcaaagtcaggtagctggtgaaaggcagtttgggctcttgtcttgataaatctgattccaaagcttgtattgttcatccctaagctatagtcagtgcttggcacatagctagtgctaaataaatggtagctattattgccaggattgctaaagtttctcacccagagagttgagggttctgttatcacttctacagctggttgaagatcagtagtgctgctatctcatcagcagcagggactatttttggaaagccctcatcacctatgataaatctagatagttgcaccacttttgtttcaattggttgatttttgaaaatcaaaaatggagagtgatttttatcttcttagagggcaaggttttttgagcagatgcagttgatgtaagggaggaagagctgggattgatgtacttttctgttgtctgtgggctgtatcaaacaaaaagtttcatgttctggctgccagctggaggatggcagcaaaccagcattcacaggcaagaggtatcatccaaaagtctggtgactgcccacagtgttttctacagggggctaagaaagagcctcttccatgagtgatgccaggagtaagagctgtgaacccgtcacccatttattcattcaacaaatgcatactgagagcttattaagtgctagacattcatctagtgtctagagatactccctggaaataatagagaagaaggttgacaagattcctatttatgaagcttatatttttagtggaaggagacagactaatcaaatactaaatgaatgcctgcataattacaaacactcatgccacaagggaaattcatgctgtgaaaatgtcagagggataactatcagagaaattttctgactcttccaaggatgctgcccagaaaaccgtccttctttgagctgatgaggagagccccaaatgttttgacacagggcagagtggcacctctcactttttccctggtagtcatacctagggtttgcctgcctgccttcctcctggtcatgaagagctggggttctcccaacctgaattcctagccttcaacagaggattttctcttggttcatggggtgaagtcaagtatgtccatatggcttcctcttagttctgttaatgctagatctcctaggacaggccttgcagccaggttaatattgtgcaccaagttgatacacaaggttgaagtgtattttttagtattgcccccaagagttttgccttaattattcaagtaacataataaaaataataaaggaagttggctaggcgtgggggctcacgcctgtaatcctagcactttgggaggccgaagtgggtagatcacctgaggtcaggagttgaagaccagcctggccaacatggtgaaaccccatctctactaaaaacaagtattagctgggcgtggtggccggtgcctatattacccagctactggggaggctgaggcaggagaatctcatgaacctcgggggtggagcttgcagtgagccaagattgcaccacttctgcctgggccgacagagagagacaccatctcaaaaacaaagaataaaataataaaggaattcaaactgataagaattaatctttcatcagtttatccgtcaatggtattcaagtctcaaccatttacattttttctagacagttggatatacatatcttttaagtcaccatctgagtatacaggtaacattttctgttttgcttttttcattttaagattttaagtattttctcccctattactatataaattcatacacaattatataaattatttcaggtggctataccatgcttttcttatttccttattgctggatgcttagttgttaacagattttcaccttgataaataagctcgacattaaaaatttttatttttggcagtgttattaggaaagtttgtagtgcttaacatctacttcaaaaagttagaaagatctcaaattaacaacctaatattgcacccagaggaactagaaaaaaaatttaccccaaagctggcagaaaaagaaaaaaataactaaaatccagagcaaaactgaacaaaattgagactcaaaaatccatacaaagaatcaacagaaccaaaagttggttctttgaaaggataaacaagtttggtaaaccattagctagattaacaaagaagaaaagagagaagatacaaataatcacaaccagaaatgacaaatatgacattacaactaatcccacagaaatatgaaagatctttggagactattaatacctctgttcacacaaagtagaaaatctagaagaaatggacaaattcctggaaactcacaatctttcaagattgaatcaggaagaaattgaaacctgaacagaccaatatcaagttctgaaattgagtcagtaataaaaaacttaccaccaaaaaaagccctggaccagataaattcacagccaaattctatcagacatacaaaaaagagctggtaccagtcctactgaaattattccaaaaaagtgaggcagacagatccctctctaactcattctatgaagccagcattaccctgataccaaaacctggcaaagacacagtaaaaaaagaaaaccgcaggccaatatccctgatgaaaataaatgcaaaaatcctcaacaaaacactagcataccgaatccagcagcacatcaaaaattatttcactgtgatcaagtaggcttcattcctgggatggaaggttggttctacacagacacattaataaatgtgattcacctcataaacagaattaaaaacaaaagccatatgatcatctcaatagatgcagaaaaagattttgataaaatccaaaatcctttcatcaaaaaagccttcaagaaactaggcatcaaaggcacatacctcaaaataataagaatcatctataacaaatccacagccaatatcatactgaatgggtaaaaactggaagcattctccttgagaactgaaacaagacaaggatgcccactctcaccacttctattcaacatagtattggaagtgctgtccagagcaatcaaacaagaaaaagaaataaaaggcatccaaataggaaaagaagtcaaactgtctctctttgctgacaatatgattctatacctagaaaactataaagacactgccaaaaggcttctggaactaataaacaacttcagcaaagtttcaggatacaaaaccagtgtataaaaattcatggcatttccataaccagtaattttcaagctgagagtcaaatcaacaacacaatctcatttataatagtcgcaacaaaattttaaatacctaggaatacatctaatcaaataagtgaaatatctctccaaggagaactacaaaactttgctgaaagaagtcatggatgacacaaactaatggaaaaacatttcgtgttcatggattaaaagaatcaatatcattaaaacagccacactgcccaaagcaatctgtagattcaacactgttcctatcaaactaccaatgtcatttttcacagaactagaaaaaacctatcctaaaattcatgtgtaaccaaaaaagagtacaaataactaaagcaatcctaagcaaaaagaacaaactcagaggcattccagtacctgacttagaactgcactgtaaggctacagtaaccaaaacagcatggtactggtaccaaaacagacacatagactaatggagcagaatagtgaacccagaaataaagccacatacctataatcatctgatctttaacacagtcaacaaaaataagcaacgggggaaagaactccctattcaataaatgatgctggaataactggctagccatatgcagaagaatgaaactagatcccttccttataccatatacaaaaattaactcaagatcaattaaagatttaaatgtgagacctcaaactataagaatcctggaagaaaacctaggaaacaccattctggacatcaaccttgggaaaggatttatgacaaagtacttaaaagcaactgcaacagaaacaaaaattgacaagtgggatctaattaaactaaagagcttttgtgcagcaaaagaaactatcaacagaataaacagacaacctacagaatggaagaaaatatttgcaagctatgcatctgacaaagatctaatatccagaatctataagaaacttaaacaattgaacaagcaaaaaacaaataacaacattaaaatgtgagcaaaagatatgaacagacaattctcaaaagatgcatataagctgccaacaaacatgaaaaatgctcagtatcactaattattagagaaaagcaaacaaaagcacagtgagataccccctcacgtcagtcagaatggctattattaagtcaaaaaacaccagatgctagggaggctgcagggaaaagggaacacctacacactgttgttgagaatgttaattagttcagccaccatgaaaagcaatttggagatttctcagaaaacttgaaaacagaactactattcaactcagcaatcacattactgggtatatatccaaaaggaaataaatgtttctaccaaaaagagacatgcacttgtgtgtttattgcagcactattcacaatagcaaagaatggaatcagcctaggtgcccatcagtggtggactggataaagaaaatatggtacatatacactgtggaatagtacacagccatgaaaaagaacaaagccatgccctttgcagcaacatggatgcagctggaagccattatcctaagcaaattaataatgcaggaacagaaaaccaaatgccatatgttgtcacttataagtgggaactaaacaatgaatgctgatagacataaagatggcaataataaacactggggactacaagacggggaaggctggggaaagagctaaaaaatgaattattcagtacctgcatggcaggatcaatcataccccaagcctcagcattgtgcaatataccaggtaacaagcctgcatacataccccctgaatctaacatataaattaaaattattttttaaaaaaacccttttcttctttgtgtgcgtattgctttatagaactcatattctttatctcattaatcctctttcatttgtcatcagaactatgtaatgtagagaatcattttacatgtggggaaactggagtatgtaatcttttgaattatttatgaattatttatttattcactcttatttcctagaagtacagtagcctggtccatggtcagaagctcttaattctatggcctgaatacattctagaaaggttacattaatttatatgatcctttgaatatatatcgatttaattataatctgtccagcaatgagtattatcatgtagaaaactgcggacgaatgtaaattctataaactagtttctcagtattctagttgcccctcttgggtttctctcatgattaaccataactttatatgcttgttaattgtgctttttattttgtgattagtctgttcatgttgattacctctttattttgggagacttttattatattaaccctttttatattttgacttttcctttttattgtagttacagtatttttcattgtatagatgttgaaattttcttgcaactgaatgtattaaacttttcctttgctattttcctacatcgcatcaaaagaagaaagagctgacaggtatatatttatatttttagctgttttttgttggtttgtttagagacaggttcactctgtcacctaggctggagtgcagtggcgctcatagctcactgcagcctctaactcctgggctcaaatgatcctccctcctcaacctcctgagtaactgggactacaggcatgcacgcctggcttatttttagctttttaaaattacatttttatacttttgtacattttttcaaagtcaaagaataatggatgtacattttagaaattttggaatatatgtaaaattataaaagatgaaaacatctattattaccattctgggtgtacttttttctagtactttttcctagtactttttcacgtttttttaaatgtattttttttctgaatttggatagtgtttaccgttttataacgtattttttcagttacaattatactgattgaactttcacatattattaaatattctttgaaaataaataattttttgaaaatctgtatgaagtttatttcaggatggacctaattactccctgtttacctccaagccagcaattaaacaacctgttcttcccaggttggtccatggtggccgctttagctttctagcccattcttatctggtgtcaagtctatttctttttttttttttttttttttcttttgagacagagtctctctctgttgcccaggctggagtgcagtggcgtgatctcggctcactgcaacctccgcctcccgggttcaagcaattctcctgcctcagcctcccttgtagctgggactaccggtgtgcgccatcatgcctggctaattttttttttgtattttagtagagatggagtttcaccgtgttagccaagatggtcttgatctcctgtcctcatgatcctgatccgcctgcctcggcctcccaaagtgctgggattacaggtgtgagccaccacacccggctagtgtcaagtctatttctaggctatctgtgctgttcacagatccagagcattgcacctttaataggcttttctctctctctttttcctgagccctggaggcttcctggattgagacctagcctaggtctgcataagcacctttccatcttgttaatgtttaacactgcctctgctggaaaacagctctcacctcctctctttctgtctcttattttttgcctttgcagatgagttttgatcatcctgagaaaaatgggccttggcctgcagacccaataaaccttccctcccatggataatagtgctaattcctgaggacctgaagggcctgccgcccctgggggattagccagaagcaggtaaggaacacacagaggcatgggctagcaaaggggtacattcctgagtaaaagctggtgtggcagatgtcctggcagggaatctcaggatctcagtatctggctccagctttgctgttttctttttgtatgtattttttagtcctctttaactgctgattcaatgtgggtttcattggggggtgtagagaaatggcttgtccatttctattaactatataagatttaagttattctgtatttcagtcaaccattctgagtacctactacctgccacgaatgcaactggtactgagtatgtcatgacgggtgggtcgggacaggatttccttgctttgagcattgatttctgccggttcagtgttggccagttctttgaaggtgatgatgcaagtcgctgtgttcttcctctagaagcctcgtgatgattgtaaagattctctgatacaattgcatcagttcaataatctttcattgagtatccgctctggtccaggcactgtgctgggtactagggtttcagaaaggataccaggaggagttttccttgagcagcaaagtcaggcatgaaaagcaagcattacaaagcactggctggcagcaaaggggagcagggatagtgcggaaggggaggtggcctccactgaccttcagaagcagaaaggtgatgctgtcagagctggcaggcacatggacaaggagaaagagtgcagcagtgcagacacctggaggcttaacacagtctggtgtaattggaaaattcaaagcttagtgtgtttttccaaaacatttgtagagaaaagtttgctactcttttccctcggttgcgccatttagagaaagtttcttcagcctctgccttcttcagacaatttgagagatgagaaagggtcttgcagttataagtgcctgtgaccagaaactccagccacctggtggacttggagcctcaaccaagggtggtgtcaagggaccacatgagcccttatgtgagatttcagatgagtgccctgaggccatgacagagcacaggctgtgaaggctgaggctgtctgatggttgcaagactgtcgctagacccagctgtttggaggaactcttctttcctgggaaaccacaccttggagagtaggtactgggcagctgctgcctgagcctccactcctgtgacagtgaatcaggcccttcctgccatcttgtttcattcagacatgtgaaagtcaggttctaagtccactatttccaaatcactcatgcaactttgaaaattatttgtatttccaaacctcactatactcagctataaatggagctcataaaatctgctgtgcttatctcacgggagtataataggtctgtaaaaccttaccaatacggaaagtacctgagtgttaccactcagtgcacagcagggatggcaggtgcagcactgatggtgaaggtggcttgtctgcgactgtctgacagacgaagttgcctctctagtgaccttgagtccgacttgatcacactgacttctcactgtcccttatcacagatgcatgtccttgggtggaaagatgatgaacttttagagtcagacagacctgggctggaattctggttctagaactgacttgctgttgacattggagaaaccctataaccttgctaagtctcagttttttccatttcctaaaataggattgtcaatatctctatcatagtgttgtagtaaaggttcaatgagatattgcaaggaaagtgactaccacgtagtaggccctccttaaatgctactttccttcttttctctagttcttcttcagttgtcatatggtcatgtgattacctgtgttgggtgtctgcggaaattgaattccttagtttctggtaatacaacaagcttccacccttcacttcatgatcttctatctgaattcttcttccactgtgtacatttaatcatttccacaacttcagcagcccaagataggagcccatcgttcccagagtcactggttcctgaggtctgggatggtggaagcactgctttggttggtactgccaatggattccaggaatgagctggatgtcagttcatggagaattcccagggaagagcctggagctcagggctgctgagtcatggctgtggcttcacactgctgtcttcactacccgtatcacctccacatggcccccaggctgagctgctgctctcctgtctctgttcagaataccttctgtgcctttttgcttatctagttcaaatccaatgaataccatgctcttgttttgccctcccaacactctgcaaatcacatagggcagagataattattctgaaaaactcaggggcagaaatattaagtgacctgcccaaggtcaccaagaatggggataagaacccaggttttgtgaacacccagtccagtactcctactaccttttcctgatatccttaggagcgggatccatgggaagggacctcagacccctagtgggttagcaaaaccccggaggtgattgctttgatttattattgtaaataaacccagtgattggggaaagaatgtaatgttttccaaaagatacagacattatttgagttcaaagtgcttccagtttccattcagttacacaataaattctgagaaaacaaagtaggtgtttactcagaaataaagagactattcagtctctatttgctcagtgaaatctattttccagagcttcttgcagttctgtgcatgttgtactggaaaggacatgggttatggaatcaaatccacttcgatttgaacctcagtgcaaccatttcctcagctctgtgagcttgggcacttcccttgacttcttagagcctcaggttgctaatccataaaatggagattataacacctttgaagtgaaccctgtacaggttaggagatgcccttcgtattagactatgctatgcgtggtgcccccagagttgtgtctcatggtggccctggttatggtgaagttaagtgaaataacatctagcgtgcttaatgaatttttgtttccatttccttagttggctacatgtctgctatcttacccagaattcctagcctctatcatgaggtgagtcagcttcctgtctcagcagtgctcttcttgcagggcactgcacaaaactgtggtggagataaccctcgatcttctcatgcaggagtccagcatcgcagcccttagagagatacatcagaaatctatggcatcatctataacgagaagtctttttctggccattttgaaggggtgttgggccacttactattttaggaagtttaggtctggtgatgtaaaacagtcagcctgcttttttttattctatttttttttcaagcatgcatggcttcatttaacaaatgttacaaggccctaggaactgagtgatttgcaagatgtggtttctgacttcaagaaactcagagtgcagtcagagaggtagaccaaggcaaccagaaactaatattcagcatagaaaaagtaatgatgggaggacatataaagtgttcatggctcaagaggaagaagggagtggaagagtggaagaggaagagggactgctgtccacgttcaaagcccaaattgagtctgacttttgtcgagaattgcttaacaggctgcagaggtggccaggaggtagaccagggctggaattcaagtcacctcatttcaaatctattgctcagtccatcgctccgcctcatgccacattgggtttttctttacatcatttgtttttccttgtctcactttttttaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcggtatgttctggggttgttctgtgaatggcagtgcttattgggactggctgggcatattgatggtatgggagacaagtggcccaagtgtggctcagcggaccagtggagtgggcccagggcagtgtttttttcagagtcacaagtgacacagagggagttgaacagatggcgctctaggcccccgcatcttttatcaattagaagagcttcattattgtttcctaatatttttagttgatatataataattagatatatttatggggatattttgatacgtgtattcaatgtgtaatgatccaatcagggtaattagaatatctatcaccttgaacatttattgtttctttgtgttgggaacagaatagttttattttcatctgttttaaatattggaattgtgtagaagatttcatttgaaaaagagagttccgctgctaccaataatcaaaagcctacaattgacctttgaaaagacttgaagcatagatctgcacatcatttccaggttctgaaattctgttgtttttcctgattagtggaggactctattggcctcaacaacctgggtaattttcagcttttctctttgaaaagatttaattgggtcagtaattcttaactgggggctatggaccaacttcagagggtcatgaatccctgcaattgcgtgcaaaactgtctgtggattaggtgtgtagaatgtatgtgtatgcgtataagtgtgtccgtgcatttttccaggaagggagtttgtagactgcagtttattctctaagggatctgtgacccaaaaaagtttcagagtcactggtcacaacatattaatttgcttttcttgaaaccctttgtagtgaatcaagatagaaagtctgtctatatttgtaaacctgtgtaacagagagccttatttctcttatgctgaatgtgttttccattatttgaaatgaatcagctaaagaaagcaaagcacaggaagctttgctcctctgtcagcctggaggtactggagcaggtgaggtcatacgtctccttttttatttccttcatttgactgccaggaaaaatggtctgaaacccagcacaggctctcaaagaaaagtaggcccaaactggattctctagagcagaaagaaatggtgagatcacagtttctacctccccaaataggcagctgccccgctggccggccccacctcaacttctgcttttgtatttttggtttttcttggactttgttttcaagaaactaaatgtgattggtttttgttcatccataatggagctaagtttctttcttctccatttttgctgcttatgtagcaaatgtttgggatatcctaggtattagctgatccttcttcttcatgtcaagttaatattgcgtgcctggctgaaattgtactgaagtttgagacagggcctgatagctctgttaattagaactacagctttaattttatgcactccttaaagatttggggtgatttaagtaaacattaatacaaataatatttttctatagattgcagtttcaacttcaaaataaggatttccacagaaggactttgatcctgagatgtaatcaaaattgcatgttagacttcgaatgttctgctgttatggggtatatatcctcttggcattttgtctaacaaatattttaagacattcatatattcttttatttattcatggattcatcaacaatacaaaggggaaagggaagggaaaggccctttgttgaagcccgagttgcaggcagcgtgccaggcccatacacttcctcctgcatctggaatttgttgagtctcttcccaactactggatggatcagattatttcaaatggttttcttttacaaataacattgctgacaaggtttttgtgcagataacttaggtaaccactattgacattcaacagggaaatatcctcagaagtgaggctagaagacacgagtaagagacattttatgacttttttttttttgtccatagcaagattttctatcagagagagtgtaataacatactctgcctccagcagtctcacaaaccagccaatggtgggctcagtcattttcaattatttttgatagtttactcatacatgttaagtatcctagatttgctggaattttcatgtcaaacagtagcataattttaaaacactatcatcaatacaagtgatgcttattatgcatctgctgagttcctaacatgccttgctcttttcatcctcccagaagtcctgtgaggttgataagattattggtctcattttgctggagagctaaatgcggaggctcaagtggtcacacaactggctaatagcagactgaggtttgaaagcagagtgcttgcttcaaagaccccactcttggcacctctgctgttgtgcctcataataattgtagcttcataataaaattcggtgtgattattcttttattatgttaaaaattttcttctattcttgtctattagctgtcctagagagaaagagaagggtattctgagttaaggcaaaggcaagaagcaaaggctgcacggggaaaagtgtgtttgggcatcacaaataatcctgtttggacggcatgtgggtccttgtgggtgaagatgggtgaggaacgaggccagaaaggtagctaggcattagctcttagagaacgttgatagtcacaataaggactttaggtttcattctttaagccatggagagccctaggaggtttttgaacaagggagacttctcacttctctatgagtccctgttttgtactctataatgtctccattattagggactattgccacaaccaggtcagaagtgccaggcctgcccaggctgtggtagcagtgatgaagagaaaggaccttacctgagagggctcatgaagtaagaggcagaacttactatctagctggaaatgatcttgagtgagaggcaggagccaggatgtctagcctgggagcaggctgtatcttaccaaggggagcatgcttccagaggaacgcagattccactttggatgttctgagactgaagtgtgtgtggatttccctgggtagatatctatgctgttgagtacttaattctagagaaggatcagatatcgagatagatttacaagtcatttgtatcaaggtgagataatggttataatccagggaagaagaccaattagaaaatctagaaaaagatttacatttaaaggacaaagaaaagaacagggaaaagtcagaagggtcagagaccggctagaggagaactaggtgtgcaccatacaatggaaggcaaagggggatggagtttgagggatgttggctgttggtatcaaagtctgcagaggtgggacatattcttgggcagaataaggactgagaagacacctgtgaactgagtagcttggagaacatgatcagttatatcaggggtcagcaagcttttcttaaaaggccggatagtaaatagttttggctttgagggccatgatgtctgtcacaactactcaactctgctgttgtactgcagaagtaacaatagatagtagtaaatgaacaggcctggctatgttccaacaaaactttatttacaaaatgagggatgcaccagatttgtccttcaagtcatagtgttttgttttgtttttgacggagtcttgctctgttgcccaggctggagtgcagtggcatgatctcggctcactgcaagctccgcctcccaggttcatgccattctcctgcctcagcctcccgagtagctgggactacaggtgcctgccaccacgcctggctaattttttgtatttttagtagagacagggtttcaccgtgttagccaggatggtctcgatctcctgatctcatgatccgcccacctcggcctcccaaagtgctgggattacaggtgtgagccaccgcgcccggccaagtcatagttttttttttttttaactctgatctatagtatgtctgttttcttcaaccggactcagaatgtaattttccataaatggttgtaggatgtattaggctaacttgaaaatataaaagcgtttggtgataaattgtgataaaatttctttcataataatttctagctatttagagttaactacacctagaggcagtggattttgatgtatttatgaatttactaacttgagctgattctgttgaattttctaagcgtgtgattgtataatctgaatacagtgatgcatttattttttcttctcctaatttgcctctttttctgagctctaattctaagttacagagaggtggtagtttcttttttctgcagcctttccccctcgctaggcttgtttgctgggatctcagtagttgtggatttctcttggtgatttcttagaggcctatttgagtttgaaagttcaactttcaattagcagggaggtttgacaaacaggatttttttctctttaagtacccaagtcagtttaaagttttctttttaaaaatttgatatataataattgtacatatttatggggtacatgtgatattttggtacatgcatacaatgcgcaatgatcagattgggtaattagaatatccatctcctcaaaaaagttttctcctttgattggcttttttcttttcctttcttttttttttttttgagacagagtcttgctctgttgcccaggctggagtgcagtggcgtgatcttggctcactgcaagctccacctcctgggttcacaccattctcctacctcagcctcccgagtagctgggattacaggcgcctgccaccatactcggctaatttttttgtatttttagtagagacgaggtttcactgtgttagccaggatggtctcgatctcctgacctcgtgatctgcccaccttggcctcccaaagtgctgggattacaggtgtgagccaccgtgcccagcctgattggcttttttcttagaatcacgtccaaacttcatacctgggcccccatgtccgtgtatgatctggttcctgccaacctctgtaactgtatctttgatttttcttcccctcactccttgtctacagtcaagtccctgccctcattgtggtcctgacacttgctgcatcctctgactggtggacttctctgaacccttcccaaggctggccatcctttgggtctcagctccaaggcattccctgaatcatcactctatgaaggaaattccctcagtgtctctggcacacagctcagcttgttagtgtcacagtgtttgtcacaatccgaaattatcttatatgtaggttgttgtccgtctttactgtctatgtccgtgcagtagaatgtaatatctctgagggcatggaccttgtctttgttgctcacaggcgtcgtctcccgtgtctaaaactgtgcctggcatagagtaggtgctcaatcagtatttgttgactgaacaaaacaattctcctttcttatggtcaacatcaagcatctgttctaacctaagccttctgtgctggatgttctccagtggcacctccaaatcccactctcacccttttccatctggctctgtccctgagaaattgaatttttttttttttttttttttttttttttttgagaatgagtcttgttctgttgcccaggctggagtgcagtggcacaatctcggctcacgctaacccccgcctcctgggttcaagcgattctcctgcctcagcctccagagtagctaggattacaggtgcgtgccaccacgcccagctaatttttgtatatttagtagagatggggtttcaccatgttggtcaggctgatgtcgaactcctgacttcaggtgatccacccgcctcggcctcccaaagtactgggattacaggcgtgagctactgcgcccagctgagaaattaaaattttgaactgcgttaattggcatttctcactctctggattttctctgggactggccaggagaagcagtggcattaaagctgagaagaagactaaggtcagggcacctattccgccatgtttcgccttgcagagtaaactcaagctgtatctttctcttgactgaaggtctcagatcctgccaggaggccgtcccagtcttggtcctgctctgtcccttttcccttcagttctatgagatccaagggaaggggcagaaccaggttgggatattgactccctcaggctccttcttgcccggaggttggcaatagctgtgttcctctcctaaaggcaacagctcccgacaggtgtccctcctcagctcagggtctccgctcatcaggccacagtagacctggggtggtaatgacaccctgcagtcatcaaccctggggctttagcctattccgtgttgatttctttaaactctaccccaacttggtaagtagtccttttatgaatctctcaattactccattggagcttctcatctcttttctactgggattctcaccaataatttattcatctgtgaaatggaaaagttgactaactgaagtttctgatggatctgtgtttctcatgcaattactactaatccctttcgaaccagtgactgattctgacaaaatgtgttgtaattctgagttgtgtaaagatatacctcctgccctatgtgcacttcagtgtacctgccctgtaagatgataacagtttggactgtgcccttctcagataattttcaaaccattttgatgaaattttgccctaggattgaggatagggttgtgttgttttcatgaatgatgtttctgtgttcctgaggtttagtacatacattggaactgaaataaagagagaggctttcatccttaattctgtggatatcctctttctaaatcatcttgtgttcagtcaaatgccctcacttccccaaatcctgtgtggataaagaatgatccaaaacaaacctgaataggacaatagaggattcagctgacccccagatcccgtgtagatttcagtggtgagccccaaacttgcttgaccgagtaagattgaaagaagttctcataggatcacaggatttggatggctccttaaagtcttcagttccctccttcatcagataggtcaacgtggggtagagaaacttttccaagtcttccaaacactgcttaaacagttgcaaagacaaggagctagcccaggaagcttttaggtttttcaagatggcctgtttgattttgactggatttagtacattgtttctgacaatggcttacaaagaaagagagagagagagagagagagagagagggagggagggaaggaaggagggagggaaggaaggaaggaaaagaaggaaggaaggaaggaaaagagagagaggaaggaagttagtttagctctctgacctcctcttccatttctgccacaccagttctgtgactcttccctgggcctcaggttcctaaatggaacgcctgggggttgtcttggatgccatagttaaatcctgtccatttgctgagcactgcatgcttttcaaagtgcaatggggtcctttgcacttgtgggatacactgaacatatggtagtgttttcatttttctgacagagatagaaatataatctactggtgataccaagagaatatctggtttgctgctttgataactggagtagctactccactgtaagtagcacactggctttgttcacttttctgtgtgcccaggcacaagcgaatgtctttgaatgggtttcaggaatgccacagtatggcccccttcagcccttacagtggctggcagacaggtggtcatctctgcctaggagctttacctgagcaccacacaaatactgccatttcgccctgtggatcatgatggggtaaagatggggaagcattattcccttgccccctcccccgcctctcgtctttctctttttctgcatattgccagtgctcatcacctcttttctgtttctttgtggtttatagatgatcatgacgcagtcctgaggtttaatggggcacccacagccaacttccaacaagatgtgggcacaaaaactaccattcgcctgatgaactctcaggtaaaatttcttctgtgcagctatggagtaagagaaggaccacagtgtgggctctaatgtggaatgtatctactgggagcatatctaggctgccaattaagtctcttgatcttcctgagttcctgattcctcactggagaagaagacaatgattccatgacccaacctgatgatgtgtttatttaaagaaaaaccctttagtattagtgtctgctaatggaggtgtctggtacccaggaaagtagagttgagctgtccttgctgctgcaaggtcatacctggaggtttacatgagggacagcagagcgcagaacatccaggggagagtggggagtgttgtgaaaagtgaatgaaacaatacacaggagagcactttatgaaccgtaaaatgctatacaactactataagacagtgtcaccatgtaattatgtgtaatatggcactagaattcatgtactatttcataaattcccctggataattaggttcccggagtattttcaggtagcacatgccgatttctcaatactaagggagacttgagaaatattcttgccacagggttctgttagtatattttattagtgggaaaaactgtattacacatatatatgaaaatatcaaaaattgcacaatagggctgcaacctgcccatctcacaaccaccaacatttgcctttttctgaataaacatatgtgctctgggggtttttatgtcagtatttagtctgcatacttccctaggagtcctgggcatggggtggatcctggaacagatcagaaatgccttttcagcagtgtctgtggaatgtgtgtttctttccttctctactagggctccacttccctatatctgtctcttcacttccttactttcaggaactcaccagctaggcagaagctgcttcctgcatagcccactttctatttgaagcccacaaccttaagaaacttttttttaaaattatactttaagttctagggtacatgtgcacaatgtgcagatttgttacatagatatacatgtgccatgttggtttgctgcacccatcaactcgtcatttacattaggtatttctcctaatgctatccctccccttgcccccaaccccacaacaggccccagggtgtgatgttccctgccctgtatccaagtgttctcattgttcaactcccacctgtgagtgagaacatgcggtgtttggttttctgtccttgtgatagtttgctcagcatgatggtttccagcttcatccatgtccccacaaaggacatgaactcatccttttttatggctgcatagtattccatggtgtatacatgccacattttcttaatccagtctatcattgatggacctttgggttggttccaagtctttgctattgtgaatactgccacaataagcatacgtgtgcatgtgtctttatagcagcatgatttataatcctttgggtatatacccagtaatgggatggctgagtcaaatggtatttctagttctagatccttgaggaattgccatactgtcttccacaatggttgaactagtttacactcccacccacagtgtaaaagcattcctgtttctccacatcctctccagcatctgttgtttcctgactttttaatgatcgccattctaactggtgtgagatggtatctcattatggttttgatttgcatttctctgatgaccagtgatgatgagcattttttcatgtgcctgttggctgcataaatgtcttcttttgagaagtgtttgtttatatcttttgcccactttttgatggggttgtttgtttttttcttgtaaatttgtttacattctttgtggattctggatattagccctttgtcagatggataggttacaaaaattttctcccattctttaggttggctgttcactctgatggtcgtttcttttgctgtgcagaagctctttagtttaattagatcccatttgtctattttggcttttgttgccattgcttttggtgttttagtcatgaagtccttgcccatgcctatgtcctgaatggtattgtttaggttttcttccagggtttttatggttttaggtctaacatttaagtctttaatccaccttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgaggcctctgttctgttctattcgtctatatatctgttttggtaccagtaccatgctgtttcggttactgtagccttatagtatagtttgaagtcaagtagcatgatgcctccagctttgttcttttggattaggattgtcttggcaatgcaggctcttttttggttgcatatgaactttaaagtagttttttccaattctgtgaagaatgtcattggtagcttgatggggatggcattgaatctataaattaccttgggcagtatggccctttccacagtattgattcttcctaaccatgagcatggaatgttcttccatttgtttgtgtcctcttttattttgttgagcagtggtttgtagttcttgttgaagaggaccttcacatcccttgtaagttggatgcctaggtattttattctctttgtagcaattgtgaatgagagttcactcatgatttggctctctgtttgtctgttattggtgtataggaatgcttgtgatgtttgcacattgattttgtatcctgagactttgctgaagttgcttatcagcttgaggagattttgagctgagatgatgggtttttctaaatatacaatcatgtcatctgcaaacagggacagttcgacttcctcttttcctaattgaataccctttatttctttctcttgcctgattgccctggccagaacttccaacactatgttgaataggagtggtaagagagggcatccctgtcttgtgctagttttcaaagggaatgcttcagtttttgcccattcagtatgatattggctgtgggtttgtcataaatagcttttattattttgagatacattccatcaatacctagttcattgagagtttttagcatgaagggctgttgtattttgttgaaggtcttttctgcatctattgagataatcatgtggtttttgtcattgttctgtttatgtgatggattatgtttactgatttgcatatgttgaaccagccttgcattccagggatgaagctgacttaatcgtggtggataagctttttgatgcactgctggatttggtttgccagtattttattgaggatttttgcatcgatgttcatcagggatattggcctaaaattctctttttttgttttgtctctgctagactttggtatcaggatgatacttgcctcataaaatgaattagggaggataccctctttttgtattgattggaatagtttcagaaggattgatacaaagaggtttgtacctctgctagaatttggctgtgaatccgtctggtcctggactttttttggttggttaggctattagttattgcctcaatttcagagcctgttattggtctattcagagattcaacttcttcctggtttagtcttgggagggtgtatgtgtccaggaatttatccatttcttctagattttctagtttatttgcatagaggtgtttatagtattctctgatggtagtttgtatttctgtgggatcagtggtgatatcccaatttatcgttttttattgcgtctatttgattcttctctcttttcttctttattagtcttgctagcggtttatcaattttgttgatcttttcaaaaaaaaaaacagctcctggattcattgatttttttgaagagttttttgtgtctctatctccttcagttctgctctgatcttagttatttcttgccttctgctagcttttgaatttgtttactcttgcttctctagttcttttaattgtgatgttagggtgttgattttagatcttttctgctttctcttgtgggcatttagtgctataaatttccctctacacatggctttaaatgtgtcccagacattctggtatgttgtgtctttgttctcgttggtttcaaagaacatctttatttctgccttcatttcgttatgtccccagtagtcattcaggagcaggttgttcagtttccatgtagttgtgcagttttgagtgagtttcttaatcccgagttctaatttgattgcactgtggtctgagagacagtttgttatgatttctcttcttttatgtttgctgaggagtgctttacttccaactatgtggtcagttttacaataagtgcgatgtggtgctgagacaaatgtatattctgttgatttggggtggagagttctgtagatgtctattaggtctgcttggtgcagagctgagttcaagtcctggatatccttgttaagtttctgtctcgttgatccgtctaatattgacagtggggtgttgaagtctcctattattattgtgtgggagtctaagtctctttgtaggtctctgaggacttgctttatgaatctggatgctcctgtattgggtgcatatttatttaggatagttagctcttcttgttcaatcgatccctttaccattatgtaatggccttctttatctcttttgatctttgttggtttaaagtctgttttatcagagactaggattgcaacccctgctttttttttttttgctttccatttgcttggtagatcttcctccatccctttattttgagcctatgtgtgtctctgcatgtgagatgggtctcctgaatacagcacactgatgggtcttgactctatccaatttgccagcctgtatctttcaactggggcatttagcccatttacatttaaggttaatattatgtgtgcatttgatcctgtcattatgatgttagctggctattttgcccattagctgatgtagtttattcctagcattgatggtttttacaatgtagcatgtttttgcagtggctggtaccagttattcctttccatgtttagtgcttccttcaggagctcttgtaaggcaggcctggtggtgacaaaatctctcagcatttgcttgtctgtaaaggattttatttctccttcacatatgaaggttagtttggctggatatgaaattctgggttgaaaattcttttctttaagaaagttgaatcttggcccctactctcttctggcttgtagagtttctgctgagagatctgctgttagtctgatgggcttccctttgtgggtaacctgatgtttctctctggctgcccttaatattttttccttcatttcaaccttggtgaatctgacaattatgtgtcttggggttgctcttctcgaggagtatctttgtggtgttctctgtatttcctgaatttgaatgttggcctgccttactaggttggggaagttctcctgggtaatatcctgaagagtgttttccaacttggatccattttccctgtcactttcaggtacaccaatgaaacgtagatttggtcttttcacatagtcccatatttcttggaggctttgtttgtttctttttactcttttttctctaaacttctctttttgttttatttcattgatttgatcttcaatcactgataccctttcttccacttgatcgcattggctattgaagcttgtgcatgcatctcgtagttcttaagccatggttttcagctccatcaggtcatttaaggtcttctctatactgtttattctagttagccattcatctaatcttttttcaaggtatttagcttccttgccatgggtttgaacatcctcctttagcttggagaagtttgttattactgaccttctgaagcctacttctgtcagctcgtgaaagtcattctccgtccagctttgttctgttgctggcgaggagctgcgatcctttggaggcaaagaggcactctggtttttagaattttcagcttttctgctctggtttctccccatctttgtagttttatctacctttggtttttgatgatggttttggtgtggatgtcctttctggtgatgttgatgctattcctttctgtttgttagttttccttctaacagtcaggtccctcagctgcaggtctgttggagtttgctggaggtccactccagaccctgtttgcctgggtatcaccagcagaggctgcagaacagcaaatattgctgcctcattcttcctctggaagctttgtcccagtggggcaactgcctgtatgaggtgtcagtcggcccctactgggaggtgcctcccagttaggctacacggggctcagggacccacttgaagaggcaatctgtccgttctccgagttcaaacaccgtgctgggagaaccactgctctcttcagagctgtcagacagggacgtttaagtctgcagaagtttctgctgccttttattcagctatgccctgcccccagaggtggagtctacagaggcagcaggcctggctcacctgcagtgggctccacctacttcgagcttccagggctgctttgtttacctactcaagcctcagcaatggcagacgcccctcccccaccaggctgctgtcttgcaggtcgatctcagactgctgcactagcagtgagcaaggctccgtggtcctgggacctgctgagccaggcacaggatataatctcctggtgtgccattttttaagacagttggaaaagcgcagtatttgggcgggagtgtcccattttttcaggtaccgtctgtcacgacttcccttggctaggaaagggaagtcccctgaccccttgcgcttcctgggtgaggtgatgccccaccctgctttggctcgtcctccatgggttgcacccactgtccaaccagtcccaatgatatgaaccaggtacgtcagttggaaaagcagaaatcacccgtcttgtttgtcgatcgcgctgggagctgcagaccagagctgttcctatttgaccatcataagaatatttttataacgggatagaaattgaggaacttaacttatttgtaagtggtcaccatcttgtttttttgttcttcctctaataccttttaatttttttttaagaaaatcactttctatcaccgtcacatcttctagtcacctctaggtgcttccaatgcctgtttgttgttcaaatttatattttggcttttggtattacttttattattattattattattattatttgagatggagtttcgctctgtcacccaggctggagtgcagtggtgtgatcttggcttactgcaacctccttttcctgggttcaagcgatcctcttgcctcagcctcctgagtagctgggattacaggcatgcaccaccatacccagctaatttttgtatctttagtagagatggggtttcaccatgttggcccaactggtcttgaactcctgacctcaagtaaccacccaccttggcctcctgaagtgttagtattacaggcgtgagccatcgtgcctggcctacttttattgttactagaagagataggattgaaaggaatggactggctagcaagaagctctctggggcaaatgacagttgagctagactttgaaagatgggcaggacttggggaaatagcaatagccgggcactccagaaagtggaattggcaagacagaggagaacaggaaatgagggaggcgttacaccactccaagagtagtgtaatgatcactcccctattagtgatcaggctggagtgcagtggcgtgatcataggaaatgagggagacattcagatacccctggctaagttggaggtggaggtgtagaagaattggctggccttgccccgtagagagagatgaggctggaccttcatggctgcttgtgctctggcaagtgtggaaattcagacagagggttaggaccagctttgtccctttcccttctcatgcctagtcaggaaccctggagctggagagcactttagggagcactaaaacctcatctccacttctatataagatgctacctaaatatccaggagagatgttcatttactcttaattaattcattcattcaacaaatgtattcagtattgagtagactgtggcagtcagtacataaactctatagttagcctgcttggggttgaaatccagctctgtctcttactagctgaaggatcatcaagttacttctctctaaaaaagggagaataattcccttacagggttgttgtgaggtgtaaataagaaaaatctgtgcaaagcacttagaacaatacctggcacatgtatcaataaacgttaactgcacttactattgatatttgcagacattggtaggggagggtacaattgtgagcaaaacaggctcagcctctgttcttatgatgcaatcaaatagttttacaaataaataaatttgcaaaaaagaactagagaagagagtggtcaaggtactaggagagccctgaaaggggagatttgagctattcaaggaggtcagaatccctaagtaggtggtacttggctgtgtagaaggaatgtgtggatgttgaaaagggtgggataagagcttttcaggaagaggcaacagcatgggtacagttttgtgtggaaggaaatgggggactggaaggactcaggaagaggtgagtatatgtgggactatgtggtgagagacaaggctgaaagcaagaaggagtcaagccatggtgctgcaccgaggcatcttcttttttcagtgggggtaggggggttggcctgtcacccgggctggagtgcagtggcgcgatctcagctcactgcaaacaccacctcctgggttcaagcgattcccctgcctcagcctcccgagtagctgggattacaggcgcccacaaccatgcccgactaatttttgtatttttagcagagacgaggtttcactgtgttggccaggttagtctcaaactcctgacctcaggtgatccacctgcctcagcctcccaaagtgctgggattacaggcgtgagccacctcacccagcagggtgagacatcttctttatggcatgatcagatttgcattttgtaaccatcactggctttcatctgagcagaggggctgcagtagatgaagacacatagttaggaaggtcttacaagtagtctgggttagatacgctgatagcttgcacaagagtaggggtgaaggtgaatgtgagaaaagaatgtatttaagggctgcttgcgatttgcagtcaacaggttttaatgtcgcattagatgtgagaagtaaagggagaggggccaaaggtgcagctcagtttctttcttgtgtaacttggcagctagaagttgaaattagaagtcagccccttatccatggtttcactctctgcagtttcatttatttgtggtcagctgcaggctggaaatactaaatgaaaaattccagaaataagcaattcagaagttttaaatgacacgttgttctgagtagtgggatgaaatcttacacatcttactttgtcccttcctcatcacaggaagaaggatgggtacagtacaataaaatattgaataaataagcaaattcaataaagtagcaggatccgaagtcaacacacaaaaaatattcattttttctattatgtgcaataacaatgaatgatctagaaaggaaatttaaaaaacaattccatttacaatagaatagcataaaaaagcataaaatacttaggaatgaatttaaccaaggagttgaaagacttatacaatgaaaactacaaaatagttctgaaagaaattaaaggagacacaaaaacctggaagacatcccatgttcacagattgaaaaaagtattgttaagatgtcaataataccgaatatgatatgcagatttaatgcaatcgttgtgaaaatccaaaagatatttctttttttgcagaaatagaaaaagctatcctaaaatttatatgaaacctcaagggaccccgattaaccaaacaatcctgaaaaataagaataaagctggagttctctcacttcttgatttcaaaaaatacatatgttacaataatcgagagagtgaggtacaaagacaaacatataaaccattggaatagaataaaagtccagaaataaagtcttgtatatatgtgtaaatgatttttgatgagtgtgtcaggatcgttcaatgaggaaaagacagtctttttaagaaatgatactgggaaaactggctatccacatgcaaaagaataaagttggacccttacctaacaccaaaaataaaaattaactcaaaatggatctatgacctaaatgtagaccaaaaactataaaactcttagaagacaacatagggcaaaaactttatgacatcagatttggcaatgatttcgtcattattacaccaaaggcatacatacgtaacaaaggaaaaaatatacaagttggactttatgaaaattaaaaataattgtatatcaaaagatactctcaacagagtaaaaagacaccacacataataggagaaaatatttgcaagtcatctatctgataagggattaatgtacagaatatatagaacactcttcaaacaacaataaaaaaaatcaaattacccaatttaaaaataggcaaaggacttgaatggacgtttctccaagatatacaaatggttagtaagcacatgaaaagagactcaactcttttttgctagggaaatgcaacccaagaatacaacacagcaccacctcacccccattagggtggcttctatgatcagaaatcggaatccgtgggcactgttgatgggaatggaaaatggtcagccactgtggaaaacagtacggcagtgcctcaaaaacttaaaaatggaattaccgtgtaatctaataatcttatttattggcgtatatgtacagaaattgaaagaagggtcttgaagagatattcatacccccatattcagactactcttattcacaatagctggactgcagaaggaacccaagtgtctgttgatgttgaatggatacacaaaagctggtttatacatacaataaaatattattctaaaaaaggaagaaaataccgagattggctacaacatggatgaaccctgaagacattatgccaagtgaaataagccagtcacacacacacacacacacacacacacacacacacacacacaaaatactatatgaatgtggttgccagggaatgtgaggtgggagggggaatggggagttactgtttaatgagtatagagtttcaattttgcaagactgaaaaagttttggagatggtttgtggtgatagttgcacaacaatacaaatgtacttaatatcactgaactgtacacttaaaaatggttaagatagtcaatgttatgttatatgtattttaatacaatttttaaattggaaaaaatgtcagtaggggagacagtcacagaagtacaaacactgtatgattccactttatatggaacacctggagtagaaacaaagtagaatgatgtttgccaagggctaggaggagaaaggaatgtggaattgttgtttaatgaatactgtgattcattttgggaagctgaaaaagttctggagatggtggtgatagttacacaacaataggaatgtactaagctgaatacttaaagttgctaaaatggtcaattttatgttatgtatattttaaaagctttcttttaaatcaacagggagaaaccagttgatagagggagaaagtgaatatactaaaaagaggagaaaatgattagttacccacaacatgatggtggtggagccaaagcgtagtggaggatgaaccccagcaggcgggagtcagagggaagaaggtgcgagtggtgtagctggaggcagtcagtattagaaggatgagagggcttctattttctctgcaaagtggcatgcaaggccaagtcagaaggaggctgagggggaaagaggttttagtagagaaggtttgaacaaagagatttataattgtcattgaggtgagtgggaccgtcagtaaacctgatgaatggagtaggatttccaggccatgctgggctactttgaggttgaagagaatgaatttagagagaaaccaatctctgtttgatacatggatggtaggatctggaggtgagcaggcagcagcaaagaggagaggggagaggggaggagccctccctgagcactctcttggactgcggaggctacctactctctgagcacttcttcgtgatgattcagtcttcctcactgtgaagaacgaaaccccagtcctgcaaagatttgaaactgtatttaaggccaaagtaaggttgcctgggaattaagagtactggagtcaggcaggctttgatcagatccctcccccaacacttcctgtgtgagtgacttcagcaagttgctttactttacctttctgagcctcatttcccttacttgtaacacagaaatatgaatagttactatccagggtttttttttaggatcaaaggagttactatgtgtggagcatgtcacccagaggctggtatgcagcaagtgctttgtaaatagtagcgatgggcactactgaaacctgaatgtctgcctctgcctgtttgcgaatgactccaccttcccaaatcccaacagggaaggtgagtcagcttgagaccacttgagaggcatctagcagaagggaggcaaaacttctgttaaaggataatttttagggaaaaaaaggtaagatgatgactctcatacagatattaaaaatgaattcatcatgaagattttattttactcgtatgatggaaccaggcagatattacaactggttcaaaggaaaagtcaaagcaacacaaatttggagtaaaggagttgaactagtttttctgtgagataaggcagggggaggggagaaatcaattgaaactctcctgggcagcatcctgcccagtaggcacatgtattagttgcctacaattcacaaagggttgcgaaatagctcccgtggaatcagaatctgacagggaggaagagtgtgctcagaaaatgcatggctttctactgaagcagatttttttcccattacacttctagatctctgtgcaccattgtgccagggctgcgaggaaggtggcccacttcccgggatacactacccaccctcaagagagcctttcctgctgcttcttaggcaagtcagctctcttttctcacctcctgtaagcaacactaagtatctggctgttcctttcgtactcgagtcctggccgctccatgacagcacttgtggtggtactgaactgtgatggacactttctatcattgccctttcttaccttgatatcctaaaaagctggtggtctgtcttctctatcttttgtcctggtcagttatcctaactattttgtgtctgtttctgtggattagtaaacggggtccccacccccactccacaaggagaacatctggcacccagaagtcactgagagaatagctgttgctttggtagaattctgcctctgagtggcttgttcttttcccagacggagaggtctcctgacagcagctctcttctttttcttttttttttttttgagacagagttttgctcttgcgctcaggctggagtgcagtggtgcactctcggctccctgctctgcctcctgggttcaagtgattcccctgcctcggtctcccaagtagctgagattacaggcatgcaccaccatgcccagctaattttttgtatttttagtagagacagggttttgccatgtttgccaggctagtctcaaactcctgacctcaggtgatccatctgcctcagcctcccaaagtgctgggattacaggcatgagccactgcgcctggctttagcagctctcttctaaagccatctggacccacatttgttcagctcccctcccttggccatgatgaaggcatgcaaaacaaaaaaggcacttttcttattgagaaggtggctttttatagagaatggtgtcatactgttaggtttcaggccagcagacctagtcaggcatgtgacacttctgtgccaggtgtggctatgagagtcaacaggaaaaatgatatatgtaaatggacaggtctttaaataaatgcagttttgactataagagtaagaaggtttctgtgagactcaactcagtacctcctgtaccctgtgggcctgagagaggagacaatgggacaagaagacccagtggcttccttggaagcttttgtgctagctggagagagaagacctacttcctatatgcctagcaacagtccacactgactggactgcaaccaggacatttccagattactcagtggggcttatcttgaaataatagttgatgccatttgttaaatatattatatataccatctaagggtcttacatgccttctctcatttgatcttcatggcaaaccctgtgaggtatgaccaccaaccaccattttacctcagaactcaggctcccagagtttaagttgctcacaggagcccagaaagtaagcgacagaggtgggatttggttctaggtgtttgccaccagcactttaaatcaccaaagctttctggaagctccaacttttcttctcaagatactgaaagacaggtatctggatgggttggcagggcgggtgggaggtgggcgagatttccatcaacaacgggtctaaaaccagcgatggtgagctgggtgattttgatggaacccctgccatacagtctattaatatcataattggagctaaaatttaatcatgatggcaatcatgagttctggggcttcttgatttgggccagcagacacagtctcagtcactagttctccgaatcagagaaaggatgccttcaggctgtgtcttcacatggcttttcctctgtgcgtggtggaaagagagagctctgcgggtctcttcttgttgtaaggacactggccccattggattagggccccaccacatgacacatttaatcctaattacctccctcacagccctatttccaaacagggtattagtcacattagggattagggcttcaacataggaattctgggggcacacaattcagtctataacagagggaaaacagatttgagaagaaaaaagtccaaaatatgcacagtggtaatatctgaagatgtgcgtgcgtgcgtgtgtgtgtgtgtgtgtgtgtgtgtgtgtttctattcttgcattttctaactgtccccagtgagtatttgttactttctaactgagaaggttactttaaacagtgtcttgagcagcagcactccatgccctggtgtagccttttcctggcagatgttccccagggctctgctgctctgccaatgacttattctcagcatgaactcctcccctgccccctaagaggatctccaaacccaggtcacactccccctgcaggtaagtacaggcgtttgagaacagctttattcttccaggaacagctggtcccctcagcagggccttacaaggtggttatgtctaaataaggcacctgaggccaggagatgtgacatggtccatctaataccatggagtgagttagacacagagcaggactggaacccatgcttccaattccccatccagttttaaggcaatcttcttttctttctttctttctttttttttttttttttttttttttttgagacagagtctctgtcacccaggctggagtgcagtggtgcgatcttggctcactgcaacctctgcctccggggttcaagcgattctcctgcctcagccttctgagtagctgagatttcaggtgcccgccaccacgcctggctaatttttgtatttttagtagagacgaggttttactatgttggccagggtgatctcgaactcctgacctcaagtgatctgcccacctcagcttcccaaagtgctgggattacaggtgtgagccactgcacctggcaaggcaacctttttttttttttttttttttggtagaaaatctttgaacttcatatagatggtgttaatgtgggtgagttcagagccatgtgtaaagttccaggaggggagtgcttgctggcttctcccttatccctcaaccagatcccagccccagccactttctgtttctcttctctggataaaactatcattcatcttcacctgtttctattttcatggattactgtctcattcatctcaagtagctcaagtgaatggctgtttttccattggatacaggaagactgagggtgacctgaccctcatggtgtgcttgcttatttgaatgtctgatggttttatgggtgtagtcctgctggagcagaaagaatatctgttaggagcctgcctctgggctctggttctaactgtgccacaaactcatcgtagccttagacaattctcttgtctctctgggcctcagtttacccatctggaaaatgatgggtctgaatttaataccttgagtatcatccagctgtgacatactacaactcaggcaagaagcaaattctcctgacactccatactcctatccagtgttctctgacgtccttccccaagagctgtggtaccctaccctgcccacattatgtgaggcattatagcacataggttagaagtgtggtctctgggccgggtgtggtggctcatgcctgtaatcccaacactttgggaggccgaggcaggtggatcacgaggtcaggagatcaagaccatcctggctaacacagtgaaaccccatctctactaaaaatacaaaaaattagctgggtgtggtggcacatgtctgtcgtaccagctacttgggaggctgaggcaggagaatcacttgaacctgggtggcggaggttgcagtgagccaagatcgtgccactgcactccagcctgggcaacagagcgagactccatctcaaaaaaaaaaaaaaaaaagaagtgtggtctctggagctagacctaagaatccaattcagactctcttacttactgactgtgtaatttggacaagttacttagcatttagcatctctatttctttaatcataaaatgaacatattaacacttacttcctagggctgttgtgaagataaactgagttgaggtatgacagtacctagcatgtagtaagcatcattaaatggtgtctgttgttttcacatattgtaaagaagaaagcttcgtgcatctcttggaatttctgaggacggtgaagccacagctgggaaagtctcagggagccaggagttgctggcctcctgctttgcatactcaaaattgctggaaaggggctatagcagggggagacattttttaaaaatcccagttattgctattcctcatgagtatgtatatatcacctggcatcagtactctgcatagaaagaagcatagctaaagaaaagacactttgcttttaatataacagctgttttcaggggaatagggtggatgaggatagggagtactggccctctgtcctcaggcctccctgtcaccagctcagtcacgtctatcttacaaatccccatctagcaggaagcctgctctgcccttggactatagacctgaagggctgttgttaagttacaacgttcccagtggaaggaggacagtacttaaaagttacaagatgtgggttctgttcttagttcttatggcctgtcagccagggaactcctggccagtagtctcatccttgaacttcttctttttttttttttttctcaagacggagtctcgctctgtcgccaggctagagtgcagtggcacgatcttggctcactgcaacctctgcctcctgagttcaagctattcgcctgcctcagccttccaagtagctgggattacaggtgcttgccaccacgcctggctaatttttgtatttttggtagagacagggtttcgccatgttggccaggctggtcttgaactcctgacctcaagtgagcccagccctcatccttgaacttcaaatttccaccccaccttactcccacaggcatataccagttgttcctttttctctgttcttatgcaggaaatggcctgaggtccaggagtccccttggtcccctttttccctcactctcaacattcaattagtcttcacatctacagccgacaattgtaacttcttttctttactccattatttcttaggtgacaacaggagcttctttgtggtcttcttttttctaaaaacactaattcagaactctagcatgtttagatcttccttacttaaaaccctttcctggtccccataacctactgaagaaatcctaagctccctggcttggcctctgtctacatttctctgatctcttccagctctttctctgtatcctagccatactgaactacttgcaattcccaaacagggtacacactgtactagttgttcctgcaagagacaggaacacacatccccccacactagcttaacaaaacaaaaaatgcatttctctctcatgcaaaagaagtccaaaagtagacattccaaacttaatatggtgttccagtgtcagaatccaagttctttctactttgtgggtttgccgttctcagcatatgacttccactttatggtccaaaatgactgctcaagctccagccatcacatccacatttcagccaggaggaagaaggaacaaggaaaggcataaccttgcctctaaggatagttcctggaagccacacttgcttacattccattggccagaattagtcacccagccatatttatctataagagaggctatgaaatttttttatttcagggagtctattttaggttgccatgtgcaaaagtaaaaaccagaggtgttggtggtcaaggaagaaatagcgaatggatgctgggtaacatctggcagtctctgccacacactcacacattcaggggtttgcacgtggttccccgtgtctcagacaccccctctctcatgcttacagtctctgcttggcatcttcttttttgccccctaacacttgctcttttttttttttttttttttcgagatggagtctcactgttgccaggctggagtgcagtggtgcaatcttggctcacggcaacctccgcctcctgggttcaagtgattctcctgcctcagcctcccgagtagctgggactacaggcacccgccaccatgcccggctaatgtttgtattttcagtagagacggggtttcaccatgttggccaggatggtctcaatctcttgaccttgtgatccacccgcctcggcctcccaaagtgctgggattacaggtgtgagccaccgcacccggcccaacactcgctcactttatggccatcctcatactacctctgttgttgcaccatcacagcgtgttaaccattgttcaattgtccacctttcccactaccctgtgacctcctggagggcagggactgtgtctttcctttggctccttagcacccagtatagctgcacaatctccagccaaggtagaccgaccaccaatatttcttgtctcaaagatatattgaggaaatgagagtatattcttcaggcttccaggaacttccttacatctgtaggaaggtatgggcatggggatagctcagtgattgtagaggctcgtggcagattgcttgctattctttgggttgcacacaggccgtctctcttgccatagttttttccagatactgcagtgacattgattaggtctcagccttggcgatgtagactgaggtggagagggattattgtcatgattcttgctttcgtttcagtcagttcttgatttgatttctgccatttattcctctcaatttttacctgggcaacatcatctcccgcctgctttttaaggtgaatgttgacagctgatttcatatattaattctggctttcttaagagggacatggctcccttcattcttaagcctttggggctacttttctttctcattcactcatgatctccatttgatccgcaagacagctcatatttgagagagcagagcaaatgtgttattcccatttcaccgatcagaaaatgagggccggccgggcgcggtggctcatgcctgtaatcccagcactttgggaggctgaggtgggcggatcacgaggtcaggagatcgagaccatcctggctaacaaggtgaaaccccgtctctactaaaaatacaaaaaaacccccaaaaaattagccgggcgtggtggcgggcgtctgtagtcccaactgcttggaggctgaggcaggagaatggcgtgaacccgggaggcggagcctgcagtgagccgagatcacgccactgcactccagcctgggcgacacaggctgtgtcgcctttttttgagactccgcctcaaaaaaaaaaaaaaaaaaagaaaaagaaaatgagggcctagtaagattactcttatttgctcaagatcataggaaagttagtggcaaagccaagagttgatcctggatccttttgtatccaagaccagtatcttttgcaaatacttttctttattttgataaataattaacatttacatgcattattttcccccagaatttgaattttttcttaggatagattcctaaacatggaagtattgagtcaaagagtataaatgtgctttaaaaaaaatgctcttaatacattttgcagaattcttcaagcaaggttgtcacactcatgtttaaggcaggtataactacccatgtgcaggccagcccaggagccagtgtggtggggagaggccataaccagccattgctggttccctcagccagcagaggcacacatgagcttctcaccagcccggtgagggtctcctgttgggaggtgtgcatttttgcatgcactctggcctctgcacacaaactgaatatttcatctggtgctcaaccacaagcacagccatctgttccgtgttggaacagatgtgttggactgtgttggctgtgttggactgtgttggctgtgttggacttcgtgagagagcctatgtcagtctccatcaggatgtgtatgtagtgtactggactctctaggtgattgaaaggattccagagataattttgattatatgagtccctgacttcagactccactcttgtgaccaccacacaagctgtgactccaggaggctgggatgccgtgctattttcactgtacccttgcccccgtaatctcaaagcctgactggatggaaccctttctattctatggctagtggcttgtgataaatgtcctttcaggtcaacacagtgcaggctggtatctttacctttctttcaccgaagttaagtgctgcaccagaacttagaagcctcatggggctctggggcctcaggctgtaccttgtgctatgtcagctattacttcatgtcaaacatttgcatatgaatgttcaagcgacagcttatctctttcttcctgcagttggttaccacagagaagcgcttcctcaaagacagtttgtacaatgaaggaatcctaattgtatgggacccatctgtataccactcagatatcccaaaggtaagtgggtgtccgtgggaaataggggttgagtttcctgtctgtctacagattttcctgatttcctaggtttttaaagtcatggctgacattggctattcctaaaggctgggtatttgagttttagggtaccccatttcatctggactagcagattcagaagtattcctgtcctataccagctactctctttgccgtgccagcactgccaggtattgtctcccagttatagtatttactgggatagtggctggagttcccagcatctggggtagattgttcattaatgcaattattcgtgatgagcatcagcagaactcgagagtagttgccgttactcctgtaaataatattagcacacttttatttcacacttccaatatccagaattcttcccatttcactctcataacaatttaaggagatagatggaagtgtggttgttcccattttacagatggggaaattgaaatgtggagaatgaaagtcccccattccaggacttgatttactaagcagaaggcgcagatctgcaacagcagctctttccggggaaggagacatgagtggcaggcctgctggattctaacctctctggaatagtcctctcactgttaatgcatgtcagttgacctctccctgatgcaggctgctgtggcctcaggagcatggcctgagaagggcagagagcactaatcttgggacacttaactcttaagttggatctaccaatgcctgacaggctctggcgacccctggcaccctcactatctgactttcaacagttttgcactgatctcacttagaactcaaatttgcctaggtcaggacaaggactctgaacccatagatgtcctatgctctagttttctcccctttaaaaatgagagatggggccagatggtacgtggggctcttttcagctctgagagtgttcccggactctgatcctgaagcctgaagctgatcttgggtcgccaagctcaactctcccccaaagcacaggctataggctaggccccaccctgctatccagtgaaacctgcggctggaagagaaacctgtagtctgctgcaagaaaagggctgtgcctcaggagcaacacttgttgatcctttcccctccccatgtccactgatgaagatgactcctggggggagcagctcactggcccatttctcccttgagaggaccacttctttctttttcagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtgagttcatgtcggggaaaagaccttgcatgtttgtttctagaagagatgagctttttttctggggtctcattcagtcattcgtttgttcatttgttcactaaacaattgctaggattctgctctgcttgtagaccatgccaagttctatctaaaatacagagggaaatcagatagaatcctttttcctgagggcatctattggggaggtcaatcagatgtctgaggcaatattcaatttgtgccagaagggagagacaacctggtgtcataggagagaggacaccttctagctggacagttgcttatagcctcatggaggaagtagtgttcggtaggctttggagaggggagaatttggcagaggaagatggagggaagggaagctatgaacaggggagggaggtgggaaaatgaggagcggggctgcacctcagacgaggggagcaaggcacttttctcaggtgtacaatttaagggcgtaccccttaaaaactcagtcatcaagataaataatatttcactacagtatcttcagaaaacacaattaatgtaaaaattatgatgagtgaaatatcaagtatttaaataaagataggatcagtaacagtgctgtgcagagtttattggaacaatgctggccaggggcccccttcttggattttctctacatctcatcattcagactgtggagtgctcctgttccagctgtccctttgcccagctaagggaagaaaagtcttccctccccaacactgtttcatgcaaatgctataaggaaaaatctgctcccaaatagcaccatccaagaggttctgcaggatgtcacagtgctagaaagtgctaactacacatgatgccactgtctcctcaatcagctcagtaatcttgtcctctttctccaaataaattattccatggatacattcattggctgattgatggagtcatttaatctactagcatttagggaggatctattattcaccaggccctggcctaggtgctggggattcaaaggtgtataaccctcacacagccctgcatcctaaggaacactgctgggcttggcttgctgaaacttagattgggaatcacagtcataaatagaaactccagagggaaagctctccaaatttggggtcatgagctgctgaacccactgggcagagctctggggtgctggggtgggttgtcaggcatgactcacctctgctcccctctccaggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaagctgcttctctcttcttatttgctaaatgaacaactgctgattgccaacttttatctccaaagaggacacaactgagatcctgaaccccccagtccttacccactggctcctctagccttagacttactcctcagtactccaggaaaagaaatgtgaactttactggaaggatcacctctttgaaatattcactggtttactgatttttttatttttattttttgttcttgcctggattcacataactaacctgttgcatcaaagaagagatggagtcgggcagaaagcagaacataaggaagatccttccctcggtttccaaaactctaaaatccttaaatgaatgatgtcttaaaaggatttaaaatgtttggacacaaatcttgagaaggagcatgagttaggggagagagga

SEQ ID NO: 12178 - DNA, 137743 bp, Human
  misc_feature (1)...(137743): n = A,T,C or G
ctcagccatgtggaactgtgagtcaattaaacctctttcctttacaaattacccagtctcagtggtattctttatagtaatgtgagaacggaccaatgtagtgtgacttggaagggtgagagcgatgacctgattagatttggtgctcatgttaagaaaaagcagggaataagtttggattgttgggtgggcagaagcccaccaaggtaagagaattcttagtttgcagaagaaagaaaaacagcacattgtgtcacacagatcttttgatgtaaagcatgactttaatgccttcttatgatattatatagggaaacatttacatagccccttcataactgtaatatgccctagttttgtttgtcagtttatttctttgttatttactctacaaatagtccttgaacttgaggaagaaaaatgggaatggtttgtgttttacttaaattataagatcaaagatggcagatgatttatccaaagcccaggcaagtaggaaaagcccccccttcccttccccttttccaggatagaagagagttggctggttactttgcaggacttaagatgatcttcattttaaagaatctgtatcagcctccactgtggtaagatgtgactgggatttcaaggtttcccctgtctctactgatttacctaagtaggacagagatttctggggcatgcctgccggtggagggcagtaggtcactcaactaagagcacagtattgttgagaaaatgacactaaagtggtcatctgggatgctacttcgcttttggtaaataactttgcatcaacttctcaagttccacctctcagtggagacggatgctagacaaaggtaccagacaccgcagcctggtcggctgaacaaatggagttatagccttagattttgttttcgtgatgactaagctgaccaggtttcttctttgtccttgcacactttatgcttgacgagatgcttaagcaaatagaataggcgaccgctaggaggtacccgagctatgcgtcggccgccggggcgagcagaaatggctaacagcgactctctcggctcggtgggtcaaggcgggtggtgcttttccaaggtcggggttgcgataagcttatcgcttatcacaagcaagaagggcaagaaggacgtctaagaaccaacggtcctttaatctaaaaggccgcgcgcctccaaggcaatgtgacatcttgaggtctagtgtttgggcaccagctgcctgcacatctggatgcagcacttcctttcagggaggaggcgaggcggaggaccccggagtgcacgcacctcctcgtgcgcgcgctcgcttgcgcccgtgaacgtgtgtgtgtgtgtgtgtgtgtgtgtgtgtgtgtgtgtgcgggcgcgcgcgcacacacacgggccgcggctccgggaccggctaatgggggtgggggcccaggaaggaataaatctccgccagcctcctcgcgcctggctgcgggttaatatccaaccagctagagaaagactagggtgacggcagcagggtgacagcctgggcacaccggccgcttgtcgaaggatcaggatattagccagtctccgccacactcagggactgatatatttctattggcggggggctgttggtttttattgtctgccgttatctccaaagaacaagggcacgagtgaggggtgcgcgctctgggcgagtgtcgcggctcggatcgggtcgaaggaggcaattttgcgggtgggggagggagggggagaccttgatttccaccaatccccgggcgtttgtctgcgaagtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggtgggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggtactcctgccctcgcggctcctcccctctagcgtcctttcctccccgagtgcagaggacagggtcaccggcgaggaccgccttgcaccgtctcgcagaggcatccctttcatccgctcttccatgtcctttccctccatttgtgccattcccaacctggagactttagtcagggttccttccccacccctgatccccagagatgtgcagacacctgctttgcgcatgtaaagactcgacgcatttcttcccaaagcggagttttatttaacaatttacggataaacaaaacagagggaaggagaacccaggataacttagtctcttgcacttaataagaatttacctcttgggctctgcagacatttgaagctgtagggaacaagaagcaggtaaaaggcatctccccgaggtggagtgcacagtcggtaacataagtccccaacgtcggagtgatgggcagtggaaacatggacggatcccgcagctttgcgcagtgtgcccacagcaagtgcatagtactgactgacgtctactaagagacgatactgtgcaatttttgtgttgaaatctcgaacagctttctagtattattatctcatcttgttgaccacaaattgattctttagaaggatgagtaacttccccaaggtcattacttttgacctgtgggtgctggatttttcatcacttaaagctccaaagctcccagctctttttattggcttaggctgtggatgcctctggaagatgggagatgtactttaagtaggcacctgaagtcagaaaacaaacaaaatgcccaagccaggttggaaatcagaactctgaggatcactcagaggttgtagatccgcttcctttctgggaattttagattaaatgtctaaaaataagttacggcagcaggggttgtgtagttagattggagggaaggcagagctgcttccccttcctctccacctccccaggcatgttgagggaacacacgggtgcttccaccactgcgaggtgcccctttcacctttagtctctggggctgaagatgctgctgttggcttcttcctgtgattgtagtggtctgggtggttggaaatgatctcctctgctctgtagaggatctttctaatcagtgcaagggcaggtgagttctaatgtaaacatttttcactgcagttatttacaaatattcaggagcatctatacatttttaaaaactttttaaacatatggtttccatctccttctcaggcctcctcctggaaagaggattaaaaagataacagagccaatttgtttagaggaaggcaactgcattctccttggaagggaggactttccttctccctttttagaactctaccatcattgaatttaaaaataacctcactcttcctaaaagtatctaagggttaattttttctttccttcacagtattgattgtgggactcaagagcaggcaaaaggcatcacatccagcaattattttccctaaagacagaaagcactttcatttcaagtgatctaaggaaatgagttaagaacttcccattggtttgcaatgaaagagtccatttttttaatataggaggaggaataatgaagccctcttagaggatagatttcttgttggaggatacagtcaagtggaaaatgcttcaaattctgagacacacaggctgatagtttctgagacacatttgttccttgctttctgtagcctggagtaattttcagtgtgtttggctgttatctggtctggtctctatgtgcagagaattacttattaaaatccacacactatgaaaactacctaaacacatatccctcaaagttagtggctgtaaaaccatgtaaaaggcaccattgcttattgaaataagtttgagcttcagagtagaattctgaatttctacactgagtatgctgtgactagataaacagcagagaatctttggcaagttagtatattttttgagtcctggctttcttgtttatctacattgcagagttgttagaaggtttacatttttaataaaaactgatgccaagtatctggtacattgtgtacccagaaaatggttgccttataattgttataaattatatttctggtatatgttacaacttaaataaggaaatctgggcaacccatgagaatttggaatgtttctcctgccagatttacaggtaaacattattggtccctacccctctccccagccatgtacacttaacgctaatgaacagggacaagacattttgaaaggtaggagaagtttcatggtttgagttaattattttttacctgcacatttaatgttctttaacatttggattgtcagtatatggcagtagtgtttatttgttaaatattagaccagtcagtcagaagccattatcatgttaaggagacacaactttgacaaacaagcatctgtttttctccagtctgaaacatcttctgcataaatacagatatatgcacacaaatgcacaaggtgcacttatatgttgagatataggtgcatttattcacaaatcatggaatggtgtcatgtatgtataaaaatatagatgtgtatacatacataaatacaaacatttgcaatcagtcaattaaacaatatttcatgagtgactactctacatcagatatgtgttaggccctgggggatagcagtgaataggatggatagattgcctcctctaagagctttcctcctagtagaggatgattgacacacaaataaatacgatgacttaacatacggttaaattctgtgaagagaaaagggagtgtttcactatgtttataaacaccaaaatttaagattttattttgccctctgtgcttccatttacttttgtaattttcttcttctagctcagtacttgatatgtactgaattctcagagaagaaccttgtcaaactgcgaaggagatggcaggaagaaagtaagaaagctgtaagagttttgaatagaacaggaagttttcctaatgtttatgtggtgatagaaagataaaggaatcaatagatcctattatagaaactttcttaattcttgttgcttttgattaagtgatactgtgggaaatgccaaaccaaagcagtgtttgtttcttccatcagatcctcacccatttcatttgctcctcagaaatgaacctgaattcagaatttatgtgcaaggctttattcatggcacctgacatggtaacaataatagtaacaattaagctaacaagttattaggtgcttattatctgcctgacactatgctagtatgtattgtctcatttaatcctcataagaatcttgtataaattgatatatcattatccacatttatgaaaatgaacatgccctggtcttcaagggagttgctataatcccatggaaaagacagataatgtatataattaactaactggaaatagggccatcaaagacaggaaacatagcagagtgaaaaccttatggattttgggagctgtcagaacatggttggaattctggctgtatccctttctagttgtgcaatcattggtaagtccaatctcagagcttcagttcctccatttgtaaattggggcttgtaagaatgtcttacaagtttgtggtgaaaattacatgatagcatatagacagcgcctggaatgatgcttgccacatagctctgtttaatacgtgattgttataacaatagaaacaccagtggaagtgctggggatnnnnnnnnnnnnnnnnnnnntgaagtgctggggatgttcccagaacatgacatttaattctactgaagggagggaaatcgggtttcagagaggaggtggtgtttggagtaagcctccaaggatggtagggtggcatagtggtaagaggtgaggatagaagtatatgccaggcagagagaacagcaaagatcaaggcggagagatttggaagtgcctgatgtgtttactgtatggaaagttattaagtcacccatggagaccaccatagaaaagtgggctgggtggtaggacgaagccaggagtctttgaatgtatttaaggtatggctcattagaaatggacaaacatcaaggatctaatggtactggctgcatgttagctatcagcagaggtggcacatcactgttaccagtgggtttgggaagtagaatagaggttaatacagtgaagtggttgttttgaaaattctgtcgactcattgggtggtaaccgttactctaagcagtcaagtcctttctttttcaaaattttgaacaaacgactgttttcagcagttccacctttatgtggcctctttatttccctatttttgaatccagggatgttaaaagctcaatttccataattgtcctggtggcaggaaaagggcattgggagtggaggggaggagcataggtgcagccatctgtacaggtaaaatataagtttagtgtttgtaagttgggggtttatggaattcactttgaaaaggtagtttgggaaaaagagggtttaataagttttgatgcttaagaaaatatgctacagttatgttgcaaatttacaaatgtggaaaaaaatctcatcagcaataatcacaatagcaaaaatcaatcactaacccttactggatacgtaaaatataccaggcctagttcttagcacttatatatgtttttttttccccaaagcaaccttataaagtaggtttgtgtatgttccttgttttatagatgaggatatggaggtttagacagatccatgaacaaaatgatggagtttgatttccaacctggagctatttaattctaaacctcatgcttgttccctgctcatttgggataaatgaagcaatgctgtatacatctctctcatgatttggctctgattacttctccaatgtcatctttcatcagtttttgtttttattctttgctaatattggaataattaaaaataggccaggctatattggttttgctcgagccacccactccacctggaatgacttgacttgaaggccacatcttcctgccttttacctggccagttccttctcatctcttgacagtgcattatagtgggtaagagcaaaggttctgaagtcagctgtgttcaaattctgattccatcacttgctgtgttcttgagcaaatcagccttcattgctcatttctctatccataaaatggggcttcttataggactgttgtaagaattagattagataatgtgtttaaaatgtttagaactatttccagtatataattaatgctcagtccttgttagttcgcctcaaggtggcttcccttactccttcttcccttcccaggctgtgcttagaactcctcctctctgttttctttataccatgcatgtatgattgtaatcctttcagttattcaaaatacctactactctgtgtctaccactattactgtaggataggagatgctgggtctgtagctgtgaactgaataaaatttttgttttcttggaatttataggataatgatgagagacagaaaataaacagagaaatatacaaataactggtagcgacaggtgcattagtgatgatgtattaaaaatatgagtgcacttgcctgccttccctgctaaattttaagtttctcacagacaggaactgtgcctcattcttagttgcattcccagagcccagcatggtccctggcacactaaattttgcttagatatcatgtgaatgaatgtttaggaaggtgtggaaccagatagccacccaattggtcaacaaatatttaatgagacctactgtgtgtccagcactctggcagtgtagcagatcagaggagtaagcatcctttgtattctcaaagagctcttactctagagcagaggttcttaatttcaaccctcctgacattttaggctgcatactgctttgctgtggagtgctgtccggtacattgtagaatgttcagcagcatccctggcctctgtccactaaatgagacaaccaaatatgtctccagacttggcaaaatacctcctggggggaaaattgcccctgactgagaaccattgatttgcagaaacaaaacctgccctatcgacaggatttaagaaaccttgaaagtatgcgtaattaagaactaaatttggaaactacaatataaatgctttgactgtttagagaaaggaggtgtctctgtgggctcaagttgttggagaaggcctcctggaagaggcctgaatgaactgtacttgatagacaggtcttggttagggagggtcaggagaggggaggcgttttaggatatttatataagcaaccgtctctgttgaaagtaatataacagctgtttaagattttcactaatgttccccttaatccctggtgagaggggtccatgctctgtgccctatactttaaggggccacatccttctttttctctggtttcaccctttctcagtgaggcagggtgttaatgggatctttctagactctggaatttcctgcccaaatgacccaactctacttctgcagcctgcctgcctgcgtggggcattttccccaatcttcttcctgagagtggcttgcccccctggtatgtacaatcctagtccacacatcagagggggcaaggaacggctaagggacagctctttgagggagacattgtggaaggatctttgatttggttctgtggggcccacatatgcaagtggtataggcttgccctgtgtccccagattgcaggaccaaacttcctggagtttcaggagtctaaatttgaatttggcattccagattgttatgcagatttgtttgtccagggaggagaatagaacatgttttatcggtttgttggtttgatgataacttctcaatattagatacagttgtacttttgttctctgccttgcaaatggaggtggttggagagtttttggtctgtactgtataatcaatactcgagtgaaaaattatagtgggttttttgtaacttgggagtctatcagtcttctttgagagcaaagtgttttaggaaactagttggatcaattgaataattatgtaagttagtatagaatgtggtcagttagtcttttgacaaagttgtgagtcatcttggaaataatgatactatgtatcattaatgcactcttcatgatggatttgatagatttctggtaaaataatctattttagcttctcattctgacctggctctatcaggagctgtgtgaccttgggcaagttacttaacctctctgtacctttgttgcatcatctgaaaaatgagtataatgtgctaatctacttcataggtttgtgatgataattaaatcagataaagaatgtagactccataaccatcctcacttggctgggtgggatgataggaagtttgttcccacctggaaaatgtctggactttggagtcccagagataaggatctaatcctggttctgtcatttatcaactttgtgacattgaaaaatttacttggtcttgctgagccttagccgcaggtggcaatagttaccttgagaggattagttgctggataagtgctaattattagtccataatgaggagannnnnnnnnnnnnnnnnnnnnnnnnnnnnnnnnnnnnnnnnnnnnnnnnnnnnnnnnnnncttgtgacacacgctcttttttcacagtattagtgctgagggtgctgtactatggccggcaaaattttatggaagacagcagcagcccagcaataaatcaactgatttcaatcattcattcaaccacatttgctgaatgtctaccatgtaccagttaggtgctggcaatacagtgatgaatacaagaacgtggtccctgatttgttaatctaattaacaaattttataatctaattaacagcagttctcccatatctgtggttttgttttccatggcttcagttgtctatggttaatttggtccaaaatattaaatggaaattccagaaataaacaattcataagttttaaattgtgctctgttttgagtagcgtgatgagatttcactttgtcccactatgtcttgcctgggatgcgaatcttccctttgttcagcgtctccacactgttgacacttgctgcccatgagtcacttaatatccatcttggtggtgggatcaccgtgcttgtgttcaaggaacaccgattttattttaccagtggccccaaaatgcaagactgatgatgcaggtatattgttataattgttctattttattattatttattattgttcatctcttactgtgcctaatttataaatcaaattttatcataggcatgtatgtataggaaaaaataggaaaaaacggtatatagggcttggtaccatctgaagtttcagacatccactgggggtcttggaatgtatcctccacagataagaggagattcctagtttcattccttaaatcagtaagaaaccaagtaacatggggttccaaggcttacagtttgactgttttggataatgataatgagttttgaaggaatcgacttttatccctttctgttgaactgtcttctagctgtggcattgcatgagagggaagcagccaagaccgtaagagctgtgtcgctctaattaggtgccaggaggaagtggaaatgaattcagagccacacattctccatttttcagatcttaaacacagaagacactatcagagatttccaggtgaccacaatgagaaaagggcctttcgtcccactacatcttgcctgggatgcaaaatctttagtttgtttccattattgataaaataaacatatatagtacatgattttatgtcccccatgttcatttaaacaatttatagtgtttattatttgtctgattttggaaagaatacatatttactatagaaaacttttaaatgtagtaaaaaagaagaaaaagcctgctgaaattccctcactcggaagtacttattgtaaacagtctcttttgtgtatgtttgtttgtgtgtattactaaattgtatgtattttgtatatttaattttatatcctcttttattcactcaaaattatacctttagaattttctcatataattaaataacttttaatttataaacttgtgaaaaaatagctttataattttttattttggaaaaataattatttattgtccaagtattaccataaaaatactttaaaaaaagattatgctgctgacaaatttatgttagacttttttctttaatgatttcttcatatgtagttgttgtatagctgagcataggaaattaaaaagcctctttaaagatctgtactgtcttgaggttgatatttaaaggataaaagcaacactattttcatttgtaaaagtaattgacatttaacaaacatcgctaatattttggtttatattcttctggatcattcaatgccaatgtgtgtataaatgaaacaaaaatataatgaattcaacagtacattgcaaatatttttctagtaatagtatatgcagtctacatcatctcttctaatggctgtaagattttccattgttaggatagatacaaatgtatttaattaatatactgttattggatatttatgttgtaatttctcacttttatgaataaagatgtggtgatcatccttttgtatacatcttaaacacttacctgcttataaatttctagaattaatcttttcacactttttagtttgaagcgccagttctttttttaaaatctttttaaaatttttgttccttgagtttattaacttaaaacgaatgctactacaagcatttcttccatgccactaaactttagcccagacatacattttaacgcttgcataattttctgtcatatgaatatcattaaatgtatttaaccaatgatctttgttggaaatttagtttatctactatttttatgatcatgaataacactgtcatttgatgactttaagttgtcttaattctatattggttttttctttctttttttttcaacttgtattttaagttcaggggtacatgtgcagtatatgcaggtttgtttcacaggtaaacatgtgccgtagtggtttactccacagatcatcccattacccaggtattaagcccagcattcgttagctatccttcctgatgctctttcttccctcaccccaaccctgacaggtgtgttgttgttccccacaatgtgtccatgtgttctcatcgatcagctctcacttataagtgagaacatacagtgtttggttttctgttcctgggttactttgctgagaataatggtttccgactccatccatgtccctgcaaaggacaccatctcattcctttttatggctgcatagtattccatggtgtatacgtaccacattttctttatccagtctgtcattgatgggcatttaggttgattccatgactttgctattgtgaatagtgctgcagtgaacatatgtgtgcctatatctttataatagaatgatttatatttctttgggtgtatacccagtaatgggattactgggtcaattggtatttctgcctctaggtctttgaggaattgtcacactgtcttccacaatggttgaactagtttacactccctccatcagtaaacaccaattcttatatctggcatctttgattgttcatagaaaatctttggctttggctaagtgcagatttggggtgttgcctctttcagtgtgcaaagtgattgcataaatagatatactatgattgttagattaaattataaaatttcccttaggtggatttacaataggtcaggcaatgaaaaaagatccccatacaactggatatgtacagtggcaggtaaacccttcatttgggattgcagagacccagctatgaggaatttatgtagtgcagtggtacatgtgcttttatttttcatggttatcagctccattacagtacagctgataattagcatggtgttttatctccatttaaaaagcaatagctttctttcttctaggacttaagcaattaaataaaactgtgatttaaaaaggaaaatgaacttttacttcatgataaggtagagatttcaaggaaaaagaaaagtgtcctggataaaatagaaatactatgtttcacaactctaattttaagagtcattttcctatttactaaaattaaacgtcttcagcatgaatctgcagcagatcatacccacctggtgaagggtggaggtgtcataaaaaggcacaaaaattccatgatgatattttgttgggtcagtgttttggtggtgaagtgttggtgactgtgacattgctcgatatcatctgtattgtgtccttctactcccttgcacttgtgtgaaatggctccacatactgttgctttggtgctttggggctagaaatgaagtcttgttgatatatgtctgtctcaagtccctggtcacagccttactaaatgtctaatgagtattggatgaataaaaacatcagattatctgaaaggctggtagacagctgtctgaataccttttagggacagtttcatttattgtctattattaagactctaggctctaaatattcactgctaattcatgtattcactccttcattcctttattcaacaaatatatattcgatgccttctatgtgccaggcacaatgctaattactgagaacagagcgataggccaagaggacgcaggccttcccccatacagcaaacaagcacgcagcacacaatgggaaaggagcagcaacattctccagtctctccacttctttatatgggaggaaaaacaaacacaggtttgccgtagctttcagaacttagctgtgtctgcctgtatttgattcagtccataaagggcccaaatctccactctggtccattcagtgtggtgcctgaatcgtgattgcgatggcagaggtctccgtctagttcagtggtatgatatctttggactcttgctaacctatgcaacatgtgaaatgctggagaggaaaagcactttaaaaccttgctgaaagatacatgagcccatggggaaacacaaagctcaattactggtagaatcaaagagacagaggcaggctggcttggaaggggattgctcactttgtaagcaactgttctcaactcaacctgccaccctgcaatagcaaagaagaggaagtggaggggccggcagcaagactctggtgagctgagtcagtaggcagtgagctgagtctcaatttggggtaaaaacacagtcactttattgtttcctaataactgctccaactatggcatgtgaaatctacctcctgacctccaccccgcaccccagttagctggctctaatgggtctctgaacaacttggccaggttttattaattttttattcactttgattcttgggacagtctcactctggtatttagctcagttttgtttattttaaagcacaatgaaaattctggcgtctaccagctccgcctgctcaggctctagaacctctaggcgcttgcggcagaaggcaagaagagcaatcgctgaggtggagcccactccaccctcctctaggagctgctgcttcagtttgggcagggaggaggggaatattcatagtccctttctctgttgggggtggctgcttccgcgtgaaccctgcttggctgcccagccttctaatggcaaagtgttctggttctttcacctggcgggcagccctcttaggtggggtcctgataaacactccatccacagggagatcccctatccttgccacgccaaagggctctttctctcccacccctctcagcctcaccatctatctttccgtctccctttccgctttctccatggctcagggacagccagagaaaacatccaggagtgcagtgcctggtgtgtctagtgcctggtgtgtctggtgcctggtgtgtctggtgtctggttgattctgcagactcttccttttcttttctttctctttctctttctttctttctttctttctttctttcttctttctttctttctttctttctttctttctttctttctttctttctctttctttctttctttctttctttctttcttcctttctttcctttcttctctctttccttctcctttctttctttctctttctttctttctttctttttttcttctctctctctttcttttcttttcttttttttaggtctttctctgcacccaggctggagtgcagtggtgcaatcatagctcactgcagccctgctgggctcaaggaaacctcctgactcagcctcccaagtacctgggactgtaggcccagcaaatttttaatttttatctttgtagagaagggatctccctatgttgcccgggctggtctcgaactcctgggctgaagcgatcctcccgcctcggcctcacaaagtgctgggattacaggcgtaagccaccgctcccggcttcacttctttacaggtgatttgtttggagattcctctacccctcttctgtgttggcagggagggaaagcccttgtctcccctctccgtgggggtggaaaggctgtggcctcaccacaaaagcatgccactcccaaggcagctccttccctagtataaatcagctgggtggtgccaggactggtcctcttagaaaacctgtggagtggtaaacataaaagatggggtacttagcctattttggcctcagggtggggccttgactgtaattcccagataagagggaaaaatcctcacactttgttatacttattccccggataagtctttgaaccttcatgaagcttagttattgtacaccagctaagttccttttctttctttaaatagatgcattatagatgtacatagctttggggtacatgtgataatttaatatattcatataatttgtaaagatccaatctgttgtgtactgtttcttaaaggatctctgcaggtctatgtcatatggaaatgctcaactgagtccattctgtttcatcttaagcaagaaatcaaggtttcccattacaaatgagatgcccaagcccctcacctcctttttatggggcttaccgtgaatgtcttgaactgtttcttcaccatttagaatcactcttcactgcctttttaaaaatttccttttcttcttgcttaggaagctcgtggtcagatcaacacacctcctagctaagcagactccaaatggggaatgatgaatgatgcccctctggctaggtacccccaactttgattctcttggggcctccctcttcttcaggggagggaagaatccccattctcaataggtttttcttgctcccaattttcccttcatgttcgccaaggtgaagggcaattatagtgggggcgctggattgccagtcagactcttcccccagccctgctgagggccatatgtccaggggctctcccaactcatgcagcatactcagaagctgcatctccagccttggactgaaactataattctggcataaaatcccactgagcattctgttacaaaaggaaagaaccaattaagaagccagaagattgctcctcgtgtatcaggtgtcaaggtttataacttataagtagtccaaaaaattctctttggacttttaaaacagagatgcaatatggaaaattaagttcagatttaatgaacatttattgagtaccaactgtatgcaagcacagtgctagatgctttaatgcagattttatcagtcaatttaaccctagatcagctccatttttgagacaataatgatagtattttcagtaatagagttgctatttattttgtgtctgccatatgccaggcactattttcagcactctacacagtcttatcatttaacattcgcaaatgcaaaatgaagaagatattattatacttattttacaaagaaacaggctgtgaacaattatttacctaagggcagttaggcagtcagtaatgcccagagctagcatttaatgaatgcttactatgcatcagctcctcttttaaggatgtttgtggatgttaagatcatcattttcttgatggagaaactgagccacaaagagcttaaggaccttggttagggttacatagttagaaaatggtctgtctggctctgggactcgcaaacttccttactgtgctgaacctttgtggtaagatccacatttgcattcagggcttcaagtcaaagcctgatagtcccttatattgcagtgtcttactgcaaaggaatgaatcgcaaatgataaaatttcattttgtataggtgaattaacactttattctattttgatattgttaaaatcaaaggctgtttgtatcacccattcctcaagagccgtacaaataaagcagtgaggaaggaggatgtctctttttttcctctctctgcctgacatctctgattcatcccagtggcttagcttgagaaggaggcagggaaaagagggggaaggaggatgtctctttttttcctttttctgcctaacatctctgattcatcccagtggcttagctttaggattctttgctctcttaactatctagctctcacagcccacttgcttaattcccccttttatctgtaagaggtggaagcctagaaaagatgccagccataccatagtaagggagactatggcctgtacaactgagaaacaggagtggagcaatgaatcgtgtggagacttctgcgcacccaaaaagggaagtgattctttcatttctctccattgctgaaatctccatggactttcctttcggctacagtcactgtctctgaagtggaatctatgtgataatgttttgagttattgagagagaatccaatgtgtattttttttattaaaataattcacttgttgccttatgcaagtgtattaatcaaacataaaggtcttatcagtttcatttcctagagataaataatgttaacattttgatgtctattcttccagatgttttcctatttagagtataattcattatttaaactgggatacctgagataaaatgccataattatgccgggacaacaggcacaaactaagactatttccaacaaactgagatatataatctccttactgtgtatgaatttttacagctgtgtctacagaaatatctagatacactcaacatgtgttatacatggtgatgcacaacctctaagatgggtcccagtgatccccactcctggtattcatgcccttgtgtcatctgtctccgagtggaggctgcgtttagtgactcactactagaatagaataggatactatggaagagatggcacgccacttcagagattaggttatgaaaagaccatggcttccattttgagtgccctcgttctctccctatgggatcactcgctctgggggaaaccagctgccatgctatgaggccactcaggcagtctatggagagacccttgtgcgaaaaaactgcagttctggttgatagccagtgaggaactgaggccaccaacaaccacgtaagtgaactaggaagcgtatcctttagcttccgatgaccgcagccccagcagacagcttgactacacttcatgagagaccttgagctagagccctccagctgagatactcctggctctcataaactgtgtgagaaagtaagtcttggctgttttaagctgctaagtttgtggtaatttgttatatcataatagataacccatccacatttattaaataaaaaatcaaatcacgtaataaattgtttttaacaatatcctctttcccacccacaacgtctatcagtagataccccacttagtatgtgtaggacaaagcaatactgttttattttttaaagtagataaaatgtaaaatgattttagagttgaccataatgtttctccttttctttttttaaataaaaaaaatgccttaaaaatccttggaaacatgttttttgctcctgcaattatctccacagagtagcttcttaaaggaaagatttctgggtcatgagacagcacatttagatttacactgatatttatgaattgtgttccaattgaagtcatctgttttgtgaccaagagtgtatgagaaagcctgtttttttttcccgatactgaatgttatcaactttaaacaattttgccaatatataggtgaaaaattataattgtattgatgagtgagactcagctctcttttcctgcgaggggcacattcatgtgtcttagccactttcttcttgggtggttcatcttttcttttttgatactaagtgttctttatttgttaagggaatgtagtagacgtttttgtcacatctgttgcaaatatttttctcaatttgtcttatgactgcttacgtttatgtttgaattttttttccataacgactttaaaaattatcaggcaatcaacctcatcagttttttcttttatagcttttgagccttcgagtcatgaatcgtgcagcccaaaacattttcatctggtatttttatgatttaactttttgcatgtaaatttgagatctatctgtgatttgttttagtatagtgaggtagagatccaactttttccacaagatgttactgaaacaaaaacaaaaacaaaaattcacctctccccactaatttgtaatgccaagtccatccattctagataatccaatatgtgtgggtctatttcagaagtcccacttttcttccatagttgtgtctcacttgttcttttctaaagccataccatagctttatagtacattttaatatatgctgggccaatcactgtttctttgtcagaattttctgtgctattgtgtcatatttttctctcagatacaattaagattgttttgcaagttcaaatgattcttgttgagattttttatttgaatttcactcatttatatgttattattaagaactgaaacttcttgtttaagaatatttacttgtatatttaattcttattttattttcctaaacagagtatttagtttttttagaattctatcttttttaaatatttaatttaattttattttaagttctgggctacatgtacaggatgtgcaggtttgttacacaggtaaacgtgtgccatagtggtttgctgtacctatcaacccatcatctaagttttaagcccctcaggcattatctgtttatcccgatggacttttgactctaagaacaatgatttcaccatacagcattgcctgtctgtgaggggaatttttttttttttttttttacattaaggggtttgtgaatgtgaatttatttgcttgccctaactactcttatctcttctggattgttcagaggtgtttagttccctcattacttcaaggtttgctgctgcatattctcctcttgcccttcactataggttctcggtttgaaaggaaacacagctcactgtgagatgcttaaatcaaaagaatctggtttctggaaatgtcattattttaggagggagcacgggaggtagagaaggaaaatagtttagattcttgtggggaaatggaaagcaagaggaaaaatagatgttctgctcagaaaggaaacttctctaggttttaaaaatcagtacgtgttaattttgctatattttctctagcagtgggattactgcatgaatcttactgggagaaagaacggttgctctaaaccaagtcctctgtcagtgaagcacaggtctgtgatgggtggttgggatggggatgaataaggagtaggaaaaatgacagaaatagacgcttcttatttgcaagtgatagaatttacaactctgtttagcactttttttttttaaattcaacgagtcattattgagtttctactatgaggacagcttcaagggagaatataaagaaagtgtaaggcatagtctctgatctccaggtaattgtaactagtgggtcagacaattaaatgctggtacttggtagcagagaggagtgctgaacttaatcttgagggtgagtgggatttgaattggcagagaaacagtcatgcatattctgagcctgagaaaaatctgagaaatggtttttggttgagagttagctgaatggttggtttgagcagcattatgtgagtgggagaaatgaaagaaaaccttgggcggttaggatgagcttcagttggagtttgagagttatcgtcagctctggagtatgtaagtaacatggtaactgtgattaggagcatgaatctgggagaagtacgcctggagccagggatgtgagttaagaaacagtcatgccgagagcccagtctagagtacaaacaatgggaatggcatagaatgggcagatctaacagacacaacagaaaatcctccagaataaggaaatgattttgtaaagtttgtggaagagaaggaagatacacaattcaatactggacaggtttgacactacttgggtcctcttgctctatatcatggaatgtggaccagaactgagttttcttctgctaattgagccagttattccatttttttctttaaatttttctttaaattgttagataggattcttgttgtgttcctgtaggttttatcagttatgcactgaattgtcttcaagtgatcctcccagtagatgctctggtgactgaaaagttaaagctatcaccatgatggcatacgttgaggaggaggttaaacactgtgttaggaggcatactggctggctttcttctctctgggttaacatattttggccttgtgggataatcatgtttgagagttctttgatggctaaaaacataccgtgaagggtagtactagtgagcatggaggaaggagggggagagtgcagggtttcatgtagccatgttgtcagtttctctgtcctgtcccattttgcagcagctgtttgtacatgtggtgggattaagctagcaggagtctggatggatggggaaaacagcttccttgacatccttaattgcctcctttatccctcctcagacaaagcaactcacggttttaaggaccacaaaatgcttattccaaatgcaccccttaccctacaacaaacccaaacatagacacacctacatggaacaaatgcaaccaaaatattttttaaagagatagacattttaaagaatgaaaatttctacatttgcattatgagcaaataccagggcataagttgaacatatctgctggtgtcaggtatctggacactgattggtcagtccatatggcctggggcaccttcctgctggcaacacatgctcatggctccatagacattcctggcatgttccagatatagcagtacctgtgtgaaagttaaaatcattagcgtaaaaattggtaaattggctttatgcataaattcatcaatatgagtgcaattaagtatacgttccagtgattcttttttgttgttgaacatcgagggtatccagcttagttgtctagattcactgaaataggtgacatttgtggacaaatgtttatccaggccctttggcacaggctagaatcctcttgcttctcattttgagtgtatttggccattatcccattttctatgcctcatggtttctgtgtggagataactcctccaacatttgttctgttcctttcctatttccttcattggcaaaactcaagtgtgtttatttggtagcttgactgcgctgagctttcttgcccttttatcttacctgtttttactgttgttgaaaaaaaatgaacttaaataatactactgctgctaatgcctaagtggttgagaaatgtgacagtttccatgcaaaggggtttatatgtatgagctttattagttctctctactaatgtatgagggaggtactatttaatttctattgtgcagttgcgaaaactaaggcttagagaggctatggaacatactcaaggtctcatatgtagtaggagatagggccagaattcacatttggtatggcctgcctccatgagctcggactctaccagcgcatttatagatgattcatatttaaactgtaaattttacagatatgtctcaaatttaaaagttattccaaaattatggcataaaatatcaatgtaaattatcatctctgtataccaaagggttagaccagtaattcacaagaaatgaaagttttttgctaagctaactaaaagttctgattaaaacttttagaagacttcggcattgaaaagaatatggtatactcagtttagtaaagttttgcttgtgtccatcgggaccactttaatgcttttaggaatttaaataccaaattatttttacaaatttattgtttttttttttttttcatttccgtgacgcccctacttggttgccacaccaaatacaaacaatctgcttttgcttaatccagcaatgactaatttatatttaccaacaagagcaatagcaattgaaaatcgtagccaagtccccataacactaatgatgcactgaaaaaacatgtcttttccgacaattgtgggaatttccaaaccgtgcatgtgtctgtgcacaaaggaagcattgttctgttgccaactgctgctcagcagccaggcttctttggagaatgttgaatgagaatccttggtaaactctcacatgtggcagttctggtgtttgaatactgaattttaataactcttaaaattaacttagtagattgctactaggtggtcctccatcacaaataaaaatcaaagtctggggaaagatgtgccattcatttattagaacctaagaagtgtcttttggttttcttcacttcatgtcctattctaggaccctggtaggcagtatcctggccaaaggtgatccaggagaaagagccaggaggggagattttaacagctggttagtttatacgtttatttagaggagagggagggttttattaatgttaaccctctacctttggggcaacacactagaatttatggggaacatcatcagctcatctcagttgtggtttatgtacccacaaagcctggtaggttgggtgcttatcagcatcaacattttagaaaggagcaccagagaaaaagtgtaggggacttgcccactgactaattcctcaattttgacagtcaccttcatcctttttgactatgggatgaagcctaaatttcctagccagccatttaaagtcctttgcaatggaggtcttgcctactttatgcaattaatctcctacataaactattattgtttatttgcttgctgtgtgtactctgctgattgatcgtgccaagtactggtgattctgttgatgcatcatgcacagtttcccaaatttaggatttaatgggctagagaattgccaaataaataaaaacatgaatagtgttgatgattttgtattacagcaataaggaaattataaaataccaccatttcattgaagcctttatatgttaacattttaaaaagtagaaaggacatcatctcagaataaagaccactaattaaaataaactatgaaaacctcacacattgcctatattttcctcattttgccagagacaattgaagaaatagctgtggactggcactggcctgtggtgtttgggaatgatgttgcttagccttttgcttgtctgaataaatccttctagtccttcgattctcagtttacaccttgaccttagaaattcttctatccccctctacctgctgtcttgcaccccacccacccttccaattatctctctaggtggcagtctgtgtgtcctcttccaagtactgataagatgtgctgggataatttgctgctgtctcttgccacaagaccatgagattcttatggacagaaactgcatcttattcaccttcattcccaaagtttagcacgtagtctttgacacacactcagtgcataataagtagtaggtgaatgaatgaatgagtgattacctggatgccctgcctgttctttgtgttttgcatgtcttctgtgacctgcagttttgagcacatgggatttattgaaacaaacactaatattcattaaattgaattaacttatgggttttgacctcatcagttcttctatttttctttgctgaagaaaactaattatgttctccattatcagagtgtctgggaacagtctgcagctgctgtctgaaacacttacaggggctataatgcgtgtctcagctcttctgttcagcttgtgtttttctttagtcaattcattttgggttgccatgttgatttatcatatttttatttatttttatgggaaaaggaatgtacgatattgtaagacatgctatctagtgagtgtagagaaaagtcagcattttttgtagtctgatttttctaaatccaccgaggcgtatatgctttgcttttatgttgttattgtttcttttttaaaaaccacacttgtatttgccttaaacattttttgaaatcaaaacaacatatccagaaagcatagatgcagcttctcttaagattcagtggtgatctgagctgtctcatttggggacatatggtctctaggcaatcgagttactgtattgagcattttcccagctcacaagatgactgtgacgagttattgcactgactcttgctcagtcacagggggaacctgccactttgtctttagcacagacaggccccttatagacacaaggttgtgcagccactagagacctgggcttcagctgggcttggatctatgccttgaaagaaacagatcttctttttgaaactctcttgccttccttctcctagtgttttattcttttgttaatgaaaataacccatattcatagagtcagaataacaattattgatgggcacttcctatgtactaggtactttatacaccttatttataagcctttcatttgtaatcagctaattttgtccttattttataaatgagaaaactgaagaccagagagttgtatttgaccgatgccatagagcagtaagtggtagcatcaaagctgtgtaatctccaagcctctgttttttccatcacatcagtctggcttccttcttttataacctggatcatagctgtgtcattttgtgcagctgcttaactcttgtaaagataaataaaagtacctaattcataggattgttttgagaatgaaatgaaggtaatatatatgaaaggacatggcatagcatctgtgcatagtaagaacgaaatatattttttaaatttcttcttctttttcctgtaggccctcctttcttcactgatccagacctacctttctactgccaactaaagaatgatgagattcaaaaatttggaaaggagagctttatttctcataaagtgttgcagcctgaaagtggccattcttctaggtttggaagcatagcctcccaccagaagccagaaacagatactttgagagaggggcaaagggatcaagaatttatactgagcagagtggccaaatctacatattcaataagctacagaaagactcatgaatattaatgaaaggagaaacatgtacatgtacaattgagcttcatgccccttcttgggtctcatgtgcaaaaagcagtggtgttagcatgatctgagggtggagtgtttggccctctgatgtcaaaaggtgaagcagaggacacaaagacccttactgtgcattctccatagactggccaaaaccactctgtagtcggtggtgtctcatcaggcaaaaaggaggggcagcgtcagatggatgttggacatcagtggtggagttctttgaaagggccggtttctctttagtctttagggaagaaaagctaatggtagttagcgagggaggaggtctagcaaggtgtgtccaacttcctatccctcgtcatggccaagaacttagttttcaagattatcttggggtccccttcgccaggagagtgtccattcagttgcttggggggcttaggatttcatttttagtttacaatactttagacatctcctgatggtccatcgtaggtctgttctcttttgtatctcttttagagatattagttttcttgggatggatataaggaatgtggctgtgactcaatccttcattatgattagaataataaatgctgaggatcaaggtgtaagccttgggacaatcatatttaggtgatgggaggaaaaagtgctgttttatcaggggagagagaaaaagcacttagagaggagttgatgatatgtaggatgtgagactgccgtggatatcagggaagggagacttataagaaggagaaatttggtcaactgtgtcaaatgcttcagcgatcaggatgagtaatgaggaacggccatttgatttgatttgatcattcagatatctttaaagacctttaagagggcagtttcagtagaggtaatggactggaggaaagtaataaggatggtgaagaaatagaggcggtaattattttgagatatttggtttgtcaaaatcagagagattttatcatatcttgaagagatgtcatatttgaaagaatttttctttaatttagttgagaaataagtatttttatgggcaaaaattaaagatctagttaagaaggagattttgaagatgtcagagagcagagataattgataggtaagtgtgtaccgattttgaagaaaggctgagaatctaatgtcaagatcacactgagaaaactgttaatagtatttttctttgtatggttatgttcttttttaacttttaatttcttctttgttatcttttatatcttctagattttctataacaagcatctataactttcaaatttttaatagctcttaaaagttaagcagatttaaaatgataaaacatgttcatgacactaagaaactataaaaacatataagatgaaaattataacttcccacatgccctaatattttatttccatttctttaaagcaaccaccatcaaaaatttacttggtaatctgggtgtggtggcacatgcctgtagtcccagttactcaggaggctgaggcgggagtatcacttgagcccaggaatttgagacaagcctgggcaacatattgtgacctctcatctcaaaataaatttttttttcttggtagcccttcagtaattttttatacacgtatgttttaaaatcagaaaactgtattgaaaactcattagtaaagaagttaagcttgaaaaggataataccacctggcttatgattttctgatccctcttgaaagactaataacatgagaagagaagaatgtaaataggcataaacttgtaagaatgaagatagtggaagagaagaaaatagcagacgaaagacatcaacaaaatattaggaggtgaaaaacagatggcctagtgatatctgattaggagagtacagaaatctacaacttcagtactcacaacacgggaagcagtaaaaggaagtcagttctgttgcaaattcagtgctgatgtcactaaaaccaggaagatgggctggaagtgtgtctgctctccccctacccacaggtgcaaggagttgccctttcccatctgttagaagactggagatgaaacagagaggcactggacttgggacattagctgaagacaggaaaggtcgtatcctgaagagagagacctcagaccatcttatcacccggctggcagaatgttagcaactaggcttaaaccataccaagatattggagggtttctttctggggagattgactaggccaagagaaaagactgctgttatgtggagactgacatttgtgaaatggctgagtccccgtggatcaacctctgatgaagcccagcgcttggtaattaccacccaagcataaagatctttcagtcagctgtgtagtgcctcattctcaaatgtaaatggacagctatggatcagtaaatatttctagaaagcctctcacataaaaaaacagagaccaaacaaagcattagaaaaaacacagaaaacagacaagcaggaggcagaagaatacacaacaaatgatatagttatgatccttccaaagaaaatatactgctttcacaaagggtaggaatctgtgcaaatagaaccctttgaagccaagaaagactttttgttcttaaaaaatgtgatagtagaaattaaaacatcaacaaatggattagcaaaataatgtttaggaaatcactcctgaaaggacagaaaggaaaaaaagtgataaaaatgtgagaagtatggataataggagttccagggagagaaatataaaagagagggcagaagttattaaagaaacaataaaaggctgtttccagagctgaaggacctgttttctggttgcaagggaacaccaagtgtccagcacaatgaatataaaaagacatatccaaggcatattagtgacatttcagaatccttaagttaacatcttacaaacatttaaagaagaaaaatcattataataaaatggttacttctaagaatgatgtcagattactgaatagaaacactgaaagtcagaaaacaatgaataatggcttcaaaatctaagggaaattatttctaaacattctggaattttgttacccagccaaactaggaagtggtttcaacatccaaagcctcaaaaattgtactttgcttgtaccctttctcaagaaagaaatagattgtaagctattccaaaatgagggcatactaaaaaaaagaaagaaagaataaggtgtgaaccctgaatatgtgagacaggtctcagttaacttagaaagttgattttgccaagattgaggacgtgcccatgacacagcctcaggaggtcctgacgacatgtgcccaaggtggtcagagcacagcttggttttatacattttagggagacataagacatcaatcaacatatgtaagatgtaaattggttccatccagaaaggcaggagaactcaagcagggaaggggcttccaggtcacaggtaggtgaaagacagtgaaaaagatatgacctaactgattccatcttgcttctaacctccaagctgtctttgttcattcctggactttcggaggaacttagtttatagtttagttttgaaacaaagatgatgatagtcctttcccaaaacaaaccttcttactgcctgtggactagactgcccaaaaccacaagattagaagttatggtaattttactaaataattcaagatgtagctattttcattaaaccaatattaatgtcttatttattaaaaattacccaagcaaagatcattctgttttgggctgggtttatagttaggtaaccccaatgccaaattttgacaccttatagaatttgccagggataagtatgagattgcttggtcaataaatgcaaacaaaaatgtatgctaggctgggcatggtggctcatgcctgtaatcccagcactttgggaggccgaggcaggtgggtcacctgaggtcaggagttcgaggacagcctgaccaacatggtgaaaccctgtctctactaaaaatacaaaaattatctgggcatagtagtgggcgcctgtgatcccagctacttgggaggctgaggcaggagaatagcttgaagccgggaagtggaggttacagtgagctgagagcacgccattgcactccagcctgggagacagagcaaaactccatctcaaaaaaaaaaaaaaaaaaagtatgctggaaattcttaagacaattctaatattaccgtacctgtaattttaaagctagcttatttattaaagattctacttaagtcatgtacacttgaaaaagcatttgactagtctatccttttttctgataaaatgtttgatttaagcacttttatttttctttaagcccattcattagagctcttttatatatttttagcagtgaaacattgtgtacacagcacataaataaagagatatattaggcataccgatagaagtacatttatagattcctaagacctcttcttttgtgtttttcctatcttagacttgcaaactcttgataatctgtttcatcactctggcagttgtcagctaaatagccctaaatctgcatattgaaggaaacaactcttagtgaaaaatcagatagcaaaatttacatctcaaggtactgaaagaaaaagtctggtagagctggagagagattaaagatggatgtcaagcacaaaattatacaaatctaccataggactgtaagaggagaccagttttatttagatagggactacttgtcttttaactggatctgagctctgggcagagcccacattgaatcctgggtctccaaaaaaggagaattattatgaggctagaccatgtgatgcttttacagtgcactttaaaaaaggtttttttaaacaaagacttttctgagtgtctaaactacactctccctaaaaacctgagagtagcctctgttgcaataattattttagtcaataaatcagataacaaaatacaaaagcaaatagtttaagagttgagatgaactggtctgtttatgctcttgggattccataaggaaaaaccggtttctcccccaaagggagtctggcactttctctgttttctttaaggctgttataaactattttaggttcctcattcagcagagggtgcaagagaaagaagagacagaagaagtaaatgaagaaaacagaattcagtcaactgagaagaaaaaaacttttgctcaaaaaaaaaaaaaaaaaaaaagaaaaagaaaaagacaaggtcctaggagaaaaaaaatgccaacatgaaggccttttaaatacaaacacatagacacacatgcatacatttttggatgttagcttgtaattaagctgacttttaaccactgagctccttaaaaaaaatctttttaaatcttatgaccgtagttcagctggaacaaattgctgttattttagaagtaccaagtatcaaaccagaaagggcttgatttaggaaacaaacccaggctattgtggtggaaaaaaagatggcagaacccttagctatggaacagcagcgtgagacgacagccattgctcttttggttggcctgactagcaaaaaggtggccttgttatgtaaataaagccttttaagtagtcaaaaatgaaagtcttttctgttttttgctgttcgtttttctccctgtaccacaccacttttgtgtgtgtgtgtgtgtgtgtgtgtgtgtgtgtgtgtgtgtggcagggtggtggtggtggtggcggggcggatttagccacttcagaggccttttcccataatttggaactttccttctaatttgattaagtcggatggagttgatcaaacccaatgggaaaaagacggaaacaaccacaaaaacagaaacaaacaacaaaaacaacaacaacaaaaaaagttaagcaaaacaaacaaaaaacagttaagcaaaacaaaacaaacagttaagcaaaacaacttatacaactattgagcattctaatgataaggagcaattaaaaccagctggttgttaatcttaactttagccaaaaacaaaccccgattcagttacttacctaggaatgggtctcaggctgaagactgctctctaccatcctagaagcaggaaaaatctcaaattcatcttccctgttggaagagagttcagacatcataaaatagttacctctgccttccattgccaaggaagcaggaaacctgctttccctgtgtgggaagcaagccaaattccaaaaaaaaaaaggagttgtatggcaatataaactttagatcttgacctaattttgggagatcagggattctctggagggggctctttcaggcttcagcaaattgtcctaatggcctgagccttaaagctacctctagctggtaccaagcaccaacagaagatttggcaaaggtcagaggcacctccacttagaatctctttgtggttaccaaaatgtgaaccctgaatatctgagacaggtttcatttaattcagaaagtttattttgtcaaagttgagcacgtgtgtccatgacacagcctcaggaattcctgacaacatgtgcccaaggtggttggggcacagcttggttttatacacattttagggagacataagacatccattgatatatgtaagatgtacattggttccatcaagaaaggtgggacagctcaagcagggagggggcttcaggtcacaggtaggtgagagacaaatggttgcaccctttttgagttctgattagcctttccaagggtgtcaatcagacatgcatttatctcagtgaggggagggatgactttgaatagaatgggaggcagctttgccctaagcagttcccagcttgacttttccctttagcttagtaatttttagggccccaggatttattttcctttgacattttcccccttttcttttctaaaatttttggagaaaacattttacaagaaaattagcctttggtctcaggttttatctgatctctcatgtctgggatggtttattcctatataggtaggtcccgagttattaggaaagctcatttttagcaggttgagaagtctcatgctctatgaagagaaaataggggaggaagggagaaaaacaataacaaaagaacaatcctggaaaattggtataggccacattactctgaagtccatacatcagtaggcaggtatgaaagtggcttatgtgtgtaaataggttgctgttattttcttctgaagtttatttaagttgtctaaattcagttagcagggctttaagaaagcaaaggttagtttttagtgatttcaaattaggaaaattggggggaaaaaggaaaagaaagaaaaaaatcgaaaacatcatttttggatacttgcagccaggaaaaattagaattcagtctaaacttagaaaataataaaaattgaaaaaccttaggcaaaactggaatctaacatcagatgtactatagtttttgaaacataatttttctgtctccagtttcctatttttactaaagacaaatcatggtaggactgatttgctttattatattgcccagattatttgtataaagtacagcaagaataattatctttcacataggctttttatattggctttgatggaactttgttccataaaaggaatctcagataagatttttttaaagctgagcccagccatggatttgtaccatcaaatacctatgagttggatgaattactctcttcttgaggttccaaggtattaaaaggctggggctcctgagcctgccagaaagtgacattctttacttaacacaggtcaggaaccctgtacaggaactgcatagacaaggtatgaggccagctttcccaaaaggcttttattggctttctaagccaacttcgattccttaaaggaaagcacaccatgccagtcaaagccgtggtaaaataatcagtttctccaactgtgtcctgttacaaatgaaaacatattcttattgaacttatgcaaataactatattgccataagttaagaatattcacaaatagtttctgaattctggagaaatcaggtggagagaaataaatatgctccaaattttatttataggagtatacttaattgttaaaagctgtcaatagctcaaaaaaaaagtttcctttactctgaaaaacaaaacaaaggatcagcaacattttaagcaaaaagtcaaaaatattactccagtcttctattagtttagtctgtgcagttaatacctattctgcttgatattcataaacatttcagctctccatgggtcctgaaagttttaccactattctgatgtcacaatctccagagttatcagacaccttcattcaagagcacttgttagagttttacagctgattataaaaccaccttctaaggaggatcaaaacaagacaataattgtccatggatgacaaaaagttttagggcagccatagtcaaagacacaattgacaaagaaatttattacctctgtggcacacaataatttattataacaattataattattactgaaaatgtacactaagtcatatcagaatgataggagtgtctcataattttggaacacataccaataacatatttatacaaatacaacccaaagaaaaccaaacaccatttcagatttgacgatgcttcctatataatttttataccaaatacgtcaaatatgtcaactttggactttaggaagcctaacatcttaaaggattaattaagtcagaaaaatacaaaatttataatttgattttgagaagtttgtcaaatatcaaaggttaagacatttgctatcacaaaattggatcacaagtcattgtaaaataagtcattcacttaaacaaaatgataactcaaggatttcaacaaaaggcaaaaaccttcagtcttcgagagaggagacttagttttccaaacaataagccctaataaaaacagcacgaagccaatgaaacttgtttttcaaaattttataaacaatctataaaattgtaatcttgaccatgagatataacttcaataagccttttataacctttctaagttttattaaagagtcagttaatgcttcaagaaaaccttgctaatctgatacaggggcccatatgttggtcttgcattagtgtgcctttgacgttaatggttaatttactgaggaattgaacttatttcatctctcaatattggccttacaatctcacatacccacctcttctgcaatagtccctggaccttgaggagttgaatagctttaatttctggccttgtgtctcaggaatgcagtttattttggattggcattttatagtgggcctggagatgaggctttaattgctttcagtttttaagatttagcaggacttggtgtcctttttagacccaggagtcaaagccctgtaactcaatttcacgaggactttaaaagcacataaagatacacagatgtaataaccttaattaaaaaataattcttttaaatcttagttttatttctaagcaaaccaaaacttaataataatggcataggaataattttgataaaatgtaaaatctgttaggcctgttaccaaaaggcaaaagaaaagactttctgtagtgcacagaatatattatgttggaagaaatcatttccttcagacctttaagaaaacattgttagcatcaggccacaacaaacagaacttgaggggaaaaaccttatatgagctgaaaatgagttgaaggagagtgtcagtattttgtggcttttaaaaggggagagaaaactgaaaatggccagatgcaataaaagttgaactttgggttaaaaaaattaaaatctcctataatttgttaagagtaagtcaatcccttaagaaaattttattgttctaatcaattttttagtgtattagtgttcttttacatcaaacccaatctctagaaagaccattataatttccctttaattatagacaacttgatcatataaaaatttttttaataaatcatcttattggatttatactctatacattttttaatacagcctcttattggacttacacagactattcatgacatgcttggactttctggtttgtcctgaacatccctctttcataaacaaccagaccttttattctaagactaaatttactatataagattccttctcatataaaatgatttctctttaagctttcttaccagaaaatacctctttatttctataactttctttacatctgtcttatttcctggttctttttaccttgttttatatacaacagttaaataagctttgaattagacaaaaattgttcacctctttaaaaaggacactttttttagaaagaatgttttcctacaatatatttttattggaaaatacccaaataatgaaatatctattatttaatctaatataccttcagattctaaattatgacaagtttgtctacaagtatttatcccattacatttacctcattatcttctcagcaaactgaaaaaaaaactccatttcgtttctcattttccttcccttttgccagttgtcgcttctttattcactccttgtcaaatgattcattccgtctacatttgtaatatcctttattttctcaatgcttccaagtttaaaaaaaaatctctacttttgtttttgtttctaagcctatgcttctccttaactgttgctttcaagtctctcaatacctttgcacttttctatcaagatggccagtgatattcacaaaacaatattaagtacaaatgcagtgaacacagcaacaagttgagggataatgggtggatgaggtggcagtgcctgcctgactgttttcacaatatgttggtgtggagctgagttgacccactggaagtagaaaatagctttgtttatgtctatgatcatttatagggctgatgtttaaaaagaattacctttatgtgatataaatagcttacttcctcatgatttgacttgatatagagaaagaatattgagagtaggaaaaaaccatgcacaaactccactcaacaacaatcaacacagacttctgtgaccaaatgtgtggggatttctccctaccaataagaaagcaattgattctgtggtggacccagctgggtgtcttccaattcaatttcaacactgtctacctagagatagagtcatatcccacaggatgagggtttagtccctgagactgcccccgactttagatgccagtgacaagccccaggttgttttaccagtgcatctgactgactggctataaattggggattccacaacctcctccttgggttcgattaatttgctagagcagttcacagaactcagggaaacacatttactgtttattatacaggatattatgaaggatgcagatgaagagatgcatgcagtgagatatggaggaaggggtgcagaatttccatgccctcatgaggcacatcacccttcaggaacctccaggtgttcagctatacagaagctattcaaatcctgccaatttgggtttttatggaggctccattatgtaggcatgattgattaaaccattagccactggtgatcaacttaaacttcagccaccctttcctccccacagtttggggaatgcagcttaaagttctaatcctgtaatcccgctttggccttttaaatgatcagcccccatcctgaatctacctaggggtctctagccaccagtcaactcattagcatacaaaaagacatcatttttgagtttccgaggattttaagacttgtatgccaggaaacggggtcaaagagcaaatttatatttcataatttcacaaatataaagattctagctcccagaataagattcagctagcatgttccttaatggaaagtggatgacagtcagttaaaggttgttgacaacctgaaatgctgatattctgtgctgagtaaagagagacccatatgttttagacaagcaggtggcacagttaatactctgtaaagaaagttgggaatctttgacttgtgtttacacggaattccattctgtgaaaatggttcatagcacaaagccaaagtttttctcagaaaataattttgaatcttacccacagaaataccagaagtgtatgccatgaatcatgaaagagacaattaggatctggaaaaatttcaggacagacgctactgtccagtcctgtatctagtaggcagtgcagctgggatgagtccatggagctgactccagggtcttaccctctgaaatatgtcacttcccttatcatcttaatgtttgctggttcagttccctgacttaaaaaatctgtataattcagaaatttataatgctgtttctgtatcttttttctcttcctttaatttgctttgcctttcacaaacttctccccatctttcacagacataatctcagatctaggtgtcattacaacaagaaagaaaaagtgtttctgaatggagttcttatatctattatataatgtctggcctccccagtgctattcaggagcaccgtgggccatgattggataaagacatccccgctgcatcccaccctgctgtgtaaacacgtatattcgagaaatggttcaattataagtcactgcctgcagtttggagcatctgctacttgcgcacatgtctaaaagcccagtggagtataggtgttcatgtggtgactggtacttgtgatctggaccgtattttcagctgttcttacgatgactgcccaactactgcctctctctgagtggatggacctgcccacccctatgctcctgctcaagcctccagaagtgaattcattgcatctctccaaacatatgttttaaacttcagaccactgaaacacactctccagatgtgatagatacccacttccctgtttttctgtgatgccattaacagacgaacagaattttattcataaagatacgaattcatgtataacagaaatattttcttgggtgggttttctcatatctgagcatggtgttaaatgattatgaggggaatcaaaattgaagagtctaatagagggatactttgctgtggataggacagagacaagagtgagagagggtgggcttgacggggctggttagagaaaatgttagaaatatgtccaggagagaaacaggcatccactggaagattttgtgaagtttctgttgtgcagtggccccacaccctccattgcaacttctagtcaaattcaaatgtcttgctgtgcttttggagttggatttattcttgaggatctgtaagggagggcagattcttctccttttcacttagagtaagtgccgcatgcacccaaccctgtgtgagcctctcccccaatacaccagtccgtcccatgctcactttattctagattcgctggtttccttgatggcctttcagcataccaggcatgctcctctttaaggcctctgcacttgttctttgatctatctggaatgattttgaaggacagcagattatgccccccaaaacagaccactatcacacggggatgacttcaagctaaagacacttgaagaacagcagatgtgagaaggacattcttatcttccctttttcttcctgaaggcaggagattaaaaactcccaggtgaaagctgccctccatatgctaggaagaaagaaacattctttgatggggagtcatagccaagagaattctgtacaagcagactttgttaaaataaatcgtcttcctttagccttgccatagtttagttacttttccacaaatgggtctctttgttcagccttatacaaaatcaagtaggttctttttgttggttggttctgaaacagggtctcactttgttgcccaggctggagtgcagtagtgtgatcatggcttactgcaaccttgaactcctgggctcaagcaatcctccaaacagcttcccaagtagctggaaccacaggcatgcatcgccacatcaggctaattaaaaattttttttgtagaaacagggtttcaccatgttgcccaggctggtctcaaactcctgggctcaagctgtcttcccgccttggcttcctaaagtgctgggattacaggtgtgaaccacagtgcctggcctgcatgtaggttttgccatgtctttgagtcctacttttcttatgagggctcccatatcctgtaaaacttacattaaataaattttaaaacttttctcctgttaatctatcatgtatcaatttaattctcagacccagccaggaccctacgaggagacagagagttttgactccactatactcttctttcagatattcacatggctttcttcttcacctccttcaggtctttactcaaatatcacccggtgaggactgacttagccaccctgttaaaaattgcatctttcccaattcacccaagtaaattatttattttgttttcctgatttctccattagaattagaaggcaaggtgtcccccctacctctgcccctggtttattcactgccttatcctcagtgcctagaacagcactaggcacatagaagttgctcagcaaatgtttgttgattgactgaatgagtgaggtctgaatgggtccagtcacttccagctactaaaataacaaataagtggttctcaaaagataatactagaatctttctagctgtatagatcagtaagcctgagtaggaagactgaaaataagtattcattgaaatccttcctagaaacattgatattctttaatccacataattttgtgtacttgttcaataaattataaaacaaatatgtattagaaaaaacaaatcctccttaaaatatttatatttcaaaagttccttctttcaattttctctgcccttactagagaaacacaaattacacatggcactaatctgcctttctttggaacacatttcctttatcatgcagtcatttcaaatgtgaaaaataaaatactgctaaatacaagattactttctggcttaagtagtggataagagttgtttttctctgtgtttgtagttctggcaaattatccagaagattaatctttgaaaagactttttattatatctgtagaaaacattattttgaagcaataatctaatgaaagtacttctccttcatacaatttaagagattttgatagaaaaataagatgaatacaaatctctgctctatatggagtgtgtatttcggcctattaggtcaatgatgttacctactgcagggaaccaatacagttgccccaatacctggggcaaaggtattgtctttgccccagaggcagtattatcaccacttgcctccattccccctccatgagcaagaccctgctgcttgattctcaaaacacaatattagaatctttctagctacatagactagtaggtataaacagggagactgaaaataaacattcactgaaattcttcagagcagcttctgccacttcttgttctagatcatatagaaaatatgtctgggccatcagccagcagtgacccttaaaaaaaaaaatacctgcttcaaaattgattatttcagacagatttctttaagtcaggggaaaaaattagcatatgctggcccaaactctactttcatgtgaaatctgccgcttagtttttagaataagaaacttctctgatttctatgtaggctactaggttcttcacttaaagaaaagcccccttttgttagatgcttaacttttcagcttctactctttatatggtgaacgtacaacttattattcagaaagggacatgtttgagaatagaaggagtaactattaaaaattatggccagaaaaaatttataaactgatattgtgtgaagcaaacaaagttgtattgtctctaactattaagaaggagaatgaaattacttactgaggctatataatgtgctaagtgatttatatcttttacctcaatttcaaaaccgtcctctaatagaggcttgggaacattttcagtcatgaatcaggctctgtgacattaacccaaggagtcaacaatattgtagtctaaaagaaattttaggaactcagctcaggacactttacaataaggactattgatttagctgtctgcaggaaatgcattagatacacattttggctgaaagccaaatgttaaaatcaataattgacaagtcagatatcattagaataggaagaactttggggagacaagattaaatttgaaaccttaccaaacattttcaaagtcaacatttggatgtttgacaatatagtgaaggaaaaataatttctcagcaccatccactggtggattattcctgtagtctctgtgctgcgtgtctgcagtcctacagacatgcctactttaaccagactaacatttagcatacagtggcaggaaatgggattcgctgctcagcaaataccccaaatcctggatcttctactactgaaaatgtttgtcagtctaaagcaattattttgacaagtgtttgtttcttagtctcgaaacagacaacacagaagaaaactataaggaattgacttcttcaatttgaattttgattgtggaagcaaaatgcacattgcaattctctgctttctctaacactgtcttttttcttcctatttgttatttattcattcattcagatttattcatttattttaattatggcttttagattcagagggtacatgtgcaggtttggatatattgtgcgatgctgaggtttggggtacaaatgattcaattattcaggtagtgagcatagtacccaataggtcgtttttcagttcttttctcccattctttctcccgctgctagtgctccccaatgtgtattgttctcatctttatgtccctgtgtacccagtgtttagcttccacttataagtgagaacatgcagtatttgttttctgttcatccattaactcacctgggataatggcctccagctgcatccatgttgcaaaggacatgatttcctccttttttatggctgcataatattccatccatatatatgccacattttgtttatccaatccactgttgatgagcatctaggttttcaataaatatttattaagcacctttataatgtctcagtcagcatttcaggaaatggggatacaacagtgaacagaagatagaagtctctgcctttatggagtttatattctgggtcttagggatatagacaataaacaagactataaattaaatatatagcatataaatagttttaagtgctagagagaagaataaagcagggaagagggatatgaggaattctctattgtgattggatcaaagatgatttctcatgatattatttttggagtatttattcctcatggaactttttgagggcagatttaacatttaactttcagttcttcataacaagatgtgaagagttccaatttagcatttttttttccttgaaaatctcattgtctaaatggaattaaataactgaaaattaaatatagttcttcaaagttattttgtctaatgttttgagtgtcagtatgtaaaataattctatgaagacctgacttatttaatctcaactctgttattctgctttatattatttaaaattttataaatattcgttggcagaataattatgtggtatttttcctaaggttatattccagacacgctctgacttaatatttcctttaactgacaatttactctcctaggtagtaaataattcctcataatttttttgtacataaaactaacagctttcataataaatttattattgcagcattttcttcttgcaatattaaatattcacttacacttcacctgactgatagaatttcaacatagaaagcacataaagagattgtcactgtttacccctatattgcgtataagaattttagattgcatacttggttacaaacagtaaactctgatgacactccctgtttgtgctgctcacattgataccctgattagatatgaaggggacatgcaagatcaaatgatcatttgtcacatgcatgttcagggatgccagcactggcattgatttggatgtttgtatatctgactatttaaccttccaaaagctaagtctaaatagctacagtgtaacagtagattttggccagatactgaaactgaggtaaattcttgcccacccctcctgtctcaaattcagtcatctcttggaagggacacaaaagtatcagtcattggagtggcagcctcccaaccttcttcctgcctggtgaccaaagtgttgaacatggcatctgaaagcgtcataacaaggttcactctgatcctaggcataattaatggagtggttggattttcatccttctttgcctgttaagtgtcctcagtatctgtcttcctagtcggtaggcacagtcaacagatgagggcttcttggcttaattgatcttatgaattccattaggagggataagaacctgagtgatgttctagccagtggctcccaggcttcgtaagtatttacctttatgttgcggttatagcgtcattagctacaactattactgaagcttgaattcaaataaaaagcaattagatgtaattccagtactcaactcacacgcaactgaaacttaatgatctggcaatttgaacatgaatatgaaaaaggaattcctttagcttttttgatcctcttattttattgtctgccacaaaagaaaagcaaataatacacagcatcagcgcaaagcatgaaaaaggagataggagccaaattcgctaaaaattctaaaagctggtctatagctgtgctccagaattacctgaaggttagacggacgtgaagtccattatttaatctgacaatttcctagacatcaaaaacaacaggctgcaaatctcagatcaggaaacccttcctgcaaccctggatatgacttaatgtcctcctttttccaaacaaccacagatgtctgtgcacatctctgctgtgactttggtcacatctccctgcatacacaggaagtcacttgcttgttggtgccccttttcttgattatgttttcagaaggaagatctggttttaaattccattttatatcccaagaacctagcacagctttaggtaagaactcagtaaaaatcactactactacttctaatatgactactactattagtactgcagctggtagtactatagtactagtactattcctgtttttgctgctgctgccatatccagtgtagctggtgagctaatgaggaccccactcaggcacatgggatatgcatacacatttccacattgtggtttctttttagccaccctccagagatggtcatggcagagggaagatgtggagatctggatgaagggaaaagtttaagagtttatgacagaaaaaccactcatattgcaaatagtggtatgatcgctgtgaatttgctatacctcttggatttaaaaatatttctacacatgtgaaactttgtattttctatggcgtatttgttttcccccactaaaggtatgagtgccctagcatggtgatgctgtaggaggagatgtgaatgtgattcaacataatctaatacatattttatcaataattaagaaaacatttgctaagctaatgaacttaaacaagtctctgggtctcagcgtcagtttcactgtccataaattcagaataatgtaacctgtcttcttaggctattttgaggatgcaaagaggaaacaaatatgaaagcgatttgcaagttgccaggtactaggcaacgtaaggtgctatatggctgtgacaaattttccttctgaacctcctgtagcactttgtacagaatggcaagttcagcttggttggaggccagagccatggtcttgttggaaataagtacctgatgtgaggtacaaagacctggaagcaaagccctgccccaccgtttccctagttacgtgacctgagataaattacttgagaaaagaatattaaagtcatccagctcatgggttactgtgagaattcagtagaaaaatacctatgaaggcacctggtgtactgcggcagttggccagtgtttacacagcattttttttagggcagagaaagatacaaatgaatcaaaatggttctgagcaggtagctcgcaaagaggagaaagcctggactctgcggacctggcttcctgttctgccctgtgtggcctgagcaagtcctggaaccgctctaagcttgtttcctcagatgagaattgggaggaatcatgatgataataataataataaccatacccttaattatctcttagggttgctctgaggactaaaaaatataagatatcagcagacatgggataggaactaaaaatttagcctatcctccccccagatttagcatcgtgctggtgataatgctccttatttttaaagatagtcttaaaccatgtccaggtgttttctgttgactcaataagagcctaggatgcacttctgacaaaatgtttgcagtccagtataaaactttaccttagccaggcatggtggcacatgcctgttatcccaaccatttgagaggctgaggcaggaggatcgcttgagcccaggagtttgaggttgcagtgactgcattccagcctgggcaatagagtgagaccctgtttcaaaaaacaaggacaacaacaacaaacaacaaagaaaacctttaccatctctggaagccaccttttgggtggcaaaacaccaataaaaatgaatgagggtggagaagaagaggaaagagaagcagctaatgagaaacggagggccagcgtaggagcaagaagagacactcggtctaccaagtttgataagatgaaagctttcttcccgagctcttctccccttgtctgccttgagcccttctcttctgtccttctttccattgaaaccttcacgaaggcaaagccaacgaagatctcagagagtgcaaggggaggcacagtgtggcaggaagagcacctcccccgcaggctgaggaagcttgcccacaccgcggggctcctgcagctgcagccttactgactaggctgattcctggcaacaatgaggctgggacggtgtgacaataagaaggagaacacctaccacgtattgaactttcagtgtttgctctaccagtacgttctcagtgaactctcaacgaaagtctcatagggcagttctgcagccccttctctttgcccagtcatggagttagtaagctgcagaggcaggacttgaagtcaagtctcccactccaccgtcccctttcagctaaagatgtctgagcaagcgtttctgggtgaggtcattcagaagtggtttatgccagcaatttgttttattcatcttcctagaggaggaagtggtgaataagctcttttactcatgagtaagtggaatttatttctgacagattgttaattggagggtcgtataaagatttccccatagaacaaacatggcttagacttgaggggctagctggggagtagcctgcaagtcagcccagaagggtgaggttaccccagtgatgctggtgcttcagacactgagggagctgggagaaacttctgtcaaagtcatagagctcatcacggtgtcaaacacttctgagaggccaaagtgagaaccaaaaaggcccatgaggtttagcagtgagaaggtaggttgctctccagtgtctgagatcacatcattcatttcattctatttctactcaaaagattttcaagggattgttctctatcttgtcaccagttttggggagtgcactctctttagggtcactctgtgtattcccctgccatacagcttgctggaagtctcttttcactgaatttaaccacctgattgttaatgaagatagagatgcacctctgctgtagctgaatagctcaacagtctccaaagttagctatccaagtcttttctggacctggatgtttaaatcaatcagtacatctgcaactgtaatggttatttttatcttttgacatatctcacctgaatctgaacacaatctaatgaatctgatgtatttttcttaaactttttttttttttttttgctgtgaaatagtctagtcacgcattttggtggctagaagagtgaattaatagtagtctaatcaccctggagatgctatgcttctgtgagctggcactgaggtaaggcggcacatctctgtgggaatgacaagtgaatgaatctgctcctcatttaacctgctgttcttttctctctctctgttttctctcctaggaaacaaatggaagactgctgcgaccctgcccatctctttgctatgactaaaatgaattcccctatggggaagagcatgtggtatgacggggagtttttatactcattcaccattgacaattcaacttactctctcttcccacaggttagtatagagttggttgccttcagtatggtttcttaaatttcttgctgtcatagaaaagggataattgagtttgccttactcatcagattgactttttgttttctttcttctctctttaaatgtttttctttatatctgtcatctgtgtgtgtgaataaatcacagtgttttgatgcaagggtggaagcaggatgttacagagttacagttttcctagcctttctgatttgagtcctatgagactgaaggaagcaagaaatgaatgatcagggacttgtggaattctagtgttctgaggttggctgtggaatgaccatgaggatttgtgtgatactggaatgttttcttaggactgatgttgctcagggagtggggaccatatggtgagaagtttgcttcttagagctcttgaatgttaaccctgtggttagattaccactgtgaaatggaggagtggtggatatggagaggaataattcaacttgaccacttttgaagtggtctaaatcaagctttgcttacttaatatttattcttggttttctgggcattgaaataaaatgtttttctaatatacatgtaggcagcaagaggggggaaaagggaaattttattttagggaaccctagttttggggaggggagatcttaggcaaaattgcaattagggaaaaattcagaaatgaatcatggcctccccaagacatcttttagccacccttggtttgctcagatgattgtacagaaagagaatttttaagccttagaaagtgggactgaatctttcatgtgtctctgttaatagcccatgagactttaaaggaggaatcccacaaagctgaggcacaggttctaccagatccaaagtcacactctctataaaacagccatgctgactagctcatccttagatattttagtctagtttaatggtcttaaaatgcagtgataaggtttttcttttaatttttgaaataagaagtagaagctttagtttattgccagcatctacatgttttctctcttcatctgcccttgggaggcttccaggtgtcaaaggaaataactaagagctatgatatatggaactgaattttgtctccatctcttactaactaaattccttggatgattacctaagtcgtctgagatttagctgtcttgtctctatgatggctagagcagcacttgccctatttaccttacagagctgtggaaaagatcaacttagataatgcatggaaatgtcctttttttttttttttttttgtttttgacagagtcttacttactctgttgcctgggcttgagtgcagtagcatgatcttgggtcactgcaacctccacctttcaggttcaagcagttctcctgcctcagcctcctgagtagctgggatcacagacatgtgccaccatacccagctgttttgtatttttagtagagaccatgtttcaccgtgctggccaggctggtctcgaactccggacctcaagtgatctgcccacctcggcctcccaaagtgctgggattacaggcgtgagccaccgcgcccgactgtaaaacataataaatgtactttataaatacaaagcattatatgtttggtattaatgtgctgattcatacttagtatcttgaggctgaggcatgaaaagcagaattgtattggtgagggtttaggcaaggtacagaaatctctttaggtacttttagcagaaagatatttcatatagggaatttggcatttaaaaaaatcattggaagaatggagaaatgggagccaaagggtggttcctagaattactgagtacaagaacctactactgtaactgtggtctagggactgggaagccccaacttggcattgctgttagtgtggccacaactgcttctgttagaaataggggaaagaatatgagttccaattctcctcctcatttcaaatcttcctcaaatgcttctaatggagaaatgatttgcatccagaacactagttgtgaagaagtccaggaaaggcagtttttaactgtcatgcttcagcaggaagctggaaagagagtggtacagaggttaagcaagccaatccacaggatagtctatgtatgaaaactgctacaaactagttgtggcatgaggaagagataaggaagcaatctcctttaacagctcctcacatagaaacattttaaatgaaatccaaagtagcttttttttatagatgaggacttttagttttaccaaatgaattctaactttgtattagaaaatagatttaaaaggatgattaaagaaatataaactagcctcctatattatctatcggttgcagcaatagggttataagaaacatttactttgtaaagtctgtgcaaatgaattctgtgcctctttgtgccagttgcaagaccaaggaaacatccttgaataataaaggaagaatacttttttcttgggaatcagaagtcatgacatcattgtgtatgggcatagccattgcaaaaggcagaaccaattcaatgagtagattttttttaattgcatatgtatgtattttcctgctaagaatctgaaatgactaattaattcatagaaatcttggtaaaccagtttgcatcactggaaaaaatggtattttccctctgctctcatccattattatttcttagcaaaatgtttctagtttgttatcagccaaaaagggttgccagttaattgatacgcttcatttatgttcccagtgggaagaaaatagcgtgtgcaggtgaggtagaaatgcaggtgagtgggccaggctcagcgttttcagcatgaacaaagcttcactcctttcccagagtttcagtgaaataatgctaagtcactcatttctaacttcgattccatgtctgtacctttacacttgccccttaaatactccgtatatgttagccatcattatcaatgttattcgtttgcctacttttgtttttttgtcgttggtacaaagatgcagtgtaagaagggagatgctctggtacattagggaatggcaacaggtcctataatggctggggcagtgtatcctcaggaggtaactattgaaatgtctgtgaattgagatgccacatcaaactccttttagttagttagttctatgctatttgaaccttccacaactttctgtaactttctgttcaaatttattcaattctgccacataatgcggtgtacataacttcatatctccatatgacagtgttctgtgttctaaaagtccttatctgctatctcagtaccatcttgtgagctcttgagaacaagagggttttcccttttgtgcccactgcagtgcttcccactcagtataaatagtcattcccaaccactcatgtctgtcaagggcgttcctgtctgtgtctcacttgggctggacccctgcagtacccttgcttgaactataggaaaccaagcaggaaattcagaggtagctgtttccaaagggctctataaatgtattttggtgaaatatttgttgaatattattaggcatgaagggcagaatttttaaccttcacacaggatttttaaaacatgcgatgtatgtgtgcgtgtttgtatttggggaggacggtgtgatggtatcagccttcccactttgagaatagctgctcccaatcccctgggttgggaccagctctttcctgcttagccaggaactgccccttttaagcctgcatggtccagtgtttacaggaattattgaatgaaccctattttgacctaagatatcttgccaaggaaggacacaaatttccatggaaatgagtgaggcagtagcaggaatgttagaaaccacaactgtgctgatacaatctgaaaaatatttccttttggtattataaaaacacggttggctgtccattctcttacattgtgatataaattacatttctcctcagcacgttcacccagggccatatgtaaagcatcacaaaacatccttaatgcaccccacatagacactcatttccagcttcctaggttggctgtaggctcctgtcatgttccactgagcctggacctgcagcgttcttggcctgtgggaaacccagcaggatattttggagtagtttgtcaaaatagccttgttaaaatgaaaatacacattttttttccttcacagtagtgtgcttaatagaattctctgagctcccggatatccctgagtttcacagcaatttttttttcttttaataaaatttggactatactacataatctacagaatttggtagttttttccacttattcatattattgtaatcatttcccgtgacatatatctttttggctggaaggaaactaaggggtctaatgtctggtggggatggatctttgctggacttttgttaggttctattgttaggcttccatctggctgctttataacagaaacctgatggggggcagaaccaaataattgcttatttatctcaagcaataaagaattagagggtaggtagtttagggctcagtgatggctacgtagtgtgccatcaagctcccagacccctgtcttcctactcaaacctccttagctgatggccaaggaacttcgcagtttcggttcaggatcccagcaaaaagaaggagtaaacagaagaggaaagctggacagattcctgctcatgtatcattaatcaggactgagtcacatgggcatgtctaactgcaagaaagcctgggaagttcagttttccagctttaggcaaatgccttgcgtttgtcaactatacgggctgcctcagtttcttcacatgttatctcgctcagcccttacagcgactctgtgtggctgttattattgcctccatttcatggatgaagctaagactgagaggggttaaataccttattgagggtcccagagctggtaggtggaagggctgggatgtgaaacctggcctgtctgatttcaaaggtattagtgtttactctatggtttatttccttagaagacatggattctagtggattagttcattcttatcactcagtcaccttgaaactgttttaaggtttttcacttctaagaatacctttataagaaatggagaaatttcattttttaaatttatttttattttattttattttgagacagggtcttgctctgtttgataaactaaaaatgcagtggcacgatcatggctcactgcaagcctccaccttctgggctcaagtgatcctcccacctccgcctcccaagtagctgggattataggcgtgtgctaccacacccggctaatctttgtattttttttattgtattttttttttttttttttgtagagacaaggttttgttatgttgaccaggctggtctaggaatgctgggctcaactaatccacccatcttggcctcctaaaatgctgaaattgcaggcatgaaccactacacctggccaagaaatttcttttgcagctttttgggagaaaaagtagagtgtagctatacaggatatggaatcctatacaacaccatagtttcccatacaatactctagtctctttttggctttgagctccccggtatcccctgttgaaaggagaaataagagcatttacattattttgagttttataaaggggaaaccttgcattgcttctttgttataggaatctagaacatggttccactactattgaataattaaggtaattggccctgccattcttggcctaatgctaacactagagtactgtttagggtatgcagtctaaaaatctggatcctaagcctggcctttctatgatgacgcttatgatcccagacaagtcatggaaccattctcagcatgaattttataatttgcacattgggacaaataatacctggtctttatatttcagtatcattattatgagtaacaaagttaaaatgagataatgggtttaaaagtgctttgtaatgaatgcaccataaaaacatatgataatattattactgttattttctctcaaagtgtttacggactttagcattgccttggcatttgggtaatgccaggaacccatgaagcaaaacaaaaactaaaacaccactaaaaaaagggtgaaatcaattttacaggacagtgaaaagaaataaaggtgttgaagctgggatttcgggaaacataaagtagtaacagagaatgttacagtctttgtttcattatatttggataataattacagtaaagtaaaagagcaaggtgaaataaatcattaacttctagtgaattaagattgtgatctgaacaatgaattgatatccactgttcttcaaattgctgtgtaactgagaagagcaggaaaatggatcatcactggatgtccaaatatctgttatcttcatagggaaaggaaaacaatcgattagaagtgaggtagtgcaatggagttgctcagaagaatagctgatgggaactttaagatgtcttgtttttcaaatttagaaataattgaaaattaagacctttctttaatgaaaatttgcaggttgtctatggttgagaacaaaatgaaaaataaaggaatgctctatcttgccatggtgtagatctttctaaattacttgacaatgtgtaaaatttcatacaaagaccgattatggctcaggattctagcttcctgggaataattgaaaagaattcatgacaccaattaccactgagtcacatctcatcccgtaggcctgacgggagtgatagcttttcttaggaggtgttactgttccatataacattttcttcttaggtgtggtgacatgacagggtgtttccctgcaggagaacctggtatacctttagttttttttctttgattagtttcttaatcttggttgctcttacaaaggtccaagtgtagaaaggaatttgcctccgattttaatttagttttgagcatttgtttggatactaggaagcctctgtttcatttctattaatatgctcatttgtacttttaaactctattaggagtcgcttaaatgcatagacatatttgattaacttatagagaggtatcatttcaaccctgaattttctctggcttaattaatttggtcaaataatcaagaggtatgactatgcacagagaacgttttcagagtgtttgtctatgttcagatcaattcactatcttccttctaattcactgtcttccttccattgatggccaaacattcttagatcacaggtgagctagcacaacattttttaatcacttatggcctgactagctctaccctgttatcttcagtgttcagaacttctgagtagattgaagagaccgaccctgaagcttgacttgcccaacacaatggggaaaggggttggctagggataggatagggagtgaacatagctttgggggctaaaaggaagtccagccagtagccagaaaggggtattgcagttcttactgtggaacactgttggcaataaccagaagataataaggagtaacatgatgtgctgctagtatgcagaatgcagagatgaaaatggggtggatggagctatacccagagatccgtttaaaacaattgacttcaagttcccagtctctacgctggaggttttgacaactggcagcttccaagggtactggtcagaagaagccagagcctctgacttctagaggtttgggaactgatcatttatcacagcaggaacacaagtgaaccaggtgagcatcctagcactggggccaaaattagggactgtttttgtaagcaaggctgaagcacagttactggaacttggtatgggctgggaggcagggacctggaagggcagcctggggttatgttttgaaattaagtcataaaccaagttactagagccatacctcaaagccagggccagaacacaagtgtaacttggtagtgattcccatagcttcaggtgaccatgcccaatcattcccctaaaggccaagattgacccacattgctcagggctcagtctgaaccccagctgtaggttcaggtgtatatagagattgagaagtaggctggataaatgagtagaatttttcagacaaaaacatttaggttcttactgtcttcaatgtctagctctgtggaggctgacaatacagagagagcaaaaactaagtgtaaggagaggatttgggaaaattgttaggtaattaagaaattatattagcagtttgtcagaaaaataggtaagtggataagtgtggtgagaaaatttaggatagatgggcatgggtcaacatctgctgattgtaaaggaaacaaaagtgctttttgagggtaagacaacattttatactctgaaaattattatgcataggttttttttcttgccaagttttatttttcctgtctattcagactctattcttgagatttcagaattttaactctttgctaagaaaaagaaaataagtgctgagagaaatgcaattgtaaattaatttgataatcacttcacctggggtgtctgcagttaatgaagcactggctaacagccccatatacaatatgtatcatctgattattttgtttacatttttctgtttctagagttcaatccactctgattttatatacatcttgggtctaatatactattcagaggatagtatattcacaaagtatggttagttctgtagccataatttataaatttcctgattgtcttttcttgttatactcttacatagtctttgactatgacacccaaggtcagtaagaactgaagttgctacagtttgtaggtgcttccagatgcctgacatggagattgtttgaggatattttaaaatccaaaaaagttcagtgatatttctggactcaagaaaaaaacacagtatttctacacaaactataaaatttaatgtaaatcaaaaatctacaaaataacatcaaggttagaattaaatttaaagcaaggatttgatgcatagaagattgccttacacattgattggacttgtcacctaaataaatatgccctgctgccagcacaactatgctttcctgaaattttcatgattctatgtaagtaaaataagtgttcgaccactcattcatgaagtacttattgagcaactactgctgtgtggtagggactgtgctagttcctggggaaataatagtgagtaaaaatagatccggttctgcacctattggatactgtcctcaatgttccataggttccttaccttttacatgctcacaattctgtccctttctcctgcttcttttcttctattcctgatctcaggtaatgacactatcgtctactcagtcacttgagctggacaccagggtcttatgtttgaatttcactgtccaaatccaagtttatttcataaatatttcctgaatcaatcccctcttttcttacctcactgccactgggttaagtcaaggtttatcatctgttatctatactaattcaagaactttcaaaaaagtttcacagacaggcgcggtggctcatgcctgtaatcccagcactttaggagactgaggcaggcagatcatttgaggtctggagtttgagaccagcctggccaacatgatgacaccctgtctctactaaaaatacaaaaattatctgggcgtagtggcaggcacctgtaatccctgctattcaggaggctggggcaggagaattgcttgaacccaggaggcagaggttgcagtgagccaaaatcacaccactgcactccagcctgggcaagagtgagactccatctcaaaaaaaaaaaaaaaaaaaagttcactattatgaatttgcctttctgtgacatcctccaccctctgccaattttgttgttataaaatgtaaactggtgtgtgtgacatctcttaactcactcttcactacttgccatgcagatgagcaagtggctaaacggcagactaagtcagctggagcagcattcacagagaaaactcatgaaggacaaggagcagctagtagatatgctgttgcgttttattattaaaaataaggaaattctaccctctaagaaagggaacctgaaactacactgggctttgtagttctgtaattagggatgcaccaaccattcccctggggtgattgagagactgagatataacatacttactaagatagggcagaaccctggctttggcctcttttatcaacttagtgtttgtagggaatagaaagccaatgtagctatgatgggtgactcaggtacaagtcttgcagatacagttgaatgacatagatggccagaaacggtggccttttttttttccattttattttattttgtcatgtgttcaacagcatctctttttctctctctctcccctcttcctggcaggtcacagacataaattaaaaataaaatctacaagaaaaataatttataaaagcactcccaggctcacaccttctatccctactgctcagttaggaacaccccaactgagaatcagtgctttcccccctccacttcactcctgcttgtctggggaagacagtactccagagtcgggcaggggtgggggtggcagtggcaaacagttaaaaataaagacactgtggtcctggaaccatctggccaccttggcacttccatgactgcctcccccaggcagccctccaggagcttgtgctaagctggggctgtggagaagctgcccatggctgagagcttgcgtgtttggggggtgctctcagcccctgtcacttgcacttctccatcttctagaaagaaacccaaaaaagaaagcagacgacaacctcgggacagaggagaaaaatcccgagtgttcacacagttagttacatgggtctttatggcaaagaggacgtttagctgctttgaatattaggacatctcctttttactcaatacaagcattctacaagtgaaacagggcacaagccctaaaaaaatcaaagtgcatgaaattctaagaggactagtttttttgttgttgctgggttgtgtaatgttttgtgttttcccagtgacaagcccagtccttggtaggcagaggcctgagggaaagatcactccccagtgttgtgctgaatcctgcctggaggctgctgcgctagatcctccctccatatcattcccctgactcacagcagtactggaataggaaggctgcaggcccagttcccggagcactgccagcacctcaccccagctacagaagagctcaggcagtgggtgagggatggggaacacaaatgggatttattgcatcagcttatagttgcagaagagctagtttcttccttggcttgctgagagtagtgggaatccaagccttgctactgatcaggatagagggccttgggcactgagccccatctggtttccatgcagctctacaggagcccacatctttttcctgttgacaggggatcaatcttgagcaggttcatccttcctggttacaacctgtatgataaaattcaaatcccttagagtgtcacacaaggtcttcacgatatgaactctctgagaatgtcagctaatataagcttaccaattgccatccatctgcttcctccagctcctcattgcttttttttttgacacggagtctcactctgtcatccaggctggagtgcagtggtgtgacctctgctcactgcaacctctgcccccggggctcaagtgattctcctgcctcagcctccgagtagctgggactataggtgtgcaccaccatgcctggctaatttttgtatttctcatagagatggggtttcaccatgttggccaggctggtcttgaacttctgacctcaagtgatacacccgcccttggcctctcaaattgttgggattacaggcgtgagccaccatgcccagccccagcccctcattactttttacttttactaagtgacttgcatttcccagaacaattcgttttttcgttttgtcttcacatttgtacatgttgttccttctgcccaaaatgcccttcctatccttatctgatgaattcttgtttatttttcaagatccagccaaagcatcatttctgcaaaccttcccagttccctctcccaagtctcaaccacctggcagtgttgattaaaaatctattttctcccccccaaatttgtatatatctctcttaatacaactgaataacaattattgtataacaattcaataactgaattgtcaacattgttattgaataacagttactggctcacatgctttctgctgaccacactgtgagccctttgaaggcagcacatagacagggtctggcacataacatagcaggtggtaaattaaaatgtgctgaatgaatgatgaaatggatggttgcttttcccaaaacctttgcacccacatggcatcaagttacgtcaacctaggtcaatccaggcaacagcgatggaagaaggaaaggtcctggatgctcacgatagagcgtggcgtgtgtgatggtgtgtggacagtcaccctctaagtgtgcaggacttcatcctaatcttgaaataacaagatcgtacattttaaaagtcaagccacaatattggttctgggcatgtagttattttgtttttatttcttttcgctattcttattctcttttaagacatatattattcttaagaaattgttattggatggagctgatggacattttgatacttgtgaagataatttctttttctcacatccacttcttattttctctcattgtctttaccatctcatttcaaatgacaatggcctcttgtctagaattctgcaaaagttatcttctgggctttttgtatctaatctggcctcttctccagtccattaccacgctgtagcttgagttagctttttaaaatgcaaatcagatcatgcaatcattttgcttaaaacccttgattgtcttcccattgatttttaggataaagataaaccccttaaggcttgatctcttcctgtggctccagcatcaatttccacaatgttgcttctcatcctcataccttgctttactggccttctttcatatcctcacaaacactgtgctgtcttcttctgtagaggttttccacatgctatccattttcctggaagactgttgcctcctcttacctaattaacttacattgatcccttacatcttgtttgagaaccatttcctggggaggagggggctggtccccagagcaccaggtacctttcatttgcaacttcatattcaattctataagtatttgattgaagttgccttctcttaccagctggaaacctctccagggatagtgtttaattctggatgatagggagttatgtgtctcagtttgtagcatagtgcttgagacatggtagagattcaataaattttagtggaatgatgaatgaatgaatgaatgagttcagctgcttagttttggtggatacaatcaccaagtgtatcctggtgtacctagagcctatgttttggtataaatataaagagacttggagttcattaatagagagtggaggggaaaatcctcacattggaagcagtcaacataatgatgagggatttttttgctcgttagctcagctaggtctgggttcttgtctcatgaccaggaagaagtaggcacacagaaatttgaagagtgagcaaggcggggagtttcattgaatgatgaaacagcttttagcaggggtggtccccctacccaaaggcagtaaagttctcaatatggctgagcctggggctttttatgggctcagaataggtagcttgtattgattgatttgtgactgtgcaaaaaggtcaaagcaaagatgccactcaaaggtggacacgacagtgtagaaagccaattaggaaagtgtgggtatatgaaaaataggtgaacggtggggatcaatcagaggaaagtgtgccaaacgggcaggtggggtctcaatccagtccgaggatttaacttgtagcttggctttcaggctttaaactgtctgcagcttggaggtggggtttcgccaggacctgcccgtgtctatctaggcatttgtctgcctcctgtcattatcggtaagaaacctcagaataactgtcccagactgaagcctttaaggctaactgtgaagatagtcaaacagggtgaccccgagcgcttttgttaccatgttactcttgtgtcattagataatacaagtctcagatgttgcaatgaaatcaatcttaaaggacaccataatggagaaattgctgctgtttttgaagatgtaaaaatcacagtcagagatgtcagctcagtcagtctctgccttctccccaaccagaactaaatggcagagtgcagtgacagagcaaaaagctgaactggttccgaggtctcttccctgccaggagctggcatctccagactgtcggttcttgtgttggagccttggtgctcttcagtcttttagccatcaaatattcttgtaccaattttcccacaaagcgaatgactgggatttgtattttaaaaccacagctattataataccagtatctttgaaattgacatactgtctccctgttagttttcaatttatcttggcccagctgctggaggaaaatacttttcagtctttgtagcgccgtggagccaatatgtttaggaaacaagccagtcaatatagttcccaaacaacctcttgccagagacagtaataattttttaaccccttgaactctaaataagaaaatggtttcatccagattatgaacactaaaccttggttggtgtgggcagtttgaacaatcatccttcgagttgaaaactttttgactgtccttggaattagtaaaggacatacattaagtaatcccctaggactgctttttcagcttgtaattacatttcaaggaaatggccctgtaaaacaagtagcaaagtgctctctgcaatatttgaaagtaagaccatagcaggtcaaaaattataaagtaaattatagtcattcacttaaaacgttcacttaaggcattttgtaatttcattggtgaccttttattgcatcatgaacaaataggggcaagaaaggatttagaagataaagatttgggcttaggaaaataagcattcagtggtaaggatttataagatgtaagatagattaagtaagggccaggaaacctttggggaaaaaggcaaagtgttatcatatgaataaaaataatggtaataaaatgtcatagattatgtcatgtctttaaaaagagggtacctgaaggaaatttaaatttcatgttttaggttatgtcataccatggggatcttgatatgtagaaatttcctttcacttttgcagatggttgagagatctaagaacagtggagggatgcagagaacaaggagacaggaaaggctgatgtaggacacagaacatcagaatgactacttggagcagggaagccaccagagcaatgtgatgattggcgctctcgtattttacagctattaataggtcatattgactgaatgatttctaagttccagacctggcactttttataattatcattttatttaattctttcaataactgtagaggtaatttcttacgtttcccttcaccccattttatagatgaggaagctgaggctaagaaaggttcagtacccatcacaaagtacattggaagtggcagaatcctctgatgctgtaattgtgtaaataaccattttattctccatgacctgggcacttagaagatgactgaggagtgatttagatatgttatgtatattcatatagagtttatatatgctatcgttccatctgtctgtgaagttttcctcaattaagttgtgcttgagaagcattgaggattaaattggccaactctgaactttctgttgccagtgcttcctgtgggcttggcattctgtttagtacacttataagaaagtcattccagccttgaaaacatccttaatgcagatgttttcttactgagtcagttaatggatatgtgagccaaaaggttcatcaaagccactgctgatgaaacaaccaaagcttcattttcttgaggctcctattggaaagaaaaaggaaatctatgtgcctgtgggaactgcagacgtaaactacctacctcatgtaaaaggctaccacgattgcaagtgacatggtaggtgcaagtatggccaaatacataggaaaaaaggcacaatgaactttttagtgtatttccatttactaattatgaatctgtgaccacctgtacaaataaagcaattaatgtcaactgtttacgactcctacaaaagtttcttcttttaaaatttcaattttctttttgttcctatttttaaaatttgtgtaaatttatggggtacaagtataattttgttccatggatatactgtgtagcagtgaagtcagggcttttagtgtatccatcaccagaatcacatacagcgtcctcattaaataatttctcattatccagccccctttcacccctttacctttctgagtctccattgtctatcattccacactctaggttcacgtaaaagtttatttgaaatagatttagaggaaaaattatattgaacatatttttgttttaattcagtattttaattttaaattggaaataattagtaagttaatttaaataaataaactcaattccgcaaaatgtgacactttaaggaaagtgcgtaggaaacattaatgaaactcaaatgtattagagaaaacctaccaaagagtaggttggttatattttctcaatttgattcaattttgtggctacactctacaactatagtttgttgaagactaactatgtgctagactctttgctaaatgttttgcatgcattatctgataatcccaacatatgatgctgatattattgtctccattttacatgtagaaattgaggctgagccaaaagtgtcctgcctgggatttcccagttagacactggttccatgctgtgattccaagtcaagattcaaactgaggcctgttgaagctaacatctacaaatttaaccctttaaactgccttgcatttcctttcaaattaggtaatatgctacaaaatgattacaacctaatgaagtctctctcctgatatgtctgaaatacctataatagtgtataaggagattcccattttgttttccttggaaacggatggagacttactcagttgctaatttctgtaatgtggtccaaattgtttaaacctaacaattccatatttaaggatttatcttaaagaattaactgtacaactgctccaggctatatgtatcagataagtaacagcaggaggacctctatatggaatgggttagtgatggtgaacttgttaaaagagggttctgtctcttcaagactccttttatgtgaggtgttttacatacaattaagcaaactttattgtccatataaaagaagagaatacagtgggctgatactcccgtttctcagctaccttcttagctctgccacaattcaaagatgtttataacagtattgtttatcatagtgaaaaaatgggaataacctaaaatattcaacattaagggattggttaaattatgaatcacctctacagttaaataccatgttgatattacaatcatgaagggaaggtatccataatatcttgttaaataaacatacacattacaatagtattcatatgggatcacctgatcccattttggttagaaaacaagccatttaggatgggaagtccacccaacagagggctgagaaatcactgcaggtaatatacaaatattacttaatgttattttgaaaagaagcaagggagacttttagaaacttttggacttctctttgtcagttagaatcctgaatttttcactaactgccttataaaaaaaaaacaaccctgtatttcatttaaatctggcacagagaaaagagtctttcccaatctttggctaaaattccctaaagcatgtattttcctactgtgtcttttggaataatttaagatatgcactcttctctaactgcctactcttggaataaatttatttattaagtctgccagggccctgcctgggtctatagtaggatatgcaaattggctaccagttaagataaatctggccttcaaattttggctttactttaaaaaaaaatcatttgaactatatgccaacttttaaaaatgaggagcttttacattaatacctggatttttagtatcacttgaaaaaaaatcagaatatctggcagtcctggctcccatgcccatgagtagggcatgagcagcttcttatcctgctgctttggtgatatggttttggtttggctgtgtccccacccagctcccatcttgaattgtagttcccataatccccacatgtaagggagggaccaggtggaatgtaatttaatcatgggggtggttaccctcatgctgttctcatgatagtgagtgagttctcacgatagtgagtgagttctcacgagatctgatgggtttataacgggcttccccccctcccctcaacttcgctctgcacttcttctcgctgctgccacgtgagaaaggatgtgtttgcttccccttctgccgtgattgtttcctgaggcctcccccgccatgctgaactgtgagtcagttaaacctctttctttataaattacccactctcaggtatgtctttattagtagtgtgaaaacagactaatacatttggccatgtgccctttgtttgccacagtctctagcacttcctattgccttccttccactcgtttatgttacccgcttgaattgtgtaggcatttcattttgcacctctggtgtgctagactttaaaataatctaaaaagctcgtctgtggatcatttagcaatttccttaacctttctgtcagtggtctgaaaaagggaacaggtttgctgcatttgcttagatagattcttggcatttctccagaaagtctggggctggattaaatcaattaattaatgaaaacatctgtatacctatgtggtaggctctggagacactaagagttacaaagacatggtttatacccttgaggggcttattcgctgttgtggaagatgggtgtacacaacagtagctagtcaagtgttacccagtgctaagggcctagaatgtctgcttagtgagacggacagtaagtgcagtaggtgtttctgtgggaatgggcaggatgtgcatgccaatcctggaagatgacataggtcagggaaggttctagggaaggaagacctcaggtcatatctgagagttggcagatcaggtggatcacaaacatcactgtgcatgtgaattgtatcgtgtagggcaacttcagattcctaagctctacccagagatcctatttctagagggctgaagtagaccaagaatatgcatctttaatatgaattccatgtgtctctgaaatatgtgagttacactgtgaaaaaagggtagacgataagccaagcaggtcaggagaaataagtaaaggtaggaatgtgtgaaggtaatttacaggctgcaaaactcagttgattggatgcttgtatgcagagtcctgagagataattaaggcaggaatactgggaagagaaggatgctctggaaatcacttattttcctttttatcagtaagaaaggatggcagatacattttattaaattggggaaataaagcatcagcagcagccagttattcccaaaaggaatattctctgcttggcttatttatcttttaatggaataaaatagttatatatgagacaatcaatcatggacatgcttttttttaaatgaaaataatagttaattagcaggcaattgatcctggtcctgatagttcaggtgcctagtcagttaaattggattaacagtttagcagtctgctgcattacttactaagtaattgcacactatttatagttgaaaacaaaatggatgccctaattgataccaccttttagtgtagcaaatactgaactgaagctcacagtttctgacccagcatctcatacagtgactggtatatggttagttggcactcaataaatacttgccaaatgttcttaactgaaacttgcttggtatttgtagttcttcatttctgaaaaaatggagttggattttattcatggttttctacaccatcaaattccttggggtgtctaagtgtcacttccagaaatagagagaccaagaaattggggaagggtgcccactttacctcatcttctcttttgtgtatatgtgtgtgtgtgtgtgtgtgtgtgtgtgtgtgtatacttttgtgtatgtgtgtgggtgtgagtatgtgtacacacattttttcaagagacagggtctcactcggtcacccaggctgcaatgcagtggcacaatcatagctcactgcagccttcaactcctaggttcaacagatcctcccacctcagcctcccgagtagctgggactacacgtccatgccatgatgctaggctaattaaaaaatatatatttttagtagagacagagttttactaggctggtctcaaactcctggcctcaagcaatcctcctgccatagccttctgaagttctgggattatagatgtgagccaccatgcctggcctatatatatatatatattttttttttaaataggggttttctggtataaccttgtctgagaaacaataaaggcttcgattttgaagcaaagaaaataacagtagcaacagtaataagtttggaagtctctgaagtattgaataaatgatttgtttcaattccacgtgcatttaccggccactgtgcacagctttaatacataatctcatgactcatggggcataaatgaattccggtgtgcctcttgtctgcttgagttttttttagcattccttgcacttgtagggaattttattggacactgtacctgcagacccttcatagatcttaaggttgaaaaataatttggaaggcaggtaatagagtagagaaagtaaggagaaggggtgagggcgagccattgaagcagctttaacagaggtagggagacaagaaattcaggctgtgtctgaggaaacacaggtgcgtaaaatggtgtggagggaatattgggtgtatgcatagataaccagctggtagaaaagaatgaacaggaagtttagggtgttgagaggtcctgggtgggtgcttcaatgaagatcggaagtgtttttgtctgtgggcaagggaaaacatggtacttttttttttattagaaaagtgatttgcactagcttttgttttagaagaattaggatatgagagtgaaggattgatgacaggcaagaactagaggccaatttacagcattaaaccattttaaacaatagttacagtgagagtggaaagaggagaagaacagaagagcctctgcagagggaggtgttacgtagatattaagagagaggtgagcaaaaatggctctgagatttctaggctgtgttgctgagaaaatgttgatctcttaaagataaaaataacaattattgatcatttaccttgtgccagacataagtcatttaattctcacaacaactgtaagaagtcagtacagttgttacaagtgagacaactaaggccctaaggttaaataacttgccaattgtcataggggaacattaacagcagggactggatgcaggcaggcgggctacaaggtgatgctcatcaacatgaagatgtgctttctgtatttggagaaaatgaatctttcagtggtatttccaatgaggggattgcaagtatgacgtctagcaatggcatgaagcttagtacttcctgctgctgcttattccgtgttttgctccactgctaagatgattggccctacctttgaaatgttgggcctgcccttcgtatttccttccctttccatcatgaaaagaaaacagttttgaggacttttaaaatgtggtcaacctctgccctgaagtatagacacagtctttgtcaccttatggttcagaaacaacatcagtaaaaaatttcaattcattgggacttgactatgaaatgtttaataaatctgctgcatgggcacatgaactgatgccacatgagttgtatccagaataacagatcatatgtgaaacatacaaaacactttttggaatgcttttgtgttattttttataatggattgagtaagaaattttaataggcaaatagcatccactatataaatattcacatcattcaatttccaaagaagcatcctgtgtagaaagcataacactgaagctatccttttaaaatcacaattttattaatagaatggggaatacaaatcttagcagctttctggaaatttgttttcatataattgaagaacagttaaaagtccttgagtggtaggaaactacaaatattctataattaacatgtacaaatatatatcttaagggaaaattatgtgtaacgttttttaaagggtttaataattaagtacctataatgagaagttttttttctctgaaataattgaactaattaccagatattttcatcataaaatgcttacgtatgcaaagtaagaaaacaactgaaattttaatttggactgccaaggggctagttaaatgactgaaaaagccaatacgtgttagtttacttactggaaagaaccaaaactgcttttgatttggctgcatcttgttattattttgtttgtttagctgggcaccatgctcgctaggaattcgcttgtgggaatttgccagtccttaactgaagtaataaagtgactggggtacagggataaagagatgttcatgtgaggagtattgttggagagttgggggcttgattggtgcactggttagaatgtaattaggtcctggagcagggcagtgcaattaaatatgttaaggagggcataattaggtgggaggctgaatgatgtaattacattcataagaggggggctataattaaatatgaggcaggggtgtgtatttagatgcctaagttgaggatataattaacatatgggcaagaaattaaattatgtgtgtggatgaagcataattgtgtgtgggagtccaggaggatacgtgggtgagggtatatagaaagaaaagggtcggaatgcaattagatgtgtgagttgagttcttatggtcaaaaacttgagattttcattaagaagggcaaacatatgttttgacatcatgactgatagcaggtggcatgtagtgacagcctttcagaccactctgaaggcttgcaaagcaaactctgtgcttttccaatatggtttgagacctgcagctaacactgctattgattcttcttgattgtggcacttggtgccacaattctaaatactgagtgtctggataatttttctagctttaaaacacaattacatgacaaggaagacctgctcccccttcctgtcaaagagaaaagagtttggcggggattactagggcaaataaacacacaaacaagaacaacaaaaccttcttgccaccaacaaccaaaacaccaatttttctttatattgccaagtgtgaaagtaagcatcactcttttagctaaaagagtatcacataaacataaatgtgtaacaaaatcaacaaaacttagttatgatagcctcattattttaaatttctaaaacaatacgctttcataaataattttggcatcctcccaacatataaaagcaacaaagcaacaaatgtaggctgcagataaaagaggaactagggagtggcagaagggagccaggagaagaatgatcacaagcaaagtaggtgaaaaattactcagcgcatctcagaaactaagcagtgaagtatggtaagagtgatcataataatctgatatatcctatattaaacttaaaacacggagactcctgttgtcgtcttcaaaagccagagaacatttcgaatatctgttcgttgcttagataattgttgaaattaaacatatttaattggccagtagtctgcttaaattgattcaatctagcactcaattctcataaataccagagcctcagagcctcctcatatctgttcaggccttaggtcagttctgacagaactccactattgataagattcctggtgagctggttgcttcggggattctgaagtttttagattcaaaaagaatccgaaaaggattcaagaaatctatatttaaggttagttattttttataacgtggaggtaaggacattgcagcctgcccgcaatctcttgttctgccctttagtggttttaaagaacttctttttaattcttagattttgatttcataccaatgcatgatgctgatttttaaaattgtagacatgcctcaaaggcagcctctcacaaaggctcttgtaacttaatttgtaatcagaagtgctcttaataaaatgttgtgcattcctgtgaaaattactgttgcatccaattctctatccactaagtggtttacattttctttttctccatgcacttcctactttttgccctgcctcccagaccagctcagactctgcaacaatgaatgatttatggtggttaactcatgtgcttctagaggtcacacaattatcattcaagacatctagttatgtctgtgggttggaagatgagtaggtgtaaagtctccttgtgccagtggtggaggtcagtgccggctctgctgttcagggttgggggtggagtcccagctggccagctctttgttgctttgtgtggattgcacaaggagaggaggaagaggtgggcttcgggctttgaaagtgactctggtaaatgatgctttgttaacttaattataaaaaccattctgagatgctccagtactatttacataaggcacaacaaacagggtttaaattcttcagacttgaatagcgtttttccataagtcattttgtcagctaggaatatgtttgcagctggcacttaacaagtcttttcactctcatgcatgctataaaacaccaaagatcctaatttttgtttgtctttttttcaccttcctaatattatctaatagaccagaaatctcaactactttcatatgcttaaagctatggatctcagcttaaatgttaattcctcagagaaatttttcctaaccttatagcacgctgcattttgctgtcatgtttgttaaattctgtttttctatttagcgtgtaagctgcatgagtggggtatatgtctattttgtccaccatcacattttcagcatccataacagctcctggcccatactaggtgctcaatgaaaagttgatgaatgaacagggaagttaggtattagggctgtttgagaagaggcacgagtgaggcagactgtggaaaatgaggataaggggtatctcagaagcaacacactggatgggcttactgaccggttcatatttagagtgatggggctcacggttgttcttcaaatttggagattaatttatatattcattacaatataaggaaatgccattttaggtccggaaactgctgagaatggattagatgctccaggaaaattttgtgattaaataactaattattgaacaatttgttgatcatctcatctgtacttagtccagatatgaggtgttgaaaaaaaagatatgatacctgcaatgatttctacacaaatatgttattaaaactcatggcttgatagaagttgtattcataagtacacccttggctgggcatggtggctcacgcctgtaatcccagcactttgggaggccgaggcaggcagatcacctgaagtctggccaacatggtgaaaccccgtctctactaaaaatacaaaaaaaagacccgagcgtggtggcgggcacctgtaatcccagctacacgggaggctgaggcaggagaattgcttgaacccaggaggctcaggttgcagtgagccaagattgcggcactgcactccagcctgggtgacagaacaagactctgtctcaaaacaaacaaatacaccctcaaaggaccaatgacaaaaaatattgatttgttcaaaatatatataaattagcttgggtaacatggtgaaacctcgtgtctacaaacaaaaaacaaaaattagccaggcatggtggtacatgcctgtagccccagctgttctggtggctgaggcaggaggattgcttgagcccaggaggttgaagctgctgtgagccgtgattggaccactgcactccagcctgggggacagagtgaaactgtgtctcaaaaaaaaaaaaaaaaaaaacaacaactatataaatctttgaaattgaaaatatctcacacaaatatagactaaatactacagtggtctagcaaaatactaactttcccctaaggaatgcaattttgttagtacataataatgaattaatataatatatttatatgggacttcagaggttactgataatggtaaatgcctcaccttattttaactctcgtaatagtcctggaagatggaacaaatggttttttatcatgccttgtttccagtgaggcactgaggggttgaagggcctgacaaatctgaatccagatgattcatataatatggtcactaataagatggccattaacagatggaacagttacagataaaaaactctggacaaagatccgtaggatggttagtggctgagcaagaatagaaaatctgtgaggctgggcgcggtggctcatgccttatctcaacactttaagacgctgaggcgagcagactgcttgaacctgagtttgagaccagcctgggcagcacggcgaaatctcgtctctacaaaaaatacaaaaaatagctgtgtgtggtggcatgcacctatagttccagctacttgggaagctgaggcaggaggattgcttgggcctgggagatcaaggctgcagtgagccgtgatggcaccattgtacttcagcatgggtgacacagaactagaccctttctaaaaaaaaaaaaaggaagaaaaaagaaaaaaacccttgagctcattactatagttaatctgtctaatctatccttgcatttagagtagatttttttaaggttagcaagagtgttatagtatattatattctcaaatccagtagattattttcttgcataggtacaaggagacacatttgaaaagacagtatgcaatgccttaataaaaatattctctgttaaaatagtaatattcatgtggcaatggataaccaaacttctttctatataagtatactcataaaggaaaacatcttgttcatacatcattctggaaaacatggaccattgccaaactgagaaattgaggaggtattctgtgagtattaatgagagtattatctcaattactttaaaaaatccatagtatttttggccgggcgcggtggctcatgcctgtaatcccagcactttgggaggccgaggcaggcggatcacaaggtcaggagatcgagaccatcctggctaacatggtgaaaccccatctctactaaaaatacaaaaaaattagccgggcatggtagcgggtgcctgtagtcccagctactcgggaggccgaggcaggagaatggcgtgaacctgggaggcggagcttgcagtgatcccagatcgcgccactgcattctggcctgggcgagagggagactctgtctcaaaaaaaaaaagaaaaaaaaatccatagtattttctcaattaagtttttttgtctgtaaagctttggtgtgctgttattgttcattgacgtattataagtgcccagagagtgcactcaggcactcaggaaatatttattgaaatgaaatgaaattgcttgtcaataaaaagtcaaaatggctttttttaaaaaaaacccctggacttttgtttgagggctttggggggtggtatttactagtgcatggatataatagctaagttttctgttaataaaaattattactaattgttaaggtagtgtgttaaattactgttttaccgtgttctacagaaaccgtgaaatctaggcatttcatggcttgaacaagccagggagactctgctagaaggaggaaagaaatgaaaaagggaaggaagatgagtggacttccatgccagtggcttggttagatgcttgacatccacaaactcatagaatttcatgaaagcctgtgtgaggttagaccccttccaggacaggaagcagaatacagaggggtttgacagcctaccttccaattccatagttccacagtttggaagttaggaggtaatgtttataactaggactatgttgctgcttccaagatctgtttgttttgcggccagattcctgacagaaaacctggaattgccagcctaataggctcaagcaagaaccactctttgacaacaattaaagggatttttagttggcttttatagagcaaactaaatattagttgaacatgagtgaacccagatttttcaaataagctatgtgaaaagaaatatgcaaatgtgcatgtataacttactcagatcaggtttttgttcttatcgctgaactaaatctacctttttcaaggtcaccagtgaccttcctgttgctaagttcagtggcaattttcagctgttgtcttacttaatctatcaatagcatttgatgtaatttttttcttttcttctttagacactttttttttttaacttggacaattcttagacctcttctcttttccatctgcactcattcaccatccagtctcctgactttaaatacccatgctgatcactctctattttctatctccaggaaagaccaactccctgactgcatagtcatgtattcacttccctacttgatattgccacctgggtatctaaaggacatcatgcacttgacatatttaagattgaactccaaatcgttccccagaaacctgctcctcctgtagtcttccatatgttggtaaatggcaagtctatctctacagttgttcaaggcagaactcttggcatcatcgctgatttctctctttttctcttgccctgttttcattgtatcagcaaatccaggcagctctttctccagaatatatccagcttctggctacttctcactaccccagtgatggtgataggggtagtgagaagcagccagattctggacatattctggagtcaccaaagtgaccaagagtcaccaaaatctcttatgaaagactcctatctggtctctctctttctgcccatgacattctacagcctgttctcatagcagtatagtgattgctccaaaatatgtcataatgtcactcctttgcacacccaacattgacttgattctcatcttagaataaaaacctatgtctttacaataccctataaggccctgcagaatgtatttcccaacctccctaatagtctactctctgatatccttcctacttctccctccctcttctgcctcgcttcttcatctccagacacaacaggctctttgctccccctttcccatcccaggaatgttttctccttagggtctctgcaccaggggttcccgcagagatctgtgaggctcactacctcatctcctgcaggaatttgctcacaaattgaactcctccctgatcaacctattaaaattgcagttcctggggccaggtgcggtggctcgctcctgtaatcccagcactttgggaggaagaggtaagctgatcacctgaagtcaggagtttgagattagcctagccaacatggtgaaaccctatctctactaaaaaaaaaaaaaaaaaaaaaaaattagctgggcatggtaacgtgtacctgtaatcctagctactgaagaggctgagtcaggagaatcgcttgaatcccggaggtgggagttgcagtgagccgagatcatgccactgtactccagcctgggtgactaagcgagactgtctcaaaagaaaataataataataataattgcagttcctctctgaaagcatctcctaatcctttcatggcaatgctttctttctttccaaagctcgtgtcaccatctgacccactgctcattttactcatttatctttacttatcatctgttttccacactagaatataacctctgggaacagaaatttttacttatgtccttgtcacccagggcagtgcctgacgcatagtaggcactttgtaaatacttgtggaataaacaaacagctactttgaatgtaagtatttaaatcttcatctgacaaattatagctctaactgatgtttttctagtgttgattccaagccctctgtttcttgcccgtctcttctctctggatctgttctgatgtttgttgggctggtctctggtgtagtaatgcaggaaattcttaactctctgctggcaaatgcttagacattacactttaagtactgtatttttatcaacaatatttccatagctctggctgttcctttgacaactagaaatcaaaggaataaaatcctcttcttatgctgcattaagtggccacctcagttaccaatgaatacagaaactcctggaattttatttctggtttaactacttcctgcctatatgaggcccttacagtgtatattcatatacttattggatttgttcttttggaataacccatattatttgcttgagattcatgtagggtggttatttttgatgccagttgtgtatatgaaaggtctttccctaaagaactccagctgctctgcgtcgtttcagcaagcaggaaattctgtacctggcagttcttgctgacccagctagaagtggccgaatgacgcatttcactttcaggggctattgctgggttttcatattcatactataaatagcacttcagggaacactcagatacactgaacattttctttacagtccagttcagtgttggcagaaagaaagtcacatgctgtgtggttctacacaagtcacttgccccttagtgggtcctaagctctagacagacccacccagagtgttcatttgctcataaacacagcatcactctcagcaaatacttctgtgtcgttgtttacgctgctttctgtgcctggaggaatcatacgtattctttaaggttcatcccaagtgagaaagctttccccgagttggctcagcagaaatgccttcttcctccttgtggattgccccatagcattcagtgtgcatctctttggcagcaacttcagcattataatagagtttgttacctaggtatatgttttcacactctcatcatccctttctctcctcacatcccaaattgtgaaccctcaggcctgtgacttctgtccacatgtatctctccccaacagttagcaaaggaaatgttcagaaacatttatcaagtgaatggctgattgtatgaatgaatgagattgcaatcacataggagaatggagctcatttgtttccagcttaatggctttaaaaataatcctgtgtttactttgtatttttttttttaattttccctagcaaacaccttctactatgtgcatggccaattggagaggaaaaaaataaatgttgttatatttaaatgcacttcagggaggctttttaaaaattttgctttttaaatttcaaggcaacagactagtttgttccttacaaacttcttggcatctttcttttcacatgctcttttttgctggactcagtcttcagtcaaattcctccaaagggtctgctgtaaacaatgattttgtgagcggttgtgtgttctttgcagtgaaaacccgccttgttttctgttgctaggcaaccccattccagctgccattgaagaaatgcgcggtggtgggaaatggtgggattctgaagaagagtggctgtggccgtcaaatagatgaagcaaattttgtcatgcggtaagagagagcacccacagcgcggcctctgccttctctccttttccccacccctcccataagccctggggcttttcaaaactagtcacttgtgatgaatcagttgtagcacgctccttagcttcacttccagctcatagacaagcgagtttaggagaggggtaaggggagcgagggaacatgccccgagaaaggacaaagccaagaaggctcaggcggaacagagatacccactctgctgtgaataaagggagcaggggaaagtggaaaatctcacatctcattttagattgtacagtcaggtgattttggctttttaaattgttcttttccttaaggaccactctctatgaataaatgctttaatggattcattttattctataccttattcttcttagtttttgatcaaatcatgtgtaagtagcaagtgggatctgaagacggattaaatctttgagtgagtgggaaaacgggaacaaaggagcaggggtaaatttcaaacgaggggacgcttggtaaagggactgagcagagtggtgatgtgcacgtcagttccaggaaaaacaggaggcccctgcgggagcatgaaaaggaattgctgagacatattcagccagggacagagactgccaaattgtaggggcagcagcctgcactgctgggtgattctgcccagacatgcttaccagccacgtatagaaggagagacagcaagtgattggataaggacaggtttgggattatctgggtgagagggaagaaggacaaagagtgacaacttggagggctctggctagagagggtgtaaagtaacacaccttgaaatcagggctgggcaggaagagcgctctgagatgagtgaaggagaaaggatggggtcagatgatggggtcattcagagcaggggtgaggtaagttgtggctcctggctatgaatgaaggagacgtggaataagaagaagctaaagtcaaagaatggctttctggagggcaagatttcagagctcagggtatctcggggatgagtggacatgttgtagaaaaagaaaacatttgttatggagcaaataaaggagccttgaggatagactctgagggacctttcaggtggaccctgaagcctcactgaggtggaaatgactatgaaccaagtgccagcagactctgtggccaggaagggtgaagactgcagcaacatcaaggacagaaagctgagcgagattttgtattcctgtttatttttaagtataaacgagtaacagtctaggagtggaaaaaaggtagccaagaagatgctaagtcacctctgagccctgagctaagtgggagagggaagagtaaaaactttatttgagagagtttcaagagaagccatgtacttgtgggggctaagttccctctcagagttggtctccttgaaagacatttttttttctcacttggtgaagcctgcaggagagtctagatccttctatacccacctttccttcatgcaggtaccctcagcatagtttttcctctgtattgcagtttttcttttcaacgtgaacaaacaacagaaaagtggaaaaagtacaaatgtagttcttttagttccagtcaatgcaacacctgctcattgagcacccatgacatatgggccttgagctggctctgggaatggtgcgttgaacaattctatagtggatttatatcctagagatgtgtttgctaccgtgggggaattcagacacacgggagcttctcaagagaagtggcgtgtgagctgagtcttctcttcgtttcaccctaagcagagaaacaacctttcccaagagtccaaggtgggaaagatagcaagtgctgttgcagtgtcatgaacagtggggaaaatggcttgagatggagccagagaggtattgaaggcattggagtggagaaaatcacctagagagcatgaataggtgagaagagcagggagtcctgaaccaccttcaggcaccctctccagtactttggcattaggtgaggctgaagagccagcaaagaacacagcgagataggagacaagtccttgctgttgttgactaggtctgtgacctacagtgcattattttacccttgctggggcccagctttctaatttgtaggaggaagcgggagtaggcaattcctcaggcccttcccattgtggcaactcttactctatctatgactgtatgaataccgtatcattgtaacaccgtttatgtagtttagtttaaattttcaaattgctcttgagtattattagtttttgtgctcttcccaaaaattatgtaaggaagaaggaatacgtagtattcaactcacagattcaaagaagtgatttcaagtggccttgatacacgtagaaatgtaaatacacttcgtgcagtacaataagtgtatttttgtattcatgagtgtgtatgtgtgtgtgtcatccatttgtgaagatggacgtttactaatgtgtagaagactaggcttaggcaccatagaatgttatctattgtttccagtgggccatatttatcacaagtaaacaagacttttttagccttatatgcaatctggtgttgatatagtcaagttcagaattaatgaacgcttctgattagagtgcctggcacagtattaagcataatgtttctaaaatatggggagatgagggttgaaagaactcaaagaaggtagcaccataactagaactatgtatgcgtatgcctttgatttaatttcaagaatagttctgttttatgacacattttaatgtttaaaagccttatgtatgttttaaattataggagtaataaaagttgataaattatttcaaaattatttgaccatttgcagatctattaataaatcattgcttaatatgcattttggggcatgcttaatgtatcgagatattatatattcaaaattaaacatttaatgaataaacgtagattagaaagcatgtcgtatgtctggtcctagactgtagggtgtgtaatggacagatacagtgagagagaacatccaaaaatagcactgcctgtacacagtgatataccagattacagttcaaagtgtcttctaggactaggatataacaatttcataattttctttgcttaaatgttttcaaacacatcttctagtgctgaaaatcaatttcccatttctcaaagtaaacatttgctctgtagccaaaagcagtactttaaaaaataatatcattgaattcaatttattgggaagatttgccagacaaaagttaacagggattgcatcctcaaaaggaactggttggcttggggacatgaatgagggaacataattttggtgccttttgaattatgctcaaatgtatgttttgcctgctcacatatacaaaaaaattaaagtaatttcatgatttttctgctttaagatttctttctctcaagcccatttcccacttacttccacatcccaattcaaagaatattcacttctcattaattctctgatcagatctcttttaggatcatgagcacagttgctaagacactttagtcattaatatttgttaattgtgccaacagcgataatgcaaactttgaaacattttacaccacaattatgccttattaaaacaatttgactgtattaaatgtgccttttgtgtacatctttgtaattatcaatttatgagttgaggaactaaaattattggtgtgcttttcctgagagaagagatacaggaaagtgtcacagatatttgcacttagagaaaaagtttacccagaagaacttacaccaaaatgtattgtcattattttctggaaatacatcaaaattcatataaaatgttatcttcatggttttaagcattcacctctgttctagaagataataaatacctgcaagtttttattgggctattactctgtggcagtaaatatgaaaagacccagacacatgagccatggaacacacaggaaaacaaagtatttactcatgaaaaccagtttgtttaataatgacaaaacatgttgacagtactctccagcaatactcagaatttacagttttagcgtaacatagctgattctcacctgcttccaagggcaattaagatcaaagcttctttaagagataagtatccaaattttagtctgtgttttatcctggaagtcatcttcctctttgcaaagatcaattaaatcacaagaccacaatcagttaccacagccggatgagcctggctgttaatgcataaactcactccctcatgagaatcctcaggaaaccacatgggatatggggcaaccacttgactgtggatacttcaagagtaggttctctgacttgggctccacccccaaggcccccataatgcccactgtgtttgctttcagtgggcattcagcaaaagccactgactggttaactgacctgttggtagctaccagaaaaaccagtatcttatcaccgaagagcagataaaaagaagattctaaatcaactgagacaagtttctgcctaggatgccttgatgtgttgatactcacagggtaaataagagacaaaatcagagaacttgagctgatcagctgagtgggtgcctggatactgagggtaatttgtagggaaaatttagtagttggggaactagcagagactgcaatatttgtaagatatctttacctacaagtaaatgatgctttggtttactgaagtaataaaaagttacagatgccctaatgtggtaggaatcaagttagacatatggttgaagaggagaaatgaggactcagtaataaaagaaagcataatggaaactataggcgcatttggcattttcatagataataaatacatatttaattatttttgtatgctatttctgacctgtgatatttttgaatatttactaagtgtacacatcaaggttggggaatttttatattacataccttttttagtccttaacaacaattcaagaaaagaggaaaaatcattatcctcattttgtataatggagaaactgaagtcaggcaaatgaattaacttgcctaatgttccacaggcagaaagccatgggatttgaattcgcagtggtcatatttcccattgtaagcattcataagacatggtggccaaggagagcaactggggcagggtggggttttgggagtgggagtggggtggctgttcccatcaccagggaaacatcacctgtactctttcctttggctgaactgggatggtggatcactgcatttctttggatgatgagccattataccttcaccagtaatcagcctacccattggccacacacacacaagtcagacatgctgtgatttaagtgaatagtacatggccctgaatgcactcttataattttgattttggaaaaagaaaaacacaagaaaatatattaattcctccttgtcttttgagatttatgggtgtgcagaggtactgtaggtcccatgtcctctagtgtatcacactgtcctgagctttaattcaggtctaagaatgtctgtcctaccctctcaaaaatattttgaatggaataaatacctcctagttactgtctctttctttttgtagataatttgcccctttggctgacattatctttcttactaaacaggagtagtttttatgacagcatttggaagatgctgatagttaattattcatccaatgtctattaaaagggagaggtggtaaaaaacaaaacaaaacaaaacaaaacaaaaaacagttactggctgggtgcagtggctcacgcctgtaatcccagtactttgggaggccaaggcgggcagatcacaaggtcaggagatcgagaccgtcctggataacacggtgaaactccgtctctactaaaaatacaaaaaaaattagccgggtgtggtggcaggtgcctgtagtcccagctactcgggaggctgaggcaggagaatggcgtgaacccggcaggtggagcttgcagtgagcggagatcacaccactgtactccagcctgggcgacagagcgagactccatctcaaaaaaaaaaaaaaaacaaaaaacaaaacagttactcgtgaattcagctagaattaataacatttctatttgtattattctaactgatgatttaaaactatgcaaattgttccaaaatgtttgttcttgtttctctagatgcaatctccctcctttgtcaagtgaatacactaaggatgttggatccaaaagtcagttagtgacagctaatcccagcataattcggcaaaggtaagagtttatgacttctgtttgtgacgaacgaagatgaagtcttctcaagtacttagcatttcaaaggcagtgagcataattcagtttgggaaatcaagaggaaaaccatctggacaggcaggaaggatgaagggaattgtaaataaagaaaacaggattatgggaatccaaacaatattttatgcttcctctgggattctgtttcttgcctttagagatgatagaaataacaagaagatcaattgttttgctcaaagaacagcacaatactctgtttactcattactgctacttttcaatttgttggcttcagtcccaatttattgattggcaactgtgaactgaattaatatcaagaataaaaacaaagcaatggccaatccattacattgctttggccaattcatacatgcattaaaatagcaatattgtcagaatggacaagaatatgtggttatagtatactgtattacattacattatattatattcaatcatatttgggagagcagatgtaaaattcttgttctaggatcaattccagaaatcttgaaattgcctggaatcttggaagctgctgtgggagctgcgggggtgggggagggggtcagtctctaattgatgaagtgcatcagcgagctatcagctgtttctccaaggactgttcattgtagagaaaggagtccgtctccaaggaaagaggaatcaagcattgctttaggtcctcctgtgtccctggcaattaggagggaaacatccagatgttctgggcccaggcgcttgtcatctaagtcccgtccaagtgaacagcatgtgtgttcacttattcacaacgtggcactacttgttttggttcataagtattcccataaaatagatatctagaaatgcaatcagcttttaattttgggagatattgttaaattaccctccccaaatgtaccatttatcttcaataatggataagactgcttgttacccatatgtaaaacaatactatttgtggaaaaaaaggatacattatattctacttaatttgcatttttctgaatataataagagctgagtggtattgactattagtattttttcttctgctcctttgtattttttgcctactttcgacttgctttaaaaaatatttttctattgatttataggaactctatattatggatattaagtctttgtatcaaatattttattctagcctgtcacatatattttaatttatattctattgcaatttaaaattttttatgcgatgagacttgttagtattttcctttatggcttcttttataaaaacaatctttctttggatgatctttcttactctgatgctcctcccttccctgaaaaaaatatcctgaatgtttctaatgcatttatagtatatatttagaaatgtaatccatgtaaatgtatttatttttgttcttataagagtaattttattatttttcaacacaaatgtatgttcattataataactcaaacagaaaagtacaaagaagaaataagagaacacttacaagaaatttttttattaaaacaatttatttttaaatacctgtagattcacagaaaattgcaaaaaacaatttacaagaaggctctacataatctttacccagtttcccccaaaggtgacatctttgactattattttgatttaggaataaaataacttttaagaaggaacacatgttcctttggagggaaatgaaacattcaatattgtattgaggaccagaagattctgtttttctacctgaatatgtggagttgatgtaagatttaaaaaggaatgtgaaaaagaatgttcagagcaagatttagaacaagctgagggagagagggagggaaggaaatgagggagggagggaaagagacgagggagggagggaaggagatgagggagggagggagggagagactgttttgggggaaaaaatataaatacaaatggaggaaggacagggtcaaaaattaaattttgaagaggaaagtagaactgttggttaagacttaagctcactatgaagaaaacacgcatggacaagcaagaatcattattactaacattggtaagtatttagttgacattgctgtgtgccaggttctgtgccctttataggcagttcctcacttcatccttgaaacaatcctaatagacagaagctattttaatttatgcatttgacagaagaagaaacctgtgatgtggtgaatctaggaacctgctcatgcacacagctgctaataatcgcctgggacttcaccaggcctctcttattccaaagcccgtgctctcaaccagtgaccatctctgagagaaaaaaaaaacccaaactgctttttcctctgttctcacactacaacacagaagactgtgacaaagaaccagggttggggggtctggctctttccagtgaccggtccccggcccccaccctgaagctgcataaggcctcaatcaactcattaacatgcaaaaagatagcactgtggagtttctaaagattttaggcattgtacgctacggaatgagatcgaagatctcaaatatctatttcataatattgcaccatcacaccctctgatctttttccaaaatccatgtgtcgcacaaggagacaatatagttttcccagaataatcaacatagaaaacttctgccaccaagtgtgtttgtgtttttcccccacacaccaagcaagcaatcaattctgcagcagacaccagcggggtatctccaactcaattccaacactatctacagatagtgtcagatcccacagattgagggctcagtcccacaagactaccccccacccccaccagtcacaagtctaggcctccggagcttctgactgactggcttcaagttggggttcccccaactctctttatgggtttgattaatttgctagggcagctcacagaactcaaggaaacgcttatttacgtttactggtttattatgttacaaaggattcagatgaaggagtgtgtaggatgagggatgggggaagggacatggagcttccatgccctccctgggcacaccacccccaagaaacctccaccttcttatctggaagctctccaagccctgtcctttcaggtttttatggaggcttcattagcaggcgtgattgatgaaaccattaaccactggtgatcaacttaacctgtaacccttttctcctccccagaggtcagggagtggggctgaagtcccagtcctagaatcctgccttgattctttgcagtgaccagccccccactctgaagctgcatagggctgccagccgtcagtcaactccttaagatgcaaaaaggtatcactgggagttgctaaagattttaggagttacgaagtcgaagatcaaatatatatttcacaacattacactatcacaccttctgatctttctccatgattcatgtgttgcacaaggagacagtagcattttcacaggttataaataattttgtaaaagtgaatgaaagtttcttcattttaaaaaatgtattcaatgtaacaaggtttctgttcaaatcaatatgtgtacaccaattccattttgtgacataagaaaaaattacatttacaatagcatcaaataatatgatacacttaattaaacaagaaagcaagtcctctttggaaaaaatatgaaattttattgagagacactttagacaacctgattagatgtactataataccatgtgcatgattgaaagactcagtatttaaaggcaccaggtctacccaaatctatctacagattcattgaaattccaatagaaatcctaatgatgcatgcatgtgtatgtgtgtgttaaacttaaaaagttatgtagaaatatgccgagaatagcaaagaagctcttgaagaaaaaatgatgggcagagttgctctataagatgttaagacttattaaaaagctattataattaagacaatgtggctctggtgcaaggataaaccaactgagcagtgaaagagaataggctactcccaaatatttccacatagatataaaccagtatatatgacagatgtcatatttatatgagtgatataaatatgaagagccgagaatagcaaagaagtataaacttttcaaaatgatgttgggataattagattacacatgggaaaaaaataaattaaacctctacctcataacttataccaaaaattattttcaggtggttaagacctaaaaatgaagttgctgggcctggtggctcacgcctgtaatctcagcactttgggaggccgaggctggtggactggctgaggagttgagaccagtccggacaacatggcaaaacctcgtctctaccaaaaaatacaaaagttagccaggtatggtggcacgtggctgtagtcccagctacttgggaggctgaggcaggagaattgcttgagtacaggaggtcgaggctgcagtgagccatgtttgtgccactgaaccgaagtctgtcgagtgagacagtaaaataataataattatttaaaataaaaaataaaaccaactaacaatatggctagggacaaagatgtagcaagtaaaactataaggaacaataagtagtcacttctcagggtaggaagagtattggttcaggtgtggaataatgggacctctggattgctagaagtgttctttttcttggccaggctggtgtaacatggatatacactttataatgattgcttaggctgcacatgtatgttagatgcactcttcaatagatatactttactaaaaacataagaaaaaagtatgctaagtgatggaggactatacaacttatagttaattttaaaggttctcagtttgcttttttgacataattgagttcgagacgtatactagagtgtaagttctatataaaaaggatctcagtgtcttgaacataaggattgataaaaacattttttttttttgagacagaatttcattcttgttgcccggactggagtacagtggtgcgatcttggctcactgcaacctctgcctcccggttcaagagattctcctgcttcaacctcccaagtagctgggattacaggcgtgtgccaccacacccgggtgattttgtattttttgtagagacggggtttcaccatgttggcaaggctggtcttgaactcctgacctcaggtgatccacctgcctcatcctcccaaagtgctggcattccaggtgtgagccactgcacccggccaataaaaatatttgaatagaaatatagttaaagccttatcagcaccactgtcagtgttgtgaagctctgtgctcaaattggaatacaatgttttaagccatcaattatcaactttccattttatagaagggatcaaacaggtagcaagtgctggaaacttttggttaaatacagctgagactgcattcatagcatcttgttcatgtggctagcagtatatgcaaacagggtggtaaacaaagtgcaaacacttgtatatagggattaaaatatagatgatgctatactctcatggcacagtaaaatggaggaaataatattgaagtgagaaaggcagtatgtatttctatattagaagattatcctatttatattagatattttattcatatctcgtagtcttctctcaaagctgtgcaaatccaagacatcagtagttatcttgtactttcatgtgatgaaaaattaaacttgttgggcagagatgtgcagtggaaatgctaattttcatagctgtctccaaaaccttgattctcctaaaaatattctatcagaagttataagcattaagagttttcactgtaaaattctgttagaaaatatcagtaacaagataaaacaggttttagaaaaattaagcatacatatgtgagaggcactcataattatagtgaaaaaaagaaagttagagaaggcaatacttattactctatctaaaagaaattctcagtaagaaggagctttgctacagtaagaaggagctttgctacagcctttgttaggatatcttgtttggagtgcattcttcttgacagtacccagaacaaaaagattagttagggtgcctgagacataagattagaaagggctttgcagtcacattcatcctctgattgaatttttatgggcagaagagaggtggttttaatctggcagctggatatttaaactccttactattatcctttttcttcctttgctggcctttgcaggtggaaggcagaggattcatacatatcattacccttcatcaatgcaccatctgtagcccttgttcttaaaacattttggttcaaatactctttattttatttgtatgaatttaagggatatagtgccattttgttacatggctatattgtgtagtggtgaagttaatgttcaaatatcctttaaaagattttttaaatccatcattcccttgattatttttaattaacctaatttttgtggcataggttaaattgttgccaagtacggacttttcagggcattatatacatatgctttaaatatatatattgtcagaatttcagaagtgcagatctagttcttccaatgttacatgtcctcttggcaaaatcagtctctttgtcaaattaatttattaactttttgtcagaaaagatggacgatggactactgtaattcaaataagtgttacagtataacccaatataatgattgggtttaattatattggatttaatataaacccacttctcaggcttaattattcaacatatacagtatggggaactgtcaagagtttgtcccctggataaaataagacacagctcctttctatttcttctaaatacatttttgcttttgttcaggggatattccctcagaaggtatgtattttggaaatgtttctttgtttggtggcttagtggcttttatcctttggggcaatgaatcattataatatttgggataataggaggcatgactttcttttatgaaatagaaaaagaaaaattatggaaatagaatttggaaaagagagttctttagactgtcagattggtcttgagcaaatatatttgagaaaaatatacatatggagtttgaaggtctggaagtttatgggggggaggaggaataaaatgagagccaacaaatatttcttgaaatctactctgggacatgacattacaaagttgaatgagatggcctcaaaccctgaagttgctcacagaagcagacatgtccatggttgtagtgtccatggaagggattttataaatttgagggaatccttctatattagtccattcccacattgcttgcagtgagcagagatcgcgccactgcactccagcctgggtgacagagtgagactccatctcaaaaaaaaaaaaaaaaaaaaataccggagtctgggtaattcttaaagaaaagaggtttaattggctcctggttccgcagactttacaggaagcatgatgttggcatctgcccagcaactggggaggcctctgtatactcacaatcatggcagaaggcaaagggggagcaggcatgtcacatggcccgagcaggagcaggagcaagagacagcgagtgagctgccacacttaaacagccaggtctcatgataagtcacttactattgcaaggaaagcaccaaggggatggtactaagccattgatgagaaatcgtccccataatccaatcacctcccattaggccccacctccaacattggggattacaattcaatatgagatttgggtgtggacacagatacaaaacatattaccttctgaaattatacaaaatgttctctacagaaaataataaaaacttggctgggcatggtggcatgttctggtagtcccaggtactcgggaggctgaggtgagaggattgcttgagcccagaaggttgcgttagggttagggttagggttagggttaaggttagccatgattgcagtcttgcctgggcaacagagcaagaccctgtctcaaaaaaaaaaaaaaaaaagagttggcatgaactaggaaacagaaatgtatttagaacaaatgtagtaaaaatcatggtggagttaaacttttaaaatttgtaaatgcataacttttaattcaataaggggacttgatatgagacctcaatatttattttgaggtataacctgagaaatatcttcccatacaagtagaagagattttatccaatggttagtgcctctaagtttaataaagggaattgagaatgtagagataatcgcagggggaacaattgtttatgttattagtgtgctttttaaataataacttgagctttgaggaaaataacttgggtccaagattacagcaatttatctttaaaattgtgtacaactcaatgtacacaaactatacatgcatgtttcaaactgtgttcctaaaacttccatatctcttttgctgtctgacttctttttttttttcctccaaactcagagcagcttatcattgtttgtatcaaggcttcaaagtcattgatagctatttattctaacatctgttctgaaataagggaattagaaggcagataataaaactgaaactagagatagcaagtaggagatagaaaagaaaagcccctaaaaatatggatacatggagttggtatctgagaggcaatattatatagcagtgaagaacacaagttttgattagaacggatttgttttcaaattatagtgctagtgctagtaagtgtttctgcctactagctatgtaaccttagttacttaatgtaccatatgtcaattgagtataaatattatttaccttggggactgttgagagatataaatgagataatgtaactgcatctagtagaagctattctgactgatatccaaattagctactcaagaggactctccagttgcaatacattttgttcttggataaaacatattatttaatacattattgtactcatcagatttagagaaatttccaagaatatctgcatgcccaccttccccacaaaaaaaacaaaaacagaaaatgagggaacaaaaaccagaccaaatggtgtgaattataaaagtcaggtaccaaaacttagaaaagagaccaatctctggactcaccatgttgagggtgtcccatattaagtcctgagaaggagcctattgtggttccaggtcagtagcagcccctggcttccaacagaagcacacaaatttcttctggaagaaagctcatagaattctcacatactatgttcaaacaaatgatagctcataagcaaacactcaaaatgcacacaagccatcaatagtgtaaattctcagagacaaaaatcaaacaaaaagtaccagatgaatttaatgcctgagaacttattggaattgtcagatgcagtagattactaaatatgtaatctttatagaaaataaaaagaatgagaagccaataagagaatatccaaattaaataggtagacttgaaaaagacctaaattgaacttttagaaatgaaaaatataattgttgaaatggaaagacatcaaattagacataactgaagagagaatttgtgaactggaatacagagcaaataattttccagataatgaggctatggaaaatacaaaggcaagacaaagaaacatggacgatagaatgagaaggagtatgttaaagtggaattgtggaagtataaaatagggataagaactctttttcagaattcatgattaatgtgatccataagtaaaaagtaatgtgatccaaaacacaaagtatcaagcagatcaattaaaatttttaaaaatgcaaacagacaattttagtgaaacagagctaaagataataagaagcttataaaagcagacagaaagaaaagacagatcacctgcaaaagaataattatactaaaaacgaacttcctctaacagtaaaaatggatgtcaggaagcagtggaagagtatcttcaaagtgctgagagagaaactatcaacatagaaatgtatattctgcaatctatttcttcaatagttgtttcaatagaaaatgttttctgaaaaacagacacagattttttacctccaaagatccttcattgagagaaaatctgaagaatatacctcagaaaaagagtatgttactccagaaaaaaaacctgggatgcaaatgaattgctaaacatatcaataaatctaaacaattttatctgtataaaacaataattattatcatacattatttttgcagatgatttgtgtgatcaaaacgaaagacaactaaaatactggaaaatgacattgcataagttaggagggggagattgaagtgtttttagctcttctttcagttttttacttcttagtgacaggtcatccttttgtcttaagcagcaacagcaataattttagtatctttcacgtttctgtgggtcaggaattcaggaagaactaggctgaacagatctgtctcatgatctctcacatggtggctggagttgaaatagcaaaggcttggagcagccggggctggccaaacatctcccttcctgtgtagtctcagggctttctgtgtggtttctccttgtgaattagtgtgggcaccctcacagcatgattgactccagaaagttggactgtttacatggcagctggctttccccaaagctagtgtccatagagaacaattggaattgcgtgatgttttaatagccttacatgggaagtgtgctagcatcactttcatcatactctattgcttgaagcaatcacaaagtcccacccaggtacaagagagaagagttctagcacagatccacctcttgttggggggggagttctcaagtcacattattagagtatgcatggtaggagagtttttgtggccatctctggaaaatataatctgccacagtctgcccttgggtcacaacaatttatatccctcacatatgcaaaataaactcattgccttcctgaagaccctcaagatctattccattacagcatcaatttaaaatccaggatctccaaaaggttgaaagaggaacagcaacaacaacaaaaaccagaaaagaataaactgaaaacaaaaatacagcagagtgggtccaaaaagccaaagttgatactttgaaaagtctaccacaattaacgaacctttagtaaagttgataaataaataataattattttaaaatagacttttcatgatttttctacaaatccatactaaaaaaacaagaaaaaactctactgtacacaaatatattacatacataataaatggataatgagaataaaatggtatctccaaacctaaaaaaaagccagtgattttgtaacttatgatatatccatattgatggtatactatacaaagatattatggattaatatacataaatggtttcaataaatggtgaaatgctcatgttctaatattaagtgaaaaaaataaatatataaatgtgtaaatatataaaattatatatatagttatgttcagagaaaatctctaaggaaaaaaaatcaacattttccaaagttgcaaaattttataatggggaaaaaaattatttaaaaagcagaccttggctgggcacagtggctcacacctgcaatcccagctctttgggaggtaggaggctgaggtgggaggactgcttgaggccaggggtttgagaccagcctgggccatatagtgagaccttatcactacaaatataaaaaataaaaaattagccagacatggcgtctatagtgctagttgcttaggaagctgacacaggaggattacttgagcctaggagttcaaggctgcagtgagctgtgatcatgccactgtactccagcctggatgacagagtgaggccccatctctttaaaaaaaggccttgttattttataatttttcctaatgttaacttattttgacaataccacagccctgtgagttggaggggcaaacaatatgaataaagccctgattttgtgtgtgggttcctgcccttccagatttaagtgagattaacttgaactccaaattttatgtacttaattcagagtcagaacgttctccacatctttccggtaaccttgtcctgagagcagctaaggtgagcatagcaccaagaacacaggacctgacacacaggagttactgcataaatgtccatttatcttctttctttctttccctctgtgaagctctagtcttcagtgttaatagcagatcagatcaaacattactctaaaagcaaaattagcacataattagtaaataaatatttgaatagcccaagttctcatggcactttcatgcaggcccactgagagtgggttgcacccagtggagaaacattaggggaggacccagcaagggtacgaggtggagaatctttacccaggatttatattgatatgccgatatgccactgggccaacaatttgtaccagctttctcccatccacccctcctcagccctctttttaaagtgtgcttcagttaaatatattttcaaatcagtaaaatgtcagtgagttgcaatttcagtgaaagaaaatgtgcggaggggtttctgtcagctaatagaacagcattggctgtgtgatgaaagatgagttgttcaaccactctctgcatggaatgtggcagaaaacatttaagtcagcaccagaattttgttttgaaggtgtgctgtctgtatatggaactgtttcttgctgaattctagggatcagggagaaactcaagggcctgtgttgtttcgggagtggaatctgagtaataggtgagtgtggaattgttgggataagcaaaagagaggggttgaggaagaaagaaggtctagagaagggagacgtggtaaaggagcaggagagaaatctttgggaaacttaggcatgttggctagaaacaaactgaaatgtctaaaatcaattgtaagttgtttttcagagagtgcgtgtcctgaaattatttccccttaattctctcttaagttctatgactcttcagatttctaatgtagccatgcatttttgtcagttttgtatgtgacattagcgtgtgtatgtgcacgtgtgtgtgtgtgtgtgtgtgtggtgaagggaatgtgcttcattcatttgggatcaacatggtttgttctcctgggtaatggcactgaggggacagagaggacctggagaatataaccctcctagggatgttcagatgcaaatcctgggaaacgccactttagcagttgactgcataccccttttggaacgtacagacaaccttttgacttacaaagctatttcattacagccaaggcatttgtgccccagcttaactgtggaaggcaaactttaagtgtaaagtgtgaaactggctaattatcttaccaattccatatatgccaagagcctctttgagcaagatggtaggggtccatctgtgaacaattcattgcacagagttgattatgtattccgtgatttcagattgtccagctactaatgaactttcttcattatcctcatgaaaacggatgacagtaacatttattagtatgtgaatatttctattactttattaaaataaaaatgactttattgctaaatttatatttgtaattcattttattggagaatagaaaccctgtagattaaatagaatatagtcccaatgattactaattgtattgcattggattatatattgtttaaaacaatatttttattttaaaaaagttttctttccaactggaattataaaaacatatctgtataagtttctgttactaagttgctttaatttgtttaatagaattttaaaaatcagagctttagtgttattgcatttataaatcatgatatgcatttttaaccgaagtttccactgtagctttcatatctgaatctctttggacacacacaccctgcgcacacacacaatacatgcgctcacacacgtgcacatacacacactaatgagacaaaggagaatcagaatcacaatgcaaattgttgacaaggtcagaatataaattagtgggacagatatcatatttgataaatattattgcaaatacaaatgaagggaaaggcagaaaaaggaagtgctacccacatggttaaattaccatattttattgattgtgagctgcacagtttttaatattttaacatctgtgaaacagctgcttcttacagcctctgttgtccagttggaagctgaggcatagttggcactgggagtacatagttgtcaccttgctcatagctgctcctatgctgtcctcctaattaaattatgcacattgttgtactgcacatgttgagtttgattggcatttaaaatatctccaaaaagattgaatatctattgtgtataaagatggaaacaaagcctgggatgtaaatttgatttgtaagcaaattacttcagagaaataatggaagcaattttatattttcttgtaaagcaacataaaaaaagaagaagaaaataaccaccagcggatgatggtttattttaagtagttactaagatgtgtgcaaaatgattgtctagacaaggcagatgaaagtaggaaaaattgttatgttccttagaatggatgaaaaatgccaaagcaagaagagactagtacaggactattcacaatactattatagaaacactgaggcatggttttattggcagtgtttttttctttatagttagtaaataatatctttttttttttttgagacagagttttgatctgtcactcaggctggagtgcagtggtgcgatctcagctcactgtaacctctgcctcctgggttcaagtgattctcctacctcagcctcccgagtagctggaattacaggcacccaccaccacgcccagctaacttttgcatttttagtagagacagggtttcaccatgttggccagactggtgtcgaactcctgacctgaagtgatccgcccaccttggcctctcaaagtgttgggattaaagtcgtgagccactgcacccagccaaataatatattatatttgataaaatataatttgttttaaacaaaaaaatctgccaattcctctgaaatacaaatgattagatagaaaataaaacagggaatatttggaggaagcatggcacataaaagaaaatactaagcactgcacaaccatgaggcacatagaactgatacgctgagaggtaagtaatgcatgtattagcattatcctgatttttcagtgaaaacttttgtgacagacaagttaggtgatttgcttcaatcagctattaagtggcagattaggcacttgaacctaggtctttggacccttttttttttgagaagtagtttgagagatactgtggaggggtttatggttggcatcgcagcttacccgtgttttactgcgagagaagagaaaacaagaaaattccaagaggtcaataatgagtttaccatttaaaagagaaaaggaggatttattgacttgagatacttgagtgaaactcctggggagacaaaaaagggtgatttatgattctgtactctgtatttcaaagattctgacagtaacagaatacatgaaaggtgaaagaatgcatgctcagtaaatgttaaaaaaaaaaatacaccaccacagtactctactcttaaacttgattgatatttttgctgggattttatttctactttggaaatccttttagcatttcgaagatgttcctccaatgtttcttcctagattcagtgttgcttctgagaaaactgatgtcattgtgattcctgatcttttgtgtatgacctgtacgtctacttacccctgcattctaatctggtcgtcttcctcgcctcatattttgaaatttcacagtgatacgcctagtgattggcttaatttcattcattgtgctggcacgcagtggaccttttcaatctgcaaggttatgtcctttcattttggatatttttcttgagttattgccttaattctgctttgccaattgcagtagtcagttgttagttctcttatttgacccaccgggaacatgtgacacattgatttttctctccttaaaccacttacttcacttagtttccaagtcaatgctgtttagattctcttgccattttattttttatttatttttatttttatttttttgaggcagagtctctgtcacctggctggagtgcagtggcgagatcttggctcactgcaacctccgcctcccgggttcaaaccattctcctgcctcagcctcctgagtagctgggattacaggcatgcgccaccatgtccggcctattttattcactttctacaggattttatccagtctcagggcttaaatactatatgtatatcctctgatgactcttaaatttgtactctgagacctattcttttatctccagactcatatacctaactcccagcttggctaatctatttggatatgtaatatgaatatcaaacttaaaataaccagtacagaactcctaattcccccttttctgcaaacctgtgtattctgtcattttccccatctcaaagaaatggaaactccatttttcatttgctcagctcaaaaaccttgaattggagtcccccttggcttattttattaaatccactgctaaattacggtggctctactttcgtattttatgaccattattcacctcctccactgtcatgaccttggtccatgtgtctcccgaataattgcagtcatctcccaataagtttttatgcttccagcctcaccactgtgctgtttagtaacttattgcctctcagctgcaaaaccactttcatataccctggtttgtgttgctgaaaccatgattttacaaatcacgtttcccccttgccagctagtttctgactgggggcactagagggacactatgggaggctgaaaggggaaagagatttgttccttcctgctggtgtcctgtgggtctcctgtctccttgtggttcctatgagaataaccctagcaaccattcttttccatagcagtagctaaattcaagtggcagcatttctcagcactttaaacttagtcaacacacatgtaagagattcttattcttgtcttttaaactttgacatttgtaaaaccacaacaacccagtctaagaataaagcaattctttgggaggctgaggcaggcggatcatgaggtcaggagatcgagaccatcctggctaacacggtgaaaccccgtctctactaaaaatacaaaaaattagccgggtgtggtggtgggtgcctgtagtcccagctactcggggggctgaggcaggagaatggcgtgaacccgggaggcggagcttgcagtgagccaagatcgcaccactgcactctagcctgggtgacagagcaagactccatctcaaaaaaaaaataataaacaaaaataaaaataaaaatcttattgcattagcacaaagtagaagaattagtttatccttggccatcccaaactcttatgcttctttattctagccaggcattttcttcccacatgggctggtttttctactttaaattatcatttcatcttacaattgtatcctgtggtactcttcacagctcagaaaaaaaaaagcttattctaattaatttgataaaattattagtctcttacctgttttggagtgaaggtgttagtgatagggtggtgatcgtggaacagttggaatgtcaagtcagcatttccagcaggacatgggtctttggaaaatcacgtgcaacattgttcatttaattcatttggaaattcattaaattttccaaatacaagtatttaaatatataatattatatatgtattattatgtctattatatatttatatataattaagtataattatatctataaagtatataattatatatttaaatactcatgctcacttattttcacaactcaacttacaaaacatcaagctcaccaacatatttctagttttttgggatatgcagagatgtgattcttagaagaggcctcactttccctgggaagtgcatcagaatcggcagaggcagtggcccaagagatcttaatgtttattaaagataaatgtgggttagaaacaacagcctggggactgctgctttccattaccccctccccaattgtggtatccttgctcccattcccagtgatgtggtgttccttggttccaagagccccatcccccagcaatgccctgtgattcagatcttctcaactcaatgtctagtctctactctattcaagatgatagtgagtcatttgataaacatatctttgttgaaatgttagtagtttataaggggtaatgttttacttctctctgtggttttacattttaactggagccaccctgaggaaactaaatgctttaaagaaatagaataattctttaactggagaaactgcagacactttgactgtcttgggagtgagggctgggcaggggattttagacgggggattggaaaggaatccttcatgttctttacatcattccatttatacagctagttattcctagggctgaccttgctaccacaagattaatgatggcttttggagaactaatgggaaacagactctactcttttgtattacagagccccagagagggcaggattcagagtctatagctgtgctctaagactagaggctcttagaaggttgcctttttcatggtttacatctcatggcaacaaattctgtgaaaaaaagagatttcattcctcaaatatatgctagatcataacatgtgcctgatatcactaaaaccccagaaggcaaagatttcataacctttagatggaaaggttttctgatttttgtgtaagagcattattttgtaagagcttgacactatttgtttgaacaattgttaaataaatattttgaaacagagatttaaagtcctggacgaatgaaactagtggttaccggtacttacattacttgatctctgctgcacttaacacatgtttctgcattcttgatattctttccaccctatgtcccaacacagctctctttactgtttcttgttatcttcctttgttggttttcctttcatctgctaccttaatgttggtgttcccaagtgttgaactaccactagttcagacctgtcccaggccttgaatctcttctgtgcttcagacagctatgtgtctactggccaactccacttagaaatccccaggtacctcatgtttcatatgtccttaaagtgaataatttttctcccatcaaaccatccttgatcctgtagttatcatcacagttattggcaccatctttcaagccatcatggtggataaccttgaagttattctttttttttttttttttttttgaaacccggtcttgctctgttactcaggctggagtgcagtggtgccatcacagctgactgcagactcgaccgcctgggctcaagcaatcctcccactttggcctctcaagtagctgggactacaggtgcatgccaccatgcccagtgaattttttgatttttgtagagacaagttctccctatgttgcccaggctggtctcaaatccctggcctggagtgatcctcccacctcagcctcccaaagttttgggattacaggcatgagccaccatgctcagccattgaagtcattcttgtacatcctcattgtcatcatccctatctattaatctacaaacactgttaatatcacttttacattatccatgaactctgttgctgtctcagtatttccactgccattgtctttgttcaggctgttctaatcccttgctgaaaatagtgtcctaagatcttccttcaacacccctcccctgtttttttacagtatagatttgtctttaaaatccagagtcaatattcttcactggctccccattacttttttttttttttttttttggagatggagtcttgctctgtcacccaggctggagtgcagtggtgcgatctcagcttactgcgacctccgcctcccggcttcaagtgattctcctgcctcatcctcctgagtagctgggattacaaatgcccaccaccatgcccagctaatttttgtatttttagatgagacggggtttcaccatgttggccaggctggtcttgaactcctgacctcatgatccacccgccttggcctcccaaagtgccaggattacaggcatgagccaccttgcccagcccccactaatttttaaatggaatctcgggtcatcatccccaccactgtctcctactttcttcagatgccagtatcacttgtcactctccagggaccacactcaccagtagctctgcacacatgcaatgtcctctgcctagagagtctttctttgtattgtcccttacaaggattagctctccaatggcaatgactctgtctctttttatctttttattctcagtatctagcagagtgtttaacacagtgagtcattagcaagtatctgggttagtatgtgccattctggtgaaatgttgtattccaacttttaaattaaattagcataaataaacacatagacaaaaaaatctacaagagaactgaaaaatagggataagagaaaaataaaatgctagaatctgcagggaatttccactaactgcagcaaggagagggttgggttgagagtcataatctaaactaagcctgctgaaccagaatagcacagaaatctgggaagaagatgggaaaagactgtgactcaaccccactctatccactggcaaagaaacacagaaaatcccaaagctgtgtgaattcttttcttagctggctagggccatgccctttctgctcttaatcagttcttctctttcctcatccacttgacaaccatacttcacaatacacaaaactgccatgggtagagagggaaaagtagaggcagtatcactttgcaggctgagctgtgtaaagactttaggaaaccattcaaggagggaagatgagaagaagagcccttagaacagtgcagctggaggtgcaatttttatctctatcactaaaggaagaattaaattctgcgtatgactccctaaccatcatcagacaacctgtcagttggagtagaagatcttccctcagtttagcaaaaattttagatgattgtttgctagacatgagaaaccaggctcaggacttggcactgtggcattctttgtaagtctaggtctaagaaagaaaatgcacaaatactcaaatgattagtgcctgaagataaaaggataccatatatacctttttgaaacaaatatggttctggaataagtttcttgctttatgtttgtttttctactatttaagagaaataatagaaaaaaaatttggtatagaacacctcaaaacattttttttgtgtgtttttgttttgttttgttttttgagatggagtcttgctctgtcgcccaggctggagtgcaatggcacgatctcggctaactgcaacctccatctccgggttcagcaattctcctgcctcagcctcccgagtagctgggattacaggcgcccaccaccatgcctggctgatttttgtatttttagtagagatggggtttcaccgagttggccaggctggtctcgaactgctgacctcgtgatctgcctgcctcagccttccaatagtgctgggattacaggtgtgagccaccgcgcctggcctcaaaacattttgtaacacagaaaatgtgacttaaagactcagaggaaaggtcaggtgtggtggctcacaccagtaatcccagcactttgagaggccgaggcaggtggatcataaggtcaagagatctagaccattctggccaacatagtgaaaccccgtctctactaaaaatacaaaaattagccaggtgtggtggtgggtgcctgtaatcccagctacttgggaggccgagacaggagaatcattgaacccgggaggcagagattgcagtgagccaagatcatgccactgcactccagcctggcaacagagccagactccatctcaaaacaacaacaacaaacaaacaaacaaacaaaaaagactcagaggaaaaacacgcatataaacatgctttcgcagaggaaatagaaaaaatttcaaagccttagcttggtgacttaataagaattgacccattaggtgcacagagtggttaggagaacaaaggatgagctgaaagttgagatgaaaagagagatggctgagagcaggcagaattgcaaagaaagcaataaagttcatgttggatgttgcaaagagcagagttacagtgcagaaagtaaaccccttaatatttccattttaagaatgtcgaggaaaaaaactcagagagatgaatataatgagaaaaaaaagatgaaggaaagggaaaggagattcatcctaaagatgacaagtttgctgaagaagaatcaataaagaattaaaaaaagtaatcatcagacccaataaggaaaaaaaaaaaagttttaacagccataaggctttccagagctgaaacaggactgggtccacaggcagaagtacttagttacattccaggtaaaattaatgcaaaaagacccacatttagacatattgtgatgaatttttacacttcaaagataaagagaaaaactctacaagcatccaatcagaaaaatgtgatttacctacaatggagtaagagtcaaggtagcttcaaacttttccctatcactaaatttcaggacagatgtcatggtaagtaccaagatgtgaatgattctttaaaaagtctagccaagttgtcatatatataatacgagggctgagaaaggttatttctcgaatattcttcttgaattttttgagtataaaatatgtactatatacatatgtattatgaatatgcactacagctgagagtcaaatattcaagaataagaaatttgcagtataagatactgatagtaattcaaaagcaattaaaagtatacagattgaaacggtgtgctggtaaatattccaaaaccagctctggggtggggaagaaagccttcatgtttagtgtttgctgatatacatggtgtaagtgccgcccccacggccaattcaagctgccattgtgatgttaatgtggagttggggagtgataaaaggtaaattgaggtacactaaaattttaaaaagttgatttgagcaaacagtggttcttgtttcacaaagcaccaaaccaaaggtggtttcaggctttgcagagggaatgcaaggagaaggctttttatggggtgaacgctgaaataaagcaagaaaacatttgattggtaacagttatagagttgccttaattggtctgtcctgcggaaaagtgtttagttatataaccataagtttgttcgttggtggctattgagcttaaaaagtttcatttttctttaacataggtgtttacaagaaatattaatagctcaagttttgtttcacttatgtttgcaaatcaagcaaggttaaggccacttatgagctctgactggctttgtctgctcaggaattcctcagccctggtctccattttaatttactttaataggagaaatgtgagcaattggtcctcacatgcctactaggatccagctactagtaggatccagatcctaataattaggatctggacctattagttcactctttgagcacaaaataacttaaatcttcatcagaggccatatatcaaaattaactgtataatcattttattagtttcttagggctgctaccacaaattaccacaaaccacaaaaacaacagaaatttgttttctcagaattttggaggctagaattttgaaatcaaggtgtcagcaaggtcaggctctctgtgaagtttccagggctctagaggagggtccttccttacatcgtcctagcttctggtgctgtctaacaatctgtagctttcctggctgatagactcagcactccatctctgcctctgtcctcacacagcattcttcctatgtatgatctatgtcactgttttttctttttataaggctgccagtcattggatcagggctcaccctaatgtgctgtggcctcattttaacttaactattatatctacaaagatcctgtttctaaataaagtcacattctgaagttctgagtgggtgtgaactttctggggatcagtacaaggatttgacccaagagaaagattcacacattaaatgtaagaaacagactacaaaaattaaaagcattagtgtgaatacttatttgtcttgaggatagagtactttctgctggcagaaatcaaagaaaaatgatttatacatttgactccaaaaatttaaaatgtgttcttgtcaaaaacataaaatctaaaaaccgacaattatttgggaaaaaattgcatcagagataccaagataaagtataaataggccaggcgcagtggctcatgcttataatcccagcactttgagaggccaaggtgggcaaaaccctgtctctactaaaaaatacaaaaatgagccaggcctggtggtgtgcatctgtaatcccagctactcaggaggctgaggcaggataatcgcttgaacccaagaggaggaagttgcagtgaccagagattgtgccattgcactccagcctgggcgcagagtaagactccatgtaaaaaaaaaaaaagtataaatatatttttatatatttataaagatgatatgtaaacaggtatgaaaaatattgtagtctcaggagataattggatgtagaggtagaaaagtcacaaaggagtaaatacagttggcttgtaaaataagtattcagtcatattaataaatatactcacattagagctggaagcaaattatctatttttaacaaccaaagtagaaaaataaagagaaatgataacaatgctgctgtatattctcatgcactgctagtgggagtataaattagtacaacctttcttttaggaaaacaaaagaattgacatgtatcaagaatcttgaaaatgttcctaccttttgaattcataataacacttctaaaaaagtcagaaagtaataatctagcaatgtataaaggataaagatgtagaaagcaaaagaagatataacagaattaagtattattttgcacaattagaaacattctattgttaaggatattgcagggaatataattcattctaactagcctaagcataaatgggtttatttaaagggattttacagctgtcgagagggtgaagaaatagattcttgattaaggaaatggaaaacagctccaaaagccaaatgacagaacgtctccagcaatcaatagactgcagaatcagtcagaatcagaatccctgccacgttgagaagccacaacttcagctgctcactccagactcatgctgcttgaatcagaatctggcttgaaaaatgggcccctgtctcctcatttaacccagttcagaagtcaggactcacacaggtacatgacattggctgcgccagcatcacagctggaatcccggctataaagaagtctgagaaaggcagttcttagcttttccactttggactacaggaagatacagaaggaggttgaaatgattattttgtgatccagtccatacatgcaccacactctaaacattcaaattataagaaatgtattcaatggctttaaatgactctgaaatacttttgattaaacattttttaaaaagcatgaaatagaagcatatataatgcatgatctcatctatgtaaaatatagaggacaaaacacctgagaaatatgtcagtgcattaaacacttgcatgaaactgtaggagttgttctttttcttaattataccttttctgtttcctaaaatgaacataaattaattttataattctcatttcccatcaaaacaagcaaacacatgtttgttaaataaatgaaggaagtattgaggacatgaatgaaaagaaaataaatatatccatggctgtttctttcgctgttttagggtttgaagagatcccaaaaaggcttgttaatttccctctaaatttggctctttcacatcaggcatgagttgtagctgctgatgaaatactagaggtagcacaggctagtcatttagactggaatttaggggtatttgtgtatttatgtgtttctcttgggtaatatataaatatatgtgtgtatatataatatttgggttaaagtatatgactatttagaatcttacttaatattaaaatgtaaagaaactaattttatttatcaatcataaataaatcaatgagtacagtgattgcttccaaagaaaacaaaaacctagagatacagtgtatataagtatatgtatatatgtatatgtgtatatatatatatatggtctttttctagttaactgtcaataagattacttacacttctttcacatacagtgctacttttaattaaaatattattggtattttgaatgaatactttttactgcttgttaactgtgataaaaataataacttcttcaatgtcttttctctcacttctttaagtattagagattttctttctggaaaattagagattttctaatgtaaatccactaccaaaataaaaatactcgagtagagcaaaaagttactgtctacagtttttccctcgtgaggcagcttctcttgctgaacatgtttggaccaaactttccaacttagcatgtgatctagcacaacgattcccttggagattctgagggatgatttgactgccctacctcattacaaggaattccttcagtgtgatgttaaaaggtgtggactaatgtgttaaaattaacccaataataaaacaagttaaataagttaagtttgtttacttaagtttgttaaatgttaataaactttttttttgaaatttattcttaatataaatatatttggtttcttatcctaatacattgcaattataagatgtactattaagaagattccaaagttcactgtattgtgcagtttttttaactttcttttccatttttgaaaatgggtgaagaatggtggtattagccatattttagagagagaggagaatgactgctgtatatacatgtaacatacgcaattcgttattcaaaatactttttaggctaggcagacagtaactgaggacacttagaaatggaagaaattactatttgccctacatctaatataggtataagcaaggaaaaggtttattttaaaagctaatccactaacacttgaatcacaacgtgaaatgaaaatagatgttctgttttcaacaactgtaatataattaactcttaggctctgcttttacttagcctctgaatcaactgttttgcagtctactgtggtttgtttggggctgtttgcagcacatgatttaaagaattggaggtgaaatgaaatgagtgtataatttagtctttgaaattgaagagagcaagtgagacatttcttctcacctcctcttctttgttattttctacactttgctatttctctcttcgtctttattcattgtggcagataaataatgggatgagtgataggaaggaaaatgatttttgttctttttctctttttgcatctcaacctctttaatcatacaagtttttgattgcctattttatctttgctgttgtttttggtaatacctctttatttacctcctcttcctcttgtccttttgcttcccattcttctgttctcttttttccctttcttctccatctgtctccactcatcattttttttctttccaggtgatgatgtaaattggaaagttagggtagtggtattgctggtgggcaaggtaggtgtctgaaataactgcatgcttctccaaggagactggtggcctaggagggagccatcttggtgctaggagagaatgaaaaatggctgaagggaatgcccagggatggacttgagatgctacctccagttctccatagcctgcatgtgatattttgggaatcatgacatttccacactgccaatatgtagaaaagcactaaaagtactgatggagcaaaaagggctgaaggcagagaaaaggcaggcacggattactgggacagcagagaaggttagagacttgagttctggttgtcagcttggtgtccagaaaaaccagacataccagccatgcagacaccaccagtgccaggtcccaaggacaagctcagatcaacttcaccacattggagacagcataaggatctactatttccgtgaggatcctgggagggaaaaattagctctgaaggagttttgcgttttaaatgaatgaaatatttgcccccaacactgtttttactttgaaagacacttaattgcttttaattggcaaatttaagggtttttcttccgccgtcagtgaggatgggaacatcagagtaagatgaaggcaattgcagggggaaaaaagttagacttttgcacatgtgagttgtgtataaattttcaattctgctattaggggtgtgtatatgaaagacaaaaatccgtatgttaattgaggtcaactctgaatggtagaattgttaggtggttattgttttccttctctgtctctctctcttattcaatatgcatttattaaacactgtccctctgccaaacatactcctttgtgcttatctttatttctaaatttctctacaaataaaatatttctgttttacttttgtgaagaggaagacataattgactgttatttaaaaataaatctatcctattcactcactgtagtatttgagtgctcgtgtctcatcatgtgagttgaaaacaaggccttggagttgactgttctgttcctcagtatatgtttttgaggttagttaaatataagttccaaggtttgcaggaatcattttgctgggcttatgtagagcttaattcccatgcaaaccttttcattcactattttaggctatgttgtgattacatacaaactagaactctgttttgatcttcagaagtggaggaagtttgtagagtgttatgatactctggtactcaagtgatcttactgaaaatggattaaaaaggttcatgtgaaagtcaaatctggtagttggttcttttttaaatataatgattcctctatgtgggtcaagtttttatcacaccatatacaatggaaattcattgcagatgggtcatgcataccctggcatgatgtcttatagcagcctcctaacgtagtcattgcaaggtgtagatggcaggcacataccagtgagaaatttccatttgctttcccagaactagcaaatacactctctagctgctttaaagatcctgtaaatgatttgttcatgataatttcattttaaaaaatcctccataacaaggttccccaaattaattatcttgtggcttgtggtagacaacaatcaacctgccgggtcacctaaccaaaggcaaggtgagtggaatattaagtcctctcttgcttcttcagatgtagtctgaggcctgggaaatggtttcaagtgccctcgcctccaccctatcctggctctgaagtgcagctggtcctcccttccactgctgcatcccaagagaaggatccctgtcttcacacccttctcagattttcagtttgagtttatgacacaaagggaaattccaaattacttcttaacttttaaattgaaggataatcaaagagattatacagatatcctgtctatgtaactatagaaatataataaaattaaaacacagtgtaatttacatttgtggtatgttactggcaagaacttttaataaaataataattgaataatgaaattcatcattaattaaataaatgtgatacctataataaatatgtaatatattaaagctttcaatgctaatgcaaatagttctatcagttgttttaaattagagtatagagagggcatagccaagttctttgtcataaaataaagatgatacattttataatattttggtgggattccattctcttataaaactttgcttacatttagcttgtttcttttggattatagaaaagagattctttggtattccctttctgctctgacaaagaacatgaaattcaccattttcactgatccctgcacttattattccttgctatttcttttttattttattttattttatttatttatttttttgagaccaagtctcactctgttgcccaggctagagtgcagtggctcaatctcagctcactgcaacctccgcctcccaggttcaagcaattcttttgtctcagcctcccgagtagattctcctgccttggcctcttgagtagctgggattataggcgcctgccaccaggcctggctactttttgtatttatttatttatttatttattttgagtctcgctttgtcacccagactggagtgcaatggcatgatctcggcccactgcaacctctgcctcccaggttcaagcgattcttgtgtctcagcttcgcgagtagctgggattatgggtgcccgccaccatgcctggctaatttttgtattttttatagagacggggttttgccatgttggtcaggctggtctggaactcctgacctcaagtgatcctcccatcttggcctcccaaagtgctgagtttacaggcatgagccactgtgcctggtctattttatttttttgagagagtctcactctgttgcccagactggagtgctatggcataatctcggcccactgcaacctctgcctcccaggttcaagcaattcttgtgtctcagcctcctgagtagctgggattacaggcacccaccaccacacctggctaatttttgtattttttgtagagatggggttttgccatgttggccaggctggtctcgaactcctggcctcaagtgatctgcccccctcagactcccaaagtcctgggattacaggcatgaatcaccgggcctatttcttgttatttctaagtgttcactgacagtttggaatgtcagtcacatgtttaaattttatttcacaaaacaatgagacatgagaaatgaacagttatttacattcatctcattattctgataatgcctatataaacaaatgcacagacataccaaggctaggaagtggtttcctattaatttataacttgtgtccttggagataatgcttatttctttggaagggttcttttaagattcaaattttcatcacttgcttttgcaaagaggagagtaatgatgatgatgataatgatgatgtggtgatgatgatgatgaaagctagtagttgtaagacttattatgtgccaggcactattctaagtgtgttatacatatgaactcatctagtcctcacaacagccctatgaaatacacgctattattatttttttcaaatgagaaaattgaggcataaagcaatgaagtaaccagcttaaggttgtgcagtttgcctgtggaaaaggcgggacatacaggcttctcaaaataccttctctaaaatttgaaaccacatttgagaccatcatctatattagacacagatatgaacatgaaaatcaatgggttttccaagatacagtctatttttaaaatataaggtgttgctttacgccatcatctccatttttttacttaaatggtgatagtctatagattagaatatacttcacttaatattatgtctcaaaataaattaatatctgtttttaaagtttagtatggccttaatttcatataaagaaacttaaacaaataaattgctcttctgagaagttcaaaagggagagaccataagagatgaacacctatggtcaaaacaacagcaagtacaattttatttgtcctggaaaaaaaatgagatttttctaaaagattcctgatattaaaaatggttgtgtgatttgtggaaaggttgatgtttctcggaaattaccatattctgtttacaagaaaatgaactagtgcctaatgagagatttgtatttaagggtgctattcagttcctaattacccgttttctggcttcaggcaggaaaatagcttgcataaaagccagtgatagaaaatgttgcatgacaaatgtgaaggcaatcaaagtatctcttatgttatcttggtattccttaaaaaagaaatagcatattttgctttttgtataccatattttggtaagaattaaatgcactttgtgacaaagatacaaaaatgcttagaaattcactcatttcattatgcatttatttgttcaacaaatatttattagatactgcattatgtcaggcatagcattagccttagggaacagcaagataaaggacattagtcttttctgaaggaattccataaaggagatctaaaaattaagatataaagacatggcaagatgacaagtaccttgataaaaataaagtgataagagaacacaaagttagatacctaatccaggctcagggtcatggaaaactttttatagtagataccatgagttgagttctgaaagattagtaggaattagcagggcaaagggggcattcactttagacagaacaagtagcatgtgcaacagtttagaggcttcagcgagcatgacccttttgatgaacaccaagtaattgggcagggcaagggtagggagtgctgacgagcagtggcaagaaaagaggctgaaggtgtaggcagggattatatcatgcttagactttatctgaagatgaggagaagcccttgaagaatgcccccttgacaggaagtgacatggtcaaattggacttgggacaattacttggggaggattgagaattatgcgttagagaccgatctgttaaaataagaaggaggaggcttgaaggtaacctgaaattaaactgtggtactgaggatatgcattagttagggttggccaactgccatgataaactaccccaaactttcatgacgtaatacagcaaagcgttctttctcatccagacacaatttgagggtgcacagaaaaggggaatggttctattctgcactgtcatttatggaccccaaattattccatctctggttccaccattcccttagggctatagagtccttgagtagatcctgttgttgctgaaaggattctgttgttgctggcagaggaaacaactgtgtttgacctgcataatggccactttatgtggctcagcctgtaacactgtaatagatagatggaaaggtaaacttaagagatgctatgaaaatggaacttagtgaccaactggatgtagaagttacagaaaagggaagaatatatgtttttagtttggttgagtcactgatggatggttgtgcaatcttttcatgcaaggaatgtggttgtcacaatagatattggaggaaagttgtgagtttgagatgcttcccacagatctccacagggctgactccctaactttctttgaacttgtgttaaaatgtcaccctaaacaaaacagcaacactctcactctgtcttttcttattatcccactttattctcttcatagctcttcccaaatattgttcattttttggtttactggttgtctcttcttacttgaatgaaagctccatgacagcagagactttgttagcattgttcattgctacatccctcagtgcatagaacagcacctggtacatgataggtactcaataaataattgctaggagtgtgaatgaatccaaatggaaatggtcagtggaatgaggctttccagagagtatgggtgacacaagagaagaaatcagtcattgagagaaggaaacagattgggaagtacctagagaaagatgcacttttgagcaaatttttgtttgttatgttagttttcagttgggggagacttggaaaagagtctatatggaggaaggggccaatgatgtggagtaggcaaagagaatgatgtggaccaggtcctgcagaaggtgagaaggaacccagactaccagggaatgaattcacaggacaggagggctatgtcttctactcagggaaaagctacacaatataattcagagcatagaatcaagtgtcaggctgatctgagttggaagccagagtctactacattcttgctatgaaattttgctagaatacttaactgccccgatccttaattttctcaacagcagaaaagggataatgccttcctcatagagttactgcaaggcttaaatgacatgacatgcattaagcaagaatcttgtgatggaatttgttgattatttctgtaatttaattatagatcttttgatttttatctcaaattattactagtgtcataaataaacaagaggccctatctattatatgttttttttgtttcatttgctccaaaaggatttgggatttcatgtcctttggaattttgaataagttttgagggttaacatcaaacttgttgtcaacaagccaaatccggcctgcagagttatttcacttggctataacattatttttttctttttaacttgaaatccttaaatgggacatgcaacaatccatttccaggtctactccctcttgtcttttgcctgggctcttcatatattttcctaatttacttggcctttgtagacaacccatgatctagactgatttctactatgaaatcaatttcatagtaatttctactattgatttctactataaaatatctcatacctttaatgactctcatattgcaaaatccccacagaccactttctgtctttattttattgatcttgcctcaacatttgccactgttgataaacttttgaaactcttttttcctctgttttctgtcaccttccttttttgtctactctttgctgcagctctgtctcctttgcccaccatttaagtgcgataatttgtcagtgtttttattttagctcactgttcttcttgttggctcatgtctgtggctcaacatgttcaaatttggataatagtctttctcttcaaaccattttctcctattgtgttacatatcacaatgaaagcagtcgccagaaatccaagccattcaatcccccaaactgaaaccactttcacatctagaaataataaatattcaacaactggcacagtgtagacattaaataagactggacagtgccctgtacacctcactgttgcttcccagctaaagatcagccctccacactcagttacccaagccagctcctactgcctctgtggtaacatcattttaccatggactattcacatgctaatgtgttttcattttccttgtaggtaaaatctcaaccttgagtggaatagatccttccttttttctgtcctgtgcatcaagctagctacacctctagctgctcccaaggctctcaactttaccatattaaattgtttgcatttccccaggtactacctgctcttaccacatgcccttgcccatgctggtctttcagcaaagagtgctcttctccttcaactccgtttgcatagctactttttactcattcttcaaaattcatttcagatatatgcatatctgaaaggcctgccctaactttcttctctcttagcaacatcgccagtctaggtttggaacccccatgctgcaagtattttaaaagcttgcatttgtaagtcatattttattattgttatagcccaacaaattcttcttgcctgctgcacagaaaaagcaaatacatggaaacatcaggtattatagtagagaaagaatttaatcattgtggggtgtgaagcaagtaggatgggagatatttctcaaattcacttccttgagaactgagaggctggggtttttaaggataatttggtgggcagggggctagggaatgggtgcggctgattggttgggaatgaaatcatagggatgttgaaactatcttcatgtcccgagtcagtttctggctggcaggggtgggtaacaggacctgtggacctgtcgagtcagttctttggtatgggtcatggattcaggtggcatgagttggtctacctgaatgcaaaagtttgaaaatgatctcaaagaccagtcttaggttttacaatagtgatgaatatacaggagcaattgagaaagttacaaatcttgtgacttctggttatatgattcctgagcagtgagcagttatggaaaagcaatctagggaacaatggctggttagtgtttaactatgcctacctcttagcagaattgaggccccactgtagtcttacaaagatggtgtcagtccccagggatcagtttgggaaagggactattatcatccttgcttcaaagttaaactgtaagctaaattcttcctatagttagcttaacctgtgctcaggcatgagcaagggcagttagcttgcgaggtgaagagcaagatggagtcagtttatgttagatttctctcactgttacaattttttttaaaggcagttcatgtcttatctatcaatggaatagcttgacctagaatgttcattgcaatctggcaaagtactttcctgtggaagaaacacacccataaaatgagaaggtatggaggaggaaagtattgtaaatcaacataaaattaacattcattgacagaaggaaaggaagtaacagctgggtaaacaaacagctgctcagagacagaaaaatgacagtaagcagccatgaacatggaaaatggtccccaaatattagaaaagcaagtaaataatatgaggaaatgaattaacccattggaaaattgctgaagcatttgaagaagaagtaaataaaggaagtgttcaaattaaagttattatacagagaaaaagtagaacaaatattgtgtgtaaaagaagtggacttttaaaacgcaatatggtcaggagataaattaacttgaaaatttatatgagttattttttataaatgtgttttatactgcacagacaacattataagaatattaaaaaaatcaaaagaataaaagtacgccataatcctcacttatcattgtgttgaaaatagtaagttagggccgggtgcagtggctcatgcctgtaatcccagtactttgggaggccgaggtgcgtggatcacctgtggtcaggagttcgagatcagcctggccaacttggcgaaaccctgtctctactaaaaatacaaaattagctgggcatggtggcaggcacctgaagtcccagctactcgggaggctgatgcaggagaatcacttgcacccaggaggtggaggttgcagtgaacctacattgcaccactgcactccagtctgggcgacagagtgagcgagacgccatctcaaaaaaaagaaaatagtaaattagaaaatcacaactggtttactttgcatttataggattactaaagaccctaaccttttaaaaggacatatttaataacacaagtaacatacatatattcaccttctaaaaaattaaaagcattacagataaggctttgaccttgtgaaatacatatttgatcttcaacctatttcatcacatacaacccctaaaatccttagaatgtccacaaggtgatgtattttgtatgctaatgattagccaatcgttagcatgcaatcatggttgacagcccctaggtagcttcaggctgggagctgatcacaggaaagaccaaggcatgattagaggattgagacttttagccccaccccccagtctccagggaggagagaggggctgaaggttgaggtgatcaccagtggccagcggttcaatcaatcatggctatgtaatgaagcttccataaaaacctaacaggacagggtttggagagcttctggatagctgaacatgggaaagttcctggagggttgcagattccttcctccatacattgccctatgcatctctccctctgtatcctttgtaatattaaaaggaaaactttagacaaattaaatttaacagagtttaattgagcaaagactcatgaatcaggcagcccctagaatcagaagtggttcagagaaactccaagctgctgtgttttctgagagaatttatggacagaaaaaagaaaatgacacgcagaaagtggcactgaggtacagaaacagcacgattggttacagcttggtgtttgtcttacttgaacacagctggaacggttggccacctttggctgaaacttggtgattggtacaagagtaggttatggtctttttacacatcctgttaagttacagttcactgtgtatagagaaatctttaggctgaacctaaaatatgtgaagaggcagctttagactaaacttaatttaacagtaatctttataataaaccagtaaatgtgaacgtttgcctgagatttgtgagttactgtagcaaattaatccaacatgaagaagggattgcaggaacctcagcgtgcagccagctggtcagaagttctggaggcccagacttgcaactgatgtctaaggggttgaagggtgtcttgtggggtctgacgctatctctaggtagatagtgttggaattgaagtggaggacccccagctggtgtctgctgtaaaactgattgcttgtttgatgtgtgggggaaaaaacccacatataggtcacagaatttttctgtgttgattagtgttgagtgagagaacagaaaaatcactttgaatttgttttttctacacagagacccttaccactacctccataccactgctatccctggaggtaaccattttttttcagctttatgtgtatcctttcaacattttcccatgcaccacatatgtatatgtaactatagaaaatttctatctttatcttttatgatatgtatatatgataatccactatacaaactgcagtcgtaattctgcaacttcttcatgtttctatataacatttgtcttggaaatatttccatttcaatgtaaattagagttatgtcatttaaaaaaattgccatgtatcataatatggatataacataatttatttggcattctattagtgatggcatttaggtggtttctaatttcctgcatcctccagcagacattcatggatatttacttagtgccacgtgccaggcacccttcctggtttggaggatttaatagtaaacaaaataatacttcttatgggcatgtaagaggagacaaatataaatgaagacatgtatatgtaataaaatattatgttgtatgatagaagaaatacaacagagacagtaaagatgtatattaaaatatatctgaggaagaaaatataaaaagaatacaacaaagatgttgtaaaaaaacatacagaaagaaaacaaagatgagagagtaggtggcagtaaaggcttctatgaggagctttcatctgagccaagacctaaaagaagtgatggatggtgccctacaaatatcaaaggcaccagctgagaactggaaatgcagggtcaataggtgtgcatatttgaaatgcaaaatcactttccaagctgtcagtggcaattcatactcccatttgaagcataaaagtgtactgtttctcacagatttctttgttattatcaatttccttaatttgcaccagtcagatgtgtggaagactgttagtttgctatagttttgttataacttgaatgcgagtgaggtcgtgcttattttaatatgcatattggccctttgaatttcctcatctcggatttggcagttctacatcgttgttcatttacccattgtgatatttgcatgtttgttattaatttttattgtttgtgttctggatactactgttttgttatgttgtgctatttgctgtatttgttattgatttttatcatttgtatccttgatactaatcccttgtcatgtatgttgtaaatattttcatcccaatctgctgcttgtctctttaaaaatatgtttgtagaagactttcattttaaagcagtcatgtttaacaattttttatggattttgctaaggaattgcctcatgtttacattgtcttttgtgtcctaaaggtcttaaagatattttctcatattttcttttaattttatggtatatgattattccatctggagcttaatttttgggacaatgtgaggtaggaatttatcttattttctattactggctagccagtagacccagtacaatgtatggaatagtagatttttatgaattggtttgaaatattacttttggcataaaggaaatctccaaaaatgcttaggtacatttttagactcattctcctgtttcatcatacatggtttattcttgtgtgagttccatagtgtttttattactatagttttataatcagttttgacattggtaagttaagttttctctgttattcttttgtccaaaattactgtcagtatacatactaatttatacctctcatatgatgtttagaattaccttatcaaattttactttaaaataatgttgggatttttgttgagattgcatttgaacctacaaatttatctggggaggcatctttcaatattccttattgtccacataaaaatgttgtatttatttttaggcttatttcaaagtgtttgggggctttgttgctattaacaatgaaatttttgttttattgtattattttaatatatgattcctgctgtatagggaagctaagactctattggttccaataaatatttttttcagttgattattttgtatattctagataggtaattataacatcttcaaatattgacagatttccacttatatacataattgaaatatgtttaaaaaatttttctaatgcagtgtgtgtgtatttttatgttgttgacttctcatttttttacattttcgatcagacagtgtgacccgtatgatgataattgttttattattgattttgcttctttttttttttttttttgtgagacagacactgtcacccaggctggagtgcagtggcacgattttggctcactgcaacctccacctcctgggttcaagcaattcttctgcctcagcctcctgagctgagattacaggcacctgccaccacacccagctaatttttgtatttttagtagagatggggtttcgctatattggccaggctggtctcgaactcctgacctcgtgatctgtccacattggcctcccaaagtgctgggattacaggcgtgagccaccgcgcctggctagaaattttctattttatgtgttttaaataatatattttaaaattgaaaactcattatgattgtggacttgtgaatttctatctgtagtttttattggtttatgctatatatttttcaaaagctatcatgttaggtatttaaagtttcttgactattattattttggtagtcttgtgaacttggtcaatataaattgttttatcttttttataattttaaacattaaatttctgtttttaccaaaataatacacatacgtggaaaaattaacttgtatgacagagctcaaactgaaaagcagcaatctcctgtctcagaccgccccccactcccccaagttatgttccaagaaatctatacctttcaacttcctcagctgattttttttgtcacatgtgaaaacaacatgcttaattacagttcttaaaatttcaacttgtctattgatttcttatggaaaaatatactgagttctcttcatgtgctcctcacagcacggctgtctaccctatacacttatactttcttgacctctcagtccagacatatcgcaatcaaatcaatagtcagtgtctacctaaatgtagttcacatctgagataaaaagtttattacaggaattgatagcctgtccacatgtaaattttctcccagagtgcataaagcccttccatgcagcagtcgcgaatccatctctggaatcctttgaaagtgcagctcttccatccctgctgcacattggcctatctgggacactgtttctgttgagacattcatctggagctgtatttttctcttacttgaacctgattgatggctttctaggcctactgtatagctatttttctggagctttcctttacccaaatccatcatttgttatattttttaaattgccagcagcactttcttattacctaaatgccttttctttttatatcatcctagcccagatgtggtagccatgaacatgaataaacaaactaattatagatgtttaagaggtttcctctgccccttgaatgattttggtttcctctgagtccctctgctctgactcttatgttggacactatccatcagtgtcttctgagcttggctgtgtgttcttgtttggtgactggaagctctgtgcagagactgcacctgtcaacaggtgggttttactctgggttgagatggtggcaacgttgctttctcttgggcagttcccaaatgttactgcttgtaggtcttctccttgggctactcagtgtcagtattccacttgggaactacaagcctgactgctgatattgtatgagtcgagaattccatttccctgggctgagccagctttctggacacctacccactcttcctacctggaaactgacgcgtccttccacatacacggtgataattgatcggtgcaggattttagggttcagcccacctgggtgtctctgctaccccataatctgaacaataaccttgctgattgctgttagacaccactttccctagtatctcctgcctccaggtatagggcattgctactgctgcctttcagaggaatgctcaacaagttccttcatgctctggtttcctttggtaaactgtctgtttttttgaggtaacctagattcaggatccactgaggtttgctttcttttttattttcagaatggagatagatttttaaaaacttattttctcctatttctagagatttgtcataggaggtgagagctttattcaccctttattgtgttcctttctattctattaatattcctttttgtattcaatttgcgtcttgtaactgtaactgaatgctttaacatttttaattgaaattctttcaagattaattgtccattttcatatcaatgtatccatatattcagactctacaatttatcgataccaatttatgtttgttatatttgctgtaaatatttctcagagtaattccctttttactttagttatcttattcttcatggtaatgaaattttacaacatgacataatcaattttgttaatattttcctgtgttgaaatatattttgcaaatgtctgataagttcatgattttttttttagtttttgtaacatagattttatttatttatttattgagatggttgcccaggctggtctcgaactcctggcctcaagtgatcctcccacctcagctgcctaaagtgctaggattgtagacttgagtcactgtgccagctagattttaaatatctatcttacttatcttaaaattatttggtaattgtctcgtgaagtatgaatctgttccctctcagatttccaaattgttagctaactatctcaatattgtttattaagtaatttaaaaaatcttattggttttgtccccattatcatgtattcaattcctttataaaatgtgctatacttttgtcctttccactctgtttttgtttttccttttatgctcatattgattataaattaatcatttctattttaataattcatgggctgatcttcatttttatttttaattcataggctggtctgatttcttttttatttttaaaaattactgtttagtagttttttattcatatagtacacaaatattctgagctacgttataaaaattaaaggatgaatagaacttgtcctttgttttcaaggagtacatagtcttagagagtatgagcaattattattcaggaattcaaagaagacttttgaaagcttaagttggaaggaaggaataagcctaataaaggaaagcttaagttgagttttgatttataggcacaacttcaccagggcaatgactagatcagcaaaaatgaatatatgcaataaaaattgtggacaggtacacacacagggatggctggagcatagggtgaggacatgaggagtagctgagtatgaggctggagagacaaactggagcaccactcttttctaattccagcttaattttgtaataatgtaataaaattcaataccaaccccattaaactcttgatcagggtaatattaaacatattcagtataccataacaattattgaattgaatctaattcttaaataataatgtcatttgtcacagaatgggagaggtaaaaataataactgtcaataaaattaggactatagtaaattcaagctgtgtgttccttttcaaagtgaaaacacagaaagggaaaactactcccttcaagactaatcagttggctttaagacaggaaacacaaaatcaatcatcttgactttattgaagcagtgtgtaattctctgctagtatgtagtccacagagacagggatcagttccatcagccagcagggccctgtgaaatgggagccattctgtacaggaataaggaggaatggaaggaagcaaggaaagcaatagaggtatcctaactgctctagaaggttgatggtgaaatgacagaatgagaatgtagcactgggaacggtatgagcatattaagaagagttttttagttctaacctgcttgttgtaatcatttcacaatgtatgtgcatatcaaaacaccacattacataccttaaatatacacgatttttatttgtaaaatataccttagtagcgttgaaggggaaagttctaaccgtatttagaagacagaggaaataattcagttgagatggagaggttgattttttttttgaagaggagagatccactttggaacatgagttctttaggatatgtgaaacagcttgtctcaagatacagaggggaagatggagcacttcttagaatggcagcaaggatgtgattagaagatgtaaagaaaaaggtggtgagagatggatgcagaaagccagacagcttacactgatgctttgatcttctaaataagtatgtcccacctgtgtcagattacccaggagtactaggtaaaaattcagcccctggatcactctcatcagaacccaggaagctgtgatattagtgaactctctgggttattctaactaaagtgtgagaaccaatggctcaaatggagtagcaggttatctacacagtgtgtcgatatgattgggaaagcattagtgccacccatattagaagatatgggtgggcgatggaagaaaggaattgctaagcagagcccatttggaagttgggaagcaggaatttgtattggagaggctggcccagctccagatatggttgaatgtgcttccatggcttcttctaagttaaagtgaatctacctaaagaccctgttattacttctgtatcaggacccagggaaaaattgataaagcaggctactggatcaagaaagcaggctactggatcaaggacatgaagacaacttgagagatttcccttccttctggccttgagaaacatacctttctgggcaggcagagtcaataatgctgattgctacatacaatcctgtggatttgtgtattcagaactttaatttcacataattatgatgagcctgccaacatgtcaggccagactttcctctgctagttgtggctcagtttattctttgatgctgctgctccacctgcatataacccaagatgggcagctcccatggtgaaaggaattaaaagttgcaaggccctaatctaggtcattgcttttctctctctctacccttctctctccctctctttctctctctctcttttttttaacttgagtgtattagcagcctcttacctggtctccaggctaccagcctcttccttccaaggtaatcttctattctattagagtaccttttttttacacagactgacagttgccataagtgctgtaagcagtcactgctgtgaagatttcctgtcaccacagagtgatgttctaacaaacaaaacagatataagacgtttttcgaagaatgccttgtcttcagccactgctgccgccattagcacctcctacattctagggacagggaatccttgtcattgcctcagtatattgcgtactcttgcctgtaaccaaagtatcccttcgagtttagttgctgttctttctgttgtttccctataagaagtgtatttaaatgttattcccactctgtagctttcttggaccacactccctctttccaggcagaattatttttttcatctgtattccatagtactttatacaagtatcaacattgtatttagaacattctattgtacttatttgtatctttgtttctacaactgcactagaatttcatgtaatccaaactgaaagaacataggaaagtagagttctttggagcaagcaatatgggcaactccctgcatcattttgtaatagtaacaagctttcctttttccatgtaatattatagttgtagcattgatgaatctgaatatttatagaatcatagaatttcagtggggagaggtatcttagaagtgattcctttgatttgcagatgaagaaaccagtcttgtggttatgttagaccacctaagtacctttcatcaaaatcccagccaacaaccttcaggaatttatgagaattaaaccgttttccatttcaggcaaaaacgttctgggagagaacaaatgtataatgcattttagtttagagggagccccattaacaaatgttaactgcgttttaagaagttggggtcagggaaaaagtcaggctatttgatgagagataattgataagttcaaggaggattttaaatacaaataaagtgtttttcatgtgtttcattgagatgatttgaggtatcagggccaccagaagacaacagagtgggttttggtgagtttctttttctctaggtttaattgaacagttttttttttcttcaataggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataattgtgatttgttgagccacgtctatattaactatagctcccctctatttttaaaattttacataagaattgcttcttcctcttttgtcaagtccacagagacaatgtgaagcattattgaatttagactgtgttgcttcatagtctggataacaggagccactttccttcctcagaatttaggacataaacccaattttaggtctgcattatgtaagcctgtttgcattgtcatttttattttagtgcaaaagactaccaatatgagtgaattatttgtttgtaaattggcataattgtcttcataatttaatgttcagaaatgcagtaaagcacgttgatgaaaagcttagtctctgtggaagacagaccagaagacaaatcccttttctatctactgtggcatattcactgcaaggtaaaggacatgtatgcatacatgcaagaatgaattgagcgaaactttgaatatgtttcctcttttgagctattgttatttagtagttacctaaaaaagaatacatttttactagtataccattaaaaatgtaaaaggcttaacatgtatgcatacatgtagacacacatacacacacacaaagttaaacaaagctcattactgtgcaactatgaaagctgaactcatatgacctggtatggcaaaaatttgtaaccagtgttggagaatcacaaatgtgttatgcactatccattacatgttgatataagacaaccgagctcactggttgctgcacataatacccatagcagcacaagatgcaagtcttacccccaaatgcttacccggaatgagcagaattgtcttactcatcctgattttacccaaaatctcatgaatgggcttgctgttgagcgtggtcacacaaggtatagtttgtacaagtaaagaaatgtgaattagtagctatttatttccttagtagcaggtaggactacttagcttgttacaacagctttgatacacagtaagaaaactctactgacagattacaagcagccaaatgtgtttacatttcagagaagggtaagggaagcctctcgttgtcttcatactttggaatgtcttaagctaaaatgtgacactagagttcaatttcttttttattttaaatgtcactaaattgtaggtaaactgtaccaaaaagttctagtttaattttaacagtaaaaactcagcataccatgttaccacgtaaacaataatggctggtattttctgtgggttaatttaacatgacataaacataggaaagcccttggcaaaattctacatcattgaagtagaccatttctaaatgcaattaaatagtgaggttattataaaaattagaatttaaaatatgacttgttgatagtgcagattataatgttacttagaaagttaagaattcgagagtaatgatgctattggagaactggtttgctatacggcagcaaaaacataatgagaatgtaccatgaagaaattgtgttaaatattcactttgagtgaaactttaaatatgtttcctcttttgagctactgttatttagcagttacctaaaaaagaatacatttttactagtctaccattaaaaatataaaaggcttaacaaaaacgcatataaaagttaataaaatgttactcagattagtactttaattgttaaaatgtaattaatgagctccatagagcccatacatcacagttccattgaaaatatcatctggactagaatctcttaaacccaggaagtggaggttgcagtgagccaagatggtgccactgcactccagcctgggtgacagggcaagaccctgtctcaaaaaaaaaaaaaaagaaaagaaaaagaaagaaaatattatgtggaaatttttcatctttttatgatgcctgggatagatttatgcagtagatttatatataatgtttagtttacaaacttgtgaaactatttcatgtgggttctgaaaggcaaaacagaaatggccagtgct

SEQ ID NO: 12179 - DNA, 47476 bp, Human
tgcttttgtgcctctgttcctcgagcacagcccctgtgggcccagcagctggggccaagccagcacatcccctctccacaccccaagtcctcaggcagctactgcctcaccctgcctgcaaggccctgaggccaagtgactcgcctggtcacaggattggcaaagccagggtttgcagttgtcaccagctgcctgtggatgccactctgggatccacctaacccagcagctcttgcctgacaccctactgtgtgccaggcatggcgcctggctctgggacacagttgtgagcaaggcaggtgtggtccttgtccccaggagcctctattctagttgaggagatagacgacagggaagcgaggaattgaacaagatactttcaggtagtgtttggttctctgatgagaagacaaactcagatgcccactggagccagccaagcgagtgtgtcctgagctgggtggtgagctggccagggtgtggtcgtgtgacaagggtcacgtgacaaggtggtcacatctgctccagtcagcaatcgccatgaggagtatgagctcactgtggtccaaccttccaatttttcaagagaactcagaattcttgacttttctctgaaatctgattatttcagtgttggccaccagtttgatcatgaagacaaacaagttgtgtcccagactgcttggctctgagtcggccacttctgctgtcatcctttttattctgcagatggggaaactgatgctcagagaggggcgagtaggcctagtagctctggttttcccagctcatccgttttctgtgtccctctgttatgttgtgggtcagcccttgaaggcaggggacccagccttgagctgtttcctcacgctgtgggctagaaatcaggatgctcttggtaacccttgtcagttctcagagagccaggggtatccaccttctgcacagacggccacactgggtgtgactgtggccctcagggtcgagctgacagggtgagtgagcacttggggaccttaggaagtacagaaagaagaggctctggcctggctggtggcagacctccctctagactgggagccaagcataagtgggctgagggtaaccatgaacagctccgggggcttagagatttgaccttctctggggcctcccgttggccaaacccaacagggagccggagggcaagggaacctggcttataggatctacagggtcagcccctggaatcacagcaagccagaggatggttagagaagggtggacaaatggggatgaacaagcacacttgcataatcctcaccagtgcaaatcccttatttttttctgctagagatgtgactggttaataaattgcacatctatttcataaacatccattctctatacttggatggcaacccatctcaaatattgtttccattccagcctgaaaccccattcctcgttcgtttccgtctatctgtttttttaacttacagttataaatggtcatccctgtgggctgggcactgtattaaggcatttgcaaaagaggagcctccatttttttaaatacaaatccaaatttagaaaatagtatctgttaatttctagaaactgcttgcaggctgttatttggcagatgcctagaactgcctgggtgtgttgtgttttgtgaaagacgatgctagggctggggtgcaggctgaagtgtgacacccagacgacaaacctgggggcctctggtgcttctcttcagcaggtgcccggggaatggacctgccgattctgtgggttgcaagtgtccacagcctgaatcttgaggtccctggtccatgaaggggtctgaatgactcctgatgttgctgtcaaagcattggacagacagggatgccaggccccttgccacaggcccgggcaggtgggagccggctcgtggatgaggaagcagagattgtgtctgagacatacaggtggtccctcatcagctgcaggatgcttctcttttgtcccccatagaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgagcttgggccgggccacaggggagcccatccagtacaaagccgccttagagctggaggctgggaccagagcgtgggtggcctctctttccctgctttccctggcccccccccttgacctccatgaggtcagcctgccatgctcctgccaaccccacccttagagacaggggataagcccgactgagaatcagagtactgttctgcagggcctttctgtgttaccttgagcaggtccctcagcctctctggtcctccagtttgccacctccaaagaggcaggacaaggccaggcttgtgtctcccaagccccagacattcacacacctccttatctgtccgccatatctacttgcctctgactctttatctttcctttaatattcatgtttgcttttctaactttaccaaatgtactccagaaagcaaattctgttacccgctgtagatggaaaactggtatcatttgtcatgctccaaaggtatccaggaataaaaagtacagtgaagatattttttaaatgtagtgactgcacttggttgggttgatgagttggttggtttgggtttttggattttggtttgcttttgtttttgtgtttttgcctgctgaaggctccgagcaggaaccctctgacaggtcttctgttacggggttgtgttgaggtcaggcagcacctaacggtggtttcttgctggtgccatgatggggttgaagagaaccggatagggaggaactgctcacggctggtgactgcttgttgtcaaaggcttgtgtgtcagcagagatgggcatgccttgtgctgcccacattagtagaaccaccttttggggaattttcccttagagcctggtttcttaaccttttgtaggtctcaggcccctttgggactgtgatgagtgtcctagacgctccccagaacaaagcacatacactagacccaagttgcccacagtttcaaagggtttatggacccgctgaagccattagtggacaccaggtaggatcccctgccccaatgctttgcccccccattcttccccttggtcccgcccccaccggagatgcctaccctctgccccttaccacctcacccttcctagctggtgcttttctgcctcctgccctgggcaggcctggggagggtaggtgaaggccccaacaaagaggcgacgtgtgagtgggtcttaagaggccaagccgtccttgttcaggggacggatgtggaggagacaggcaggcagtaggcacagctgacatgaaggctctgaggcagccgggcgcggtggctcacgcctgtaatcccagcactttgggaggccaaggcgggcggatcacgaggtcaggagattgagaacatcctgactaacatggtgaaaccctgtctctactaaaaaacacaaaaattagccgggcgtggtggcgggcgcctgtagtcccagctactcgggaggctgaggcaggagaatggtgtgaacccaggaggcggagcttgcagtgagccgagatcacgccactgcatttcagcctgggtgacagagcaagactccacctcaaaagaaaaaaaaaaaagaaaaaaaaaagaaagaaagaaagaaaaaaaagaaggctctgaggcttgaagtccctggtagatttgaaggtgagagggagggcacactggaaaggtgaaaccagctggccaggtgggcagggcctggagcatttcccaccaggtccaagagtttggccttgagcctcatgcccctcatgcattctctctggttccattggctgggagggcttgggagccttctgcgtcggcgctgccatggccacagcctcacttttgcccattctgctctctgcaggtgcgtttctcataccgtattttattttcctgtttgggagcggcctgcctgtgtttttcttggagatcatcataggccagtacacctctgaagggggcatcacctgctgggaaaagatctgccccttgttctctggtgagtatgggacggaggtcacttggggcctggcactcatcagttccacacatttttattgagcacctattgtctgccaggtccattggagcctcatgcacatcacttagctctatgctgacacaagatagcagccagtacagtaccagtgtgatgcggatgctgctgcttaggagtacggggaaaggagatgtggcaagtgcctagcacgcagtagctgctcagtaaggcccagcatgcccacttccctaggttgttgcatagagaagcctgcagctgcactgttcacagtagcaaagacatggaatcagcctaggtgcccatcggtggtggactggataaagaaaatgtggtgcatatataccatggaagactatgcagccataaagaatagcagtatggcctttgcagcaacgtggatacagctgaaggtcattatcctaagtgaattgatgcagaaacagaaaaacaaataccacgtattcttgcttataggtggaaactcaaccttgggtatacagggacataaagatgggagcaacagacgctggggactccacaaggggcggggagcaagggctgaaagactacctatggcatactgtgttcactacttgggtggcaggaatctatggaagtgcaaacctcagtttcatgcaatattcttctgtcacaaacctgcacctgcaccccctgaatctaaacaagaaaaaagaagcctgtagctacttggcagtagagtgcagcagataaacattcaggttcaggaggctttctgtctgggttcaagtctcattaactccccttgatagttttgtgactttgagaaggtcactttatacttcaattttctcatctatgaaatagaaatatagtcgtatgtttacttcacagggttgctatgaagacaaaatgacatagccacgtagaatgctttgtacacagtcagcatcaaatgaatggtagcttccttagtcctatgtttagtacttagtatgcacacaaaataatcactgttatgatttaattggcagagacgggagcatatgtgagtctcttcattcggtcatccacgtaaatccatttatccttaagcctttcttccattaaaccactcagtaattagactatccatccattttccatccatctatccatctattcatccttccattcatctacccaaccttctaacctaccaccatccatacatccatctaacaaactgattatctatgcaacaaatggatatctatccatcaatccaacattcttcaatttagctgtttatccattcatctggccattcattcaatcatccaactatccatctgttcattcatccatctatttatctcatctattcagctatccatccatccatccatccatccatccatccatccatccatccaaacatccaaccatccaaccatccaatcaaccatcctctttattatctatcttttcatccatccatctatttatccatccatccattgttctatcccccctgccccctgccatccatcccatttatctaaccatctgttgtttcacctttccattcaaccagccatccattcaccctataaatatttggtggtcactgttgaaaggcctcttgtggcctggggcctggggataccatggccttccagttgagtatgtggccgtggtgggtctggcctccctcagatgtttactcatctcatttgcccaacctgcaggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagtaaggccacctcattgaagcaaggaggaggacatgggtggggcagagaggatggcccacttccttatctcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtgaggcaggtatgcatacttatgttgtctaaaaatgatacagttttcttaatgtattttaggaaaaaatatattctgttattgcacagagaaaaatgcatatatgaagctgaagtagttaagtggaaagtgagtaggtagagtgaaaaagatgcatcagttagcttttgctatgtaacaaccatccccagacttggcggccttaaacaacaacaatttatttagctcttgattgttctgcttgttggcagtttgggctgagcttggctgggcagttcttctggtcttggtctcctccacgtgtctgcaggcaactgtaggtcctccgggtagctcttctggggtttggccggctattggctggggtgtgaggggcaactggtccctgtggtttcatcacccagcaggctagcctgggcttgtcaccggccactaagcaagcactctaggaacaagaaacggtcaatccccgaaacccaagtgcttttcaagcctctgtctgtatcatttttgttcatgtccctttggccaaagaaagccacaagacaaacccagattcaagaggtggaggaaataaattctgtctcttcatgagaggagtgaagaactgtagtcagtaactacagggaggatacagaggacaaacatcagaaaggtgggatgtggagtcctgatcttggggaactcttgagtgagctgatgtgtggagacattcttctaacatagtgcttagaggctgatcaaaaataggctactgcatcatttccctcttcttcataagccagccttggggctcagcactcaagtgcagccccttgaccctggaaataactgagatgaggccttgagtgaaggttgtgagccaggggcaggggtgctgttaaggaagagggtggttctggttctgaatcatcacgagatgacagtccctgtcttttgtgtgtggttttgccattttcaaggtgtttacccacctcttaggagctggcccaggaatgggccagagaagagggagcggcctaccgactggccccagccatgctttggggtcagggctgggacatcgttggcaaagaaggggtcggttgccctcactggtgtggagcccttacttggtcggtccgtgtcactgtcgctgctccaggccttcagtgtatgctcagggcaggtccttaggcccactgtcactgggggttcctctagtgtgtatattttccacttacaaacaaaagggacattggaagcacaatcattgcccctcggttccccgctccctggggagctgagttcacagacaaagaaaggctggcacttcctttttctcacttgaatggggtccaaggcacagccttgtcctttctctgctgtttttggagtggcctgaaaaccgggccttccccactcctggacactggcactcagccagttactgaaggcgtttgctgggacctccttgcctcagacattgactggcctgcctgggtttgaaccctcactttgccacttctagcttaggcggaagtatcccgctctctgggccgtggtatcctcacctgcacctggggagatggcagtgctgacatcccaaggttgtaggatggccctgactgcatgagatcctgggtggccagccctgagaatccattattattattattattactgttattttgtttttgagacagagtctcactctgttgccaggctggagtgcagtggcgtgatctcggctcactgcaacctccgactccctggttcaagcaattctcctgcctcagcctcccaagtagctgggattacaggaacacaccactatgtccagctaatttttgtatttttggtagagatggggtttcaccatgttggccaggatggtctcaatctcctgacctcatgatctgcctgcctcagcctcccaaagtgctgggattacaggcgtgagccactgtgcctggccagaatccattattatttatcgagtgccctcatagtgcataaaactacccctcagggcagtttctttgtgtgttatgaacttaaagaatcaccccctattgtaaaggggtcatcctcttctgggctctgcttgtctcgctgttgtctaggacccaggggtcttagagagggaacacttgggagcaatgtgaggtcctcaggttggccagtcctcactcacaccttccagagggaccgggccctcgggggtattctgggacccttgccttccagaatctccattctgagcaccccagctccattttctggcctggaagacactgagacagtatttatctttggaaagtgtctggttctgcaggcatcttcccaagcttctgcatgatccagatggatttgctctgtccaaagaaccctggctgccagcttggtactcacctcccactccagctctcacacctctcctacccctgcacccctagccccagattccagcagagctttgtgagaccacctgaacattcacaaataagctgccctctttctagaaccctggggaagattgagggccatggagcaggagcctggaaagcaggcttaggcaagaccagcactgcctcctgtgacctgccttcacagcacaggccgaggccagagaactacaccaggggacagctcagttccagccctgagccaggtgccgtgggcaagaaagacccggcctcctgccttcaagagccttctcttttcttggcatgcaatggtggaaaggcaagagaaccagtagggaatagttgactcctgtgagcatagtactaggaacttgcccctgtcatttctttcagtctctaagtagaggaaatagctaggcatcatccaaaactcttctttctacctcaaatcccacatccaattcacacatcttcttggctcccccttcagagtatacctacaatctgagcactgtccccatgcactgtcacccccatgggacccccatcactctcctggacaccagcactggcctcttggatctctccgtgccttatccttgcacctccgtaaccaattctgaatccaacctgttaattcccagctcagaaccctctcatggcttttcccatgctatgatctcaccctggcagaaaggattgagactatttcaacacagcaagtgctcactgggtgctgaatctcctcattagttccatgtcttcatccacctgcgtggagcagcaaatcactacctctctctggctcacttccccatctgcagatggaggagcatatgagctgggctttgaaggatgagtagaagttcactaggcagaaaaggagagtgacaagacagtctaggtaggaggaacagcccatgcagagtcagcattctgaaagcacatgagtatttgggatggtttggctagagcataggatgcacgggtgagggccaggtagggccagggagaagggtcaaagccttgaatgttaggcgggtacatttgaactttgttctcttggaggaggaaccatagaaggtatatgagaagggaggtggtgtgactgaattgaatgtgatttttggacattccttaaggaacacactggtgggaaagagaggctggatgtatgctgagcactgactgtatacggggcctcggagacctcagccttcagcaggtctgggttccctttgggtgaaacttatctgaatccccctgaagatagccaccaaccctgcagcgtctgaccctggggtttctctcgagtgaatcttgtcaggattttttgcgcgttgctgtctgggagccagttgggcggcagagcagtgaggataccctcgaaggttggtcttggtgaccctcaagctgaagcccagccccagctgttgcttcctttcacttctcttatatgccccagatgcataggtccctggcccgtcctttccttcagcaggagttgctggcaggtgctgctggcaggtgctcagtagtctctggaagtcaggggtacgaggcaccaggggagcggagccatctcccagcttcttctgggcaggaaaggtccctgttgaccctccctgccagcccttcctccctctgttttcacagaggaggcagcagagcagcaatgggtgacattcccctttccttgtggggggagacaaagctcaactctggctcccacacatcccagctgcacgaccttgaggcagtgacctcacctctccacgccctcttctctcctctgtaaacagaagtagcgtggtcccaatgactcacagcctggcttgagtgttttggagctaagaccagggatgtgctttgcagggggccacgggacactgacgatgcaagacgtgcagtgccctgcccgaggtcacgtgcacagctagaaggagcaaagcttccagccctggcattcagcactgcatcctgcctccagctaaccttttgtctgtgtccccaccagccaccagcccagagcccgggccaggcttgggagcccaagtccatggtcacaggtcacattgtgccacatgtgtgtctccccgctcccaggttactcttggggtcttctctcggcctggaccccctacacccaccctgtgtgcagtgctaagtcaccattctcagcagaagccagtgagctgcactttcccagatcctcatgagaagccgctggggccccagagacagtcatttcatgctggctttataattgagcgccgagttgctctgggatggggaagcagagcttttgtcccctgcttctccttgctgtctggggtcacctctgtcccaaggtcgccctggaggacaggcggggccagacctggccagaggccctccatcaggctggagccgtgccttcctcctaggctcctccagaccccctgggagctcggcacgtatcattagactttattagaatcaaagaaatgagtcatatttgcaaacaaggcctgctcagccaatcttcccctgcagctgtcggaaagaggaggcggtggagaaaggctgcacggccccgtgctctgggcggacgggcccttttataattgttgcctctgctagtctccaggggagagccatggccaataaatggctggcgtgcagtcaaaaggaaacgatttggcccgctaggaggacgtatttacatctctgagtgccggctggacggcagcagggcggccgactcaaaacagacgtccaggcagttcttttttggatcccaccctggagtgaatcattactattcttggacaagaatgcagcttacctcggagtctcctccctctgtatgagacagacgaggaagctggggatgatggggcccttgccaaggccagcaccatgcccggcacatgaggtggctggccccagggtggcatcagtaaaaaggaaccaggtccatggctgatttctatctgagtgatttcaggtgcattcctgaacttgtctcagcctcagtttccccatcaaccaaatgggtataattaatttactcaattaatgtcagctgagcacctattaggtaccaggcactgttcagtgatcaagacagacatagaccctgccttcttgggactgacattttagtgggacaggcagacattaaatagatagcacatgtacaattataatataaaagcaataagtgatgagaaataggctcagggcaggggaaggacagtgaccagggatgttttttacagagggtggccaggaacagctgccctggggatgtggcctttgagcagagacctgaaggaaaggagcgagggagttttggaacaagtggctgagggaagcagttaggtccaaggccttaaggcaggatcgcgttcgacctgttcagggaatggcccagatagcagctagggtggctgaaggaggaggaagtgatgctgcagtctgggggatgagggtagggcttgggcgcccgcacccccagcctgcccagaacacttcccctttacacccgttcacctgtgtgtttactaattggcaccccctcgctcttaaaagtgagtctgaatggcagggtcagaagggccgtgttggccggggagcgggagccctgggaggacgtggagcagaggagggatgtggcctgacataggtattgatagattccctctgacttgttggggcaggagtagagggaggaagaccaacgaagaggctgctggaaatcatcctgggggcgtcaggggcctggacaggggcagagacagtgtgctgggagagctgtgttaacactgtggggagcctgtgcagcttcctcctggggtacttaggaggcacaggtgagtggcagggcgccatggcgttccctcggcacgacactctacagtttactgagcacgccctcactgctgggtagggattggctgggatcctgatcggctgctttctggctgggaagaccctggaagtcagacacggaagggactgtggaggggcctgcctgagattcagcctgcatggctgcccgagatgtctttggaaagaatgtcggttgctctggccctgagcctgtgtcaggctgtgttgtgacaaatcctgattgatgagatacattggtttcagccctagtatgttcacgtggcccgttataaagcttttcaagaatttaaaataacttttataaaggtgatatgtgcacattaaaaacattgaaatagtgcaaaaatactttgcaaagtgcatccccctcccccacacaggcagcaactgccaccagcttcttgtgtgtcctgccaaaaatagtgtgtgtgtattcaagtacaaatgtgtctctgtctccctccctctttacacggtagggagcatgtctcatgcactgttcttcaccttgcttctttcctgcattttgtctccaggaccgagctccttagtaggacacagaactttcctgttttacaccgctgcattgtattccagtgtgtgcctgctccacagtttacaagctcctcttgatggacatttgagtcatttccaatctttcactctacagacagcactgcttgaggggggtactatgtctctggccacccatgcagatgtaactataggaggtaatcctaggaatggaattgcctgatcaaagcaaacgtccctggatggcaccatgaggtcctacaaagggactaccaccagcaatggagaaggaggcggaggactcattttctttgttgtagactccatagctggtcagctgccccgaacaagtcagtgtggcagcctcccatcagtattgggcaccactggtttgaccagcatggtggtaggagaagggcagatgctgttagatgagctggctgcaggctgggtatggtcagaatcagggctctggagtattaagcttctcaaccagcttgccctgaagaatcaaaggaaaggctgtcttgtgactgggcatcttatcagcatataaagcccttgtccttgggatgtccagggtctggtgggcaacacagacatttccccagcgtgggacaggacagcggaagacagacaggggctctacagtgagtcttccagaacctcagggaggcttcctttgagacggaggatagtgcacctggtgggcctgggagatggtggaaaggtgctcttcctcctctcctggtgctgcccattcacaaggaagtcttgggccactgcccagcctgccctggctttcactgaaggtgctgagccctgcagaatgaggaaaggctttttgttttaaagccgtggcaggcgccagatccacatgcttggcagggccccagctgggatgtggttggccgccagcctgccctatagggatgccccctgccccaaggtgccaggtgatcccagcatatagcagaggactgaagagattgttaaatcagcatatagcagaggactgaagagattgttaaaatttaggctctgttttctcttaaaaccagaccaacagtgtagtggagtagagagagcactggttttggagtcagacaggtgtgggcttggggtggcagctctgtgtcacctgctggctctgtgaccatgggcaagtggacccaccaagccttcattttccctatctgtaaaatggggtgaatggcctctactcctgggatcagatgagataaactgaaaaggccttggaaagcaggtggttgctggtagcttttatttcgtccatcagcattatcatgttgacatccctggtgccagggggagcccactgatgtcgctgtgaccagcaagaagagggcaaagaaaagctgtcctgtcttatggctgttagtgggagtatttcacggatcggtcctacagtgacatgtgaacttgctgtcctcccagttgagtccattcattcactcattcactcaacaggtctttattgaggtcctccaatgggccagatgctgttctaggtgctgggaacacagcagtaaactaaagaaaggccttgcttgaataccagttgagaagggaatcttggatttattcaaagtccttatgttgaagcttctctaaaaaaaataaaataaaaatgataaagggtctagcctggtgtgtgttccgagaaccagagccctgactgtgggggtaatcccacggactggctgaaagcttgggatgttccagaatgcttccccaagagcatcctgggcaggagctgttattctcattttacaaaaggggaaactgaggcacagagtcacacttcactccctgcccctcctgcatgggagtgtgaccttcagacagggagctgactcccattagaaggaaactcagcttcttccaggggttcgcaaacaccctggagcatgcagaccctgtctcttgtggccagcagcctgtggtggacaggtaacctgggaggcccagtgggcagggccgatgtctctgttctcagcgtggctgtcctcgatcactgttgcagcagtcagagctctgggaccatgggtgccacttctgggcatcaagtttcatggcctgggctgtcagtaccctgcatcgccctggcctgctttcagatgctgtcatccataagaatgtctgggagtaggtacttgtgtgcttgtttagcagggcagcaggaatcagctcggattggtgggaggcttaagtctggactccaaagacccacgctctgccgtgtcatcctgggcagggttggtgactgtcccgtgccaattatccttaaaaccgtttacctgcctctctctgagaccctcaaaaccctggcagggcaggggaggaaaccagcattgcttaggtgccggctgtgtgcctgaaacttccctgggcatctgaacaccacagttaacatctgcaaaggtttatcaagtgctagctgcatcccagaccctgaatttaggaccttgtgtgacttacattttagtgagagatccaggttacacagggatgaataaaataataagggacaatattgggggagggcaacactttatagacgaggagccagaggtctgggaaagttggctaacttcgttctgtcagtgacggaacaaacagtagagctgagaattgaacctagtgtttggcccacggttggcactgaagaaggttctgctgaagtcccaacagaaaatcagtgcccatttcacagatgaggaaactgaggctcaggggttccttaacttgcctgaggccagactaagttgaacctgggtttgcctgaatctggagtctgagtctatccttttcttttctttccaacaactctgtctcaagacaaatggggattcctgggtttggaaaggtgaggtgacttatgtaaatgcagcgcctcaggtgggatttgacccccagcctgttaatgtccgagccttggctctctctactccagggccaggcccctcactgactcctggctctgtgtttgcttcaaggcgcaacgtgctgagcttgtcccctggaatcgaccacccaggctctctgaaatgggacctcgctctctgccttcttttagtctggctagtgtgtttcttctgcatctggaagggcgtcaggtccactgggaaggtaagttggacttctgtccgtcccctgcctcctggagagctgtgccaggctggccctctcccccacttcccgcctgcaattagccacgccccaagagggaggtggccagtggtggcgtgctggtaagcccgccctctggaaaaaagtaaaactcaggtttgttgtagcgtttgtccatttcatggtgtcagtgctcccaccatgtttgctttcaagctgtccacagtttaatgaccagctcacagaattcctgaatattgaagagccaggctctcaggagcctacacgagctagccccatccaccacagctttctcatctcaaggtattggcagtcagtgcagatggtagcagataactaatgttgggcttctaataaataggttagctggtaacaggaggttagccagcaaccgtggtaagagccattagccacagcatggaccctcgctttgcagagggggccacaagcattcccatcagcattgcagggagcttcgtgggcctgccccaaacctacaaactccaaggctgcgttgtaacattatccccagataatccaagagcactttatgggttgagaggcactggcttagattttagctgctaaatcagattaactgagttataactaacatttcagccggcacctccaatgttagttgttcaggaaagcgttagctgataattaaatcatccactcatggccagggtgttagctgttaaccaaagtattattcataactggagtgtttgctgctgattaatatgtcacatagtgactaggatgttagtgattaacaaatgtaaaatgttagcttgtaattttaaggttttaggtataactgatacattagcaatagtggaaatgttaacccataactgaaatgttacctgttactaattagagctgaactgttccctgaaaacctagacactggctgttgtcatggctttgctgatgccaaaggctggtgcgggggtatgttgtgatcacaggtgtgagcctgaacccagggccctaagctataaagaacaaaggcgtttgctcatctgcctttagatagtgccctgtcaacgctttccccagtgactcacatcccaaaagagggaacgtctctttaagatcaaaaaacccccaaaagtcaaaggagcgtcttaaggtagcattccagatggagctgtgggcagtgaccttagctgccccagccacacagtggaattgagggttgaggaatgtgtctccctggataaagagcccccaaagaggcaaaatcatagatttgtagagatccaagtaattattccagtcacttaccctgcaagacctgggactccagggttgcaagaggtagaatgggggtgatcctgtgcacccccctccaacacacacagtgccctctgcttgtttcttggggcagaaccaccctgccatcctgaagccaagggtggaagggaagcagtccaggccttggacacctgcccgtgcccaccagtgagcacggtcctgcccggaacaggcgggagcaggggacatgggtaactcctgcacctccttggagagcaccttcactgtgctaccccggttctctgtctcacaagcacaccattttattcctttctttaaacaatgagaaaactcaggcttagggaggtcaagtgacttgtccaaggtcacttcctcctctctgagcctcagtttcctcctctataaaataggtgatagtagggttaaaatgaggtgtgttaaacacctggcacaatgcttggcacagacggttctgtaaatgctaattctcttctttttttttttttttttttttttttgtaatttgaggtggggtctggctctgttgcccaggctgaaatgcagtggcttgatctcagctcactttctgggctcaagccatcctcaaaccatcctcccacctcagcctcctgagtagctgagaccacaggcacatgccaccatgcccttcttcactctgcctcagtttccccacacagaagtgagaaagtttctgtggagcactggtcctgagcagtgctagagacatcatcacttacttacgcactagtattttttgagcctctaccgtgtgccaggtgctttgtagaaacagggctgggggacatgcagtggttcacaaaacagacaaaaattcctgtgctccaggagctgatggcctggcaggaagagtcaggttgtaacaaaacgaatgggaaaaatatataggagtcaaatggggatgcgagctatgggaaaaagtcaagcagagaaggagaatggggagtgttgggagcaattttgaatagggtggccaggcaagacctaccaagaaggtgactctaggcaaagatgtgaaggaagtgaagggctgagccaggtgagtatgtggaggggaaaatctccaggtagaagtgacagcctgtgcaaaggccctgaggtgtgtttgacccagacccttggggagcacccagtctgatggaggaggctgatgtccgccagggacagtgagcaacttttgagacataatgcagaatacaggagaatagtgtcaaagccagagagagggtgccaggctgcagctgtggccgagcaaagacgtgatcttccacgggtcctcccttctcacccttagcaacaacctccttcgtggggtggctgtaggcctcccaggggtgggcgtgattcccagaacaatagcagagcctgggccaggccagagaagccaagacaaacacagtcaggctctgtgaacttcctcaagccccatggctgagaggctgcctgctcgctggccatggcttccagccctggccacagaccaggtttgtggctgacgtgggggctgggcccacaggcagcagatggacctcatcctgccaaggccctgctctcgtgtctagtccagcaaggaggagttggagggtaatggagggagagccccagcctgagaggctcaggatctgagttcaagtcactttgcctctctaggttgcagtttccttttttgtaattttcactattccaggaagttgaaactaggctgccattaatccattcaacaaatagtgataacggtggcgaaagcgcagtagcctgtgagtgccgggcagcattctcagtgctgctaggtagctcattgaatcctcctcatggtttggagtatgtgcagttattagtcccattttacagatggggaaattcaggttcaaggaggctcattaccttgcccagcatcccacagcttgtcagtggctgtgctgggatttggacccaggcggccccactcccgacctgggtgccccacactcttccgcctcttgtgcccacccccgtgccagcctgaggatgcagtaagtagggcgtgtggcaggcatgtccctgctgtcacagagtggggtctgggaagggggcagagatccagacactcacacaggaagtgcaagccctgcagacgcacaggggaggaggccccggagtgagcatggacattcactgaggctggggctcttcgctgttggcctccggagcagctctttttgcctggttaaaaacaaagcagggggtagtcagagccaggtccttttagctctggatcccccagactgcatgactttgaacaaggccctttcactttctcagcctcaccttccccttatgtgaaatgagttagtgaagcccctcaccaacagccagggcgctgaggatccttagggcctgcctaggatctctgggatcaatggcgagccctgctgcccaggcccttacctcccaaaggatgcctggctccccctgctgctgctgctgcccagacacttacctcccaaaggatgcccggctccccctgctgctcagccaccctcttttctactgcccagaggggatggagaaaagttgtccttgtgagtttcctggacagttgggccacagggcttttgggtctagggctcagaggagccacggaggttcaccagcaagagtggaaaaataccacgtcccacagcaaggcctgctgggccaccaccagaggcccctggcagcagctagcaccagcctgtcccttggggatcccgggggagccacagaaaagttgaaagcatggctctcaggggcttgtcctcggagcagcagattctgcaaagcaagggtggctttcaaacctgctactgtaaaccaaaacccatctgagacagggggctcgatgagcttagaggtttattttgccaaggttgaagatgtgctcaggaaagagactgagccacagtaggatctgtggcctgcactttttccaaagagagttttgagaacctcagtacactaaaggggaggcccagcacagtagctcacacctgtaatcccagcacttgggggagccgaggagggcagattgcttaagttcaggagtccgagaccaacctggtcaacatggcaaaaccctgtttctactaaaaaatacaaaaattagctgggcatcgtggcgcgtacctgtagtcccagctactcaggaggctgaggtaggaggatctcttaggcccgggaagttgagactgcagtgagctttgattgcgccattgcactctagcatgggcgacagagaccgtgtcttaaaaaaaaaatgtaaggggaaacagcaggaagggacagaggaacaggtaattcaggtaattatgcacgatgtctctcagcaaatctgcattttccatagggtagagaacacacacattttccatagggtagggtgtgtacacacggtggaggaaggagacacatgcctagatgtgtgggtggatggctcatttcttgtctctttgtccggcacctgtgaagatgagctgtgagtttacattgtcagggtgagggaggccgcctggggagatacgtggcctgtatctcacaactctctgctgaagaacagaaagcaggccggttttgtgcgtgtgtgtgactcacttcccaagcttaactttttccttctgcatagtgagtttggggtcctgagattttattttcccttcacacggctgaggtggcgtgaccaggatttggggaggaacaatgacacacatcccaaaggtgtggggacctgacaccagctggcctggatccatcccgcatccaccaccagtaactgtgattgcaggcaggtgcccccacctctctgggcagtctcctcatctagaaaatgcaggtgaggctgatgcctggctcttctcagttgtctgaggattaaatgagttaaaactcacgaagcccttagctgagtgccccgcacaaaatccgcactgcataagtgcttgttaaataaactaactacgtgaaaacaaagaaagccacctccacacccctgtccctgacacaaagccctctggtcacagaccactgggttgcttggcccagtggaggcctggctggctttgaagtggccgccctctggagacccctgcggggctgctgtcagcagctattgttcgccagcccgggtgtggcccacaaagggccccagaggtgggaactggtcggggcgcctggccgcctgtccgcctgtcctcaggaagggagaggcaggttggttttcttttttcacttctttccccccttctgtggcttcctgatgtgcccccgccctccacgtctgccttcccatcctcgggaaatcatgtaggctcctggcctcaaggagaagagatgacggtggctggagaaactgaggcctggaggaacaaaggacgcccgggggcagaggcagcagtagggcccagcctgtcagtgtcggagagccatcctgacagtgccggccaaagaggcttcttgaatgctcaccgcaggccaggggccatcgagcaaggtcagcgttcccttatcctcagtggacagatggggaagctgaggcccaggtcaccagcaaggggtggcagaggcagcgtgcaacccctggtagaggtggctccccagctgacccacagcctctctacccctcgacctagagtggcagagtgggaggcaacctcagagctcctacggtcccagccctttacttcctggtggggaaacagtctagagcggacagcggcttcctggaggtctcatggcaagccagcctctaagcttggcttcagacctgagggcctccctactggctgccctctggtcttggggagaatcagtaaactgccagttgtgggaggctttttgctggtctgctatgtgtgggctgtggggcaggtccccattctgttgcttaagcccacatgaccctgggcaagtgatggactctctctgggcctcagttttattgttgcaaaatggagatagtaatacaacttacctcagagggttagggcacgggccagtgaaaatagacgtcacagcatttggaacagtgctaggcacacagtaagtgctcaataaacgctgcctaggggttgttgggctgagggcagctgagctaagcaggccctgaaagcttcctttttgcccttttccaaagcccctttctcattgtttctactcaaagggatcatggccacaagaatttgctctgtcgagggtcgtggtgccagctaggtgaggtttggggctctgtcactattggtcagtgtctgttacatacttgggccccagcagtgccctggcactgcacccccaactccatgggcacatttgtcctgttctcttcatctcaatttcctctcctgtaaaatgggtgcattgactgtgcagtggttcctccaaggtcccctgatccccagatgcggcccagggctctgccaaccagtctcaatgtttcaaggtggccaccatgaactttctgcatgtcgaagtaaaacacttcatgcctttctgcacagaggttagccctccacaggctctgggttcaaatcctggattccgttgatgccctgggcacgtccttaaagcccaccaagcctcagtttctccactgtaaaccaccgtcctggggggcatggtgaggatgaagtgggcttgtgcctgggacgttcctactcagccagtgccctgcctgaaacactaggatcgaactgtccattcagccaggcaccttcgaactcctcccaggcataatctctgtctggaaactccttgtgttgaataagatgggaaaatccatccatgagaactgaagccacaaacagcgcttgcaggacaagaggagagaaggtctttgggaggagatggccacatcgtttctagtccccacctcacacctgatcttggcctgtctggaacatgcagtgtgacccagggaaggccatgggtctcccagaggcccggtgaagcggggagcctttcctattcccagttaagggcctttgagaggcctcattttcttccctgaaggtctcgtccttccagcaaaatcagtgtcaacaacaggccctctttctggagcacctactgagtggcagtgttacaagcatcatcctattgaatcctcagctcaccccttgttgaggggcttctattactcttatctgaattctactcatgaggaaacaggtccagagaggttaagcaatgtgcctaagatcacacagcaaatgaggggacggagctgggatttgaacccttgcttatctgatccctaaccataggaatcataccaacattgtagttagttgttaactaatatgacctgcatgcaatgggcacatgccatggttggcaaccactgggctgaggcttctacacacgcacttgatagcttactctctgattttgctttttccacctctacgccctggaatgtcagttccacgaaggcagggatttgttttctgtcttatccaccactgtattttgtgcttagatggtgcctgggacaaactatttataggatgtttttcatttaatctcagtaaatctgtgaggtgggctggcgctgtggctcatgcctataatcccagcactttgggaggctgaggcaggtggatcatttgaggccaggagtttgagaccagcctggccaacctggtgaaaccccatctctactaaaaatacaagaattagctgggcatggtggtgggcacccgtaatcccagctactcgagaggctgagccaggagaatcacttgaacccaggaggcggaggttgcagtgagccgagatcgtgccattgcactccagcctgggtgacagcgaggctccgtctcaaatttaaaaaaaaaaaaaaaaaaaaaaagaaatctgtgaggtaggtacctgtatatacccagattacagatgaggcagctgagacccagagtggttaagcaatgtgccaaaggccgcacagcaagtaagacagcaaacctggctccagaactcctgatcctgaccagtgctcccctctgcctctctgagaggatgctcagacttagcagcagcaagtgatgcccatggcctcctgaatccctctcgcccttgcaggtcgtctacttcacagccacttttccattcgccatgctcctggtgctgctggtccgagggctgacgctgccgggcgcgggcgcaggcatcaagttctatctgtatcctgacatcacccgccttgaggacccacaggtactgtggggctgggacacaccatcctccctcccatccagggctgggccggcacaggacagggcaggatgtagaggccactggcagcacatcttccgtggttcttcagtgcacaggtctagctgggccaccgccccctggtacttttccaccgggcctgtggcgggtgtgcctgtccacggtgctgatggacctttctagctgtgtgcatctcttttcatgtcaaggacgtctgagggtggccacttagagaggctgctttaggccctgcaccaagggggagaaatcttctgatgagcaagtctcccgctcggacccagcttctgcccactgcagccacaagggctgctgcatcctggggatgggagagtcggggcctggagagctgcgggcttccttggctgagggtggaattcagagttaatggccttggagggtccacgggcagataccgaaagcacaccttctggcactcagccttgtgaccttggggaggtggagaaagccctgggagattttctgggtttgtttgaggacctgaatccccagggccttccggttgcttcccaagggcctgtgctctccttccccaccacccttccccctggacaggacacagttgtgagaggggttggccagccttggaggacagctgggaacgagctgcttagtgaagattctggagagcagctttgcctgcatagttccttgggacctccttctgcattctaactcgggggtctgcaaacagtaacaacaatggtggtgacagcagccttgacttacgggcttgccatgtaactggcactgggctgaatcgccactctttgaacctgggaaatagctctatggggtagggcaaaggagcccattttatagatgtgaaaactatctataaactgcaggagtgatatttacttgcccactgtcattccagggttggaatccagatccatctgcttctgaatcctcttaaccctgatgctaggtcgctgggaggtggggtgtttgatttctggggctccttgcagctcagtactgccttgaaaggcaccttggattcgagcataaatgttccatttgcatgtgcaaggtcccgtccccaggccatcgccaggtggacataaccctcgctgcctcctccaggaagccagctctgacagccctcctctctttccttgccacctccctccccctcataggtgtggattgacgctgggactcagatattcttctcttatgccatctgcctgggggctatgacctcgctggggagctacaacaagtacaagtataactcgtacaggcaagtgttgcgccggcgggcctggtggactttagaaatgatgatgatgatgtttaaagaaaaagagaagtagggagcgtggcttccttgtgttgtgaattaacttgctccctgacatatgtgtaacttagggactgtatgctgctgggatgcctgaacagtggtaccagttttgtgtctggcttcgcaattttttccatcctgggcttcatggcacaagagcaaggggtggacattgctgatgtggctgagtcaggtacggtggtatcggtggcagtggtggtgggcactgccacctagtgtgtaagccaagtactgcaggcatgaagccagaccccagggggctttgaggggggacgagcctggtttctaaaatggaccccccccccgccaccaagatatcccccaaatttcaaagagtacaaaagccaaattttaaacatttttattgcaatttggcccgaggggtggcaaaagcatggggggtggttaagttggggaatttttagctaccttagtgtggtcttccccgcccccccgtccttccccagcaaactcctggtttccacaatagaaaccactttcctaactcaggcccaagtcagccaccaatcggcattccatcaccaccttctcagccttggtttctgtattttgcactttgctcccagcgtgctccctctaagcagacgcattcatccatcccaccgatttctcgtgaatgagtcccaactctgtgtcaggcaccaccgtaggcactgggtgcagtgtgtggggggagggcgtagatgaggggacgacctactgggacggtggcagatccaactgggggtgggttgtaagcacagtgtcgcccctcggggtgtgggccctgttgaccaggcactcttcctcgggctacctggagtcacaggcatggaggatgccagtggcttagaatcacggactctgcacagacggggaacttaggaatctgggatcccagagttccagcaaggtgcttctggaacctgagaatcatggggccttcagttgctagaatctgcaatctctcaggtgcctcgattctgggacttggccatggctgcttgaggtcctgggtctgtagctttaattgcagtggcttgggttatgggattccctcaggctcccaggatcctcaaagtccacctttccgacctctccacccttccccggccctgcacagtttacttggagggtggtcatcagttggttttgttattttacatgctgagcccccagccccaccccgtccatgtcctaatttcatacaacttccctggggctacctggaggtggcaaggtcctgggctgaggctccttccaagccgaagggagagcgtgggggttattaacttcagggaccaccatagactagggccagacacagccggaggccctgccattccactgcccttgacctcctgtgccatctgtatttggaacatgaggcgatgtcccagtccctgagtcctagagccctagcactggggggtcagaaggtgcctcagcatcgcgtgtccagatgttcccttctcagatgaggagaccagcaacctgagagcaagggctttgcttgggataggtggggctacaacagggctttctgaacatcctgtccactatttctccacttgtcacacgctggacaggccttctgacacaagggtgtccccctcctgccatccagcccaccctggacacatgcaacaacctctggcccttccagtgtgagaatttggcccttgtgacctcccagagcccctggcccctcctcactgtcttctttgcttggcagagatgcacactgcccagccccatcctgagacccctgacaacactgcaggacccccttggcaaatccacatgtcacccccacacacctctccactgtccctgcttccaaagtggaccctcagatgtactgttccctccactgagcccaaagagcccccaaaagcaggccagagactgaggacacagaatgtaactccagaagtccccacgccccttagggagtttggcaattagagtggtgagggggagccagagatgatttatacctcctctgtagatggcttgctttcagctgagggcttgcaaaccaatcgcaattgagtgggaatctccaggagtatggagtgaatttggcaatgggagatacagatagatacatacaatgtatcttcctccatggacaacgaagtattttcgtagacacatatattgtcaatctcagttgttttttcctcccgtccacttcaaacaccttgtcatttattccccacggtgatgtctgaacagccggcacatcaagggtgattatttctctaataagcttttaacaagcaccatattgagtgaagtgcatttgaacaagataattatttagcctaacagagtgcaaacaagacgtggcatggcacattgtctgctagcagagaggcatccagaggttctcggagtggctggattatgtctcctggacttctctctcttgagttcaccatgcacttttagagaaagacgctcagaccctctcccagaggctcgcttgagaaaggcaaaactaaaatacagaaacgagcgaattgagaatcttcacaacgtccctggtgggttgggggttgtgggggcccattttgcatctgtcttgcagctggctggactcgattcctcattcagtgtggaccagtcagggccaacgctgatgttctgtagggaccagtggggccccggtctgggtggaaacgccgcggcttttgactccaacttcaactttgattcaaaagtcatctcaccgggtcctggggtccatatttttctgaacctggccctggttcttttgggcatgttctgagcagttttgggcttggtaacccccgctcctgatgggggtctccagcatctcagtgagcaaccactctgtcgctgcccaaggatatattttggtcaggttttctctggattgtaaaaggacacacccttccctggcacactgggggtgttaacaccgtataatgtggtttctggttccaatttattgtaaagttgggttttgctttttgtttttcattcttgagccattcgtctggtttctaatccctgctgaacagctcctgctctggccctttttgtttcctgcttcttgactttttttttttttttttttttttagttgtagattttactttcttttgctgccctcgcttctcagacccacaggtctcagttaacaattaaattatttccgttggcatccgctttcaggcaggctggagacaggaggagacatttctctctgtctccggaatgtctcccatcagagacatcccctgagctgacagagctcccatctccccagctctccctcaggttctatccaagtcccttcttttgaaacccagagcccttttctagtgacatggtgtctacctctgagaatctaaacacaggaaggctccttgtgagtcatttatggccacctgcccctcacttttcaggtggggaaactgaggccctgagagggtatggggtgattcaaaaaggaaattggaagaggatgacttggatgcaggcctcagggcttgcaggcctgggaccttgcccctgcacccatgttccctcagctttgggccctggttggcccaaccttgacctcatgggcttggctctgaccttgccagggagagccccacaaatgcacccctgaagagacaggcctcctgttgggcgtggttttgtattggtttttctttccactcctatggtgttttagccattaactcaaaaatagaaactttccctttgcaaaggagactgggcggtcaggtcaccaccacgctcccccgcctccttccagcaaaggctgtccactcaatggctttgctttggggtgggaggatcctccctttcctttgtctctgcagaccaagccctgggctcagtctgcatcctaccccaaataaccacgccccgatggatgctggtgtgtgaggaggccacgtgtgctgtgtaggagacagatgctaaaaccgggcccctcctgagccccagcgtgtcccacccaaaggcgagacaggcctggtctctttccccaggccagagttcagacctggctccctgctgtatttgggtctgagtgtctttgtgtgagcccagggttcccagtggcttggtggctgatgtctcctcccctgtgcccctccccgttttctttcctttctaggtcctggcctggccttcattgcctacccaaaagctgtgacaatgatgccgctgcccacattttggtccattcttttttttattatgcttctcttgcttggactggatagccaggtgcgtataagggatggccctggggcgactgcccctgtggggaacctgactctgggaaagactccttattccacctgggaggtggtcaacccccttcccccctccagtcagacttccagtgcttcagctgtgagggttcctccaggacaccaggaatagaaaaagctctgcgtccccagaaagtgcatttgaacaagataattatttagcctaatggagtgcaaacaagacgtggcatggcacattatctgctagcagaggggcatccagaggttctcggagtgggtgggttatgacagggacaaccagggtttgtggttacagtcaagccacaaatgacgaattggaggtcatgactcaataagtcatgatgtgctccagtggagcgtcggcggggcacaggaggacatggcagatgggcgattcggagaagggacccacatttctgtgtgagctgatcattgtctgggccatcgtaataagttgcaagtgcccaggagaagcctacgccacactcaggattctgtgctccctggagcgtgcgaggggctgggcattggctccctcccgtgctttatacaccgcacaggccgggagcctcgctcaaacccgccctgacctctggctgtcctggcttctcccctcccaaggcaggactcctgtctccactgaggttctttcctgcacttctaaaccccgtatcccaccccttcagggctcaggcctccactagaaggtgactcatggccagggaatgccagtgagagccgatgagtggctgcatctggctgtagagtagccagtgcctagtgtggggtagtcagcagtgctcggaggacaattcacttgagctcctgggcccctttccctggaaataggtgtatttttgacagggtcttgttgaaacaacagttcagagcacaggcatgactccaggagtagggatttatggcatgtgggacaggctggttgtgtgcccagcccagcatgagcccctcaggcagcgccatgcacatgggccactgagaagcaggtaggatgtagactgtgtagtctgggtctggaggtctgaatgcctcttgggaagcctttgagcaactgagaccccctgagaggttggagcttgcagccagggcgggagaaccctttgtccccctccccgcgggccgaagtcttcagagtcattgtcccaagtgggtccccagaacctggtaggggaaaagtctctgaaggtcaagcagaggagggtgagtccagggagaggaggcggccagccagcaaggtcaagagcagagcaggggatttggcagagaagggggcaggattagcagagaagacagaacgaaaacatcagggagacggaaaacaaaatacttctgcagttgttgatagacttgagctgaataaacaagcaggaggactccattaatcattcctagttaatgagtttggccttcagaggccccaagcaaatggcttttataacttcttccagagctctaagtgaaagaaaaaaacaaaaacagaggttaataaatgacaaggcatgacatcttcatgggcccaaaataggccacttgggctttggaaacggctccctgagcaggtggaggtggtcactcattagattttctccccaggaagtggggcctggtggaggacacgcatctctcagggaggccccgtgtcagtggcacacggagagaatctggtgggctctcacagccactcctcctactttgcagagcgaggaactcaaggctcagagcagttagatgacctgccagggacaagggtagaaatcgaacctaagtcactggtctcccaggccccatgtcccagggaaccaggatgggaatctgatcgcacaggtggggcttcctcctttgcatctctttgctttgtgaacttggggaaatggggaaggttttgcagatgccagcagtgtgcctcacccactgccagcactgtgacaggatcagagccctctgccgtaagaggtgttccctgggtgccggtcctcatggcaggcttctgtgtgtgcgtgtgtttggggtgaccacacatttaccatctaaaccaggtttaagtgcacagttcagtggcattagtaccttcagacattgcgcggccatcaccaccgtccgtctccagaactttttcctcttcccaaatggagcctctgtccccattcaacactgactcctaactccccagtttgccctcctgccggccccgcacctggctttttgtacatgaactccttaagctgcagtgttgcaatgcctgggtactatttttacccttcttatagctgaggaaactgagacttagagagaccaagaacttagccaaggctccacacagctagtgaagggcttgataccaggtctgcctgtctgcagaaactgtctcttacctgctagtttgtcccaactggccttccccttgaattcccccaaaataacttcctcctgttggaagtatggagatctacagcccagaggcagaggcctcccgctgatgttattgcgtcctgggcaagggagcagggggtgtcaccctgactcatcaggggttcctaccattggcgggaacagtccgtctggcctaagagccatcatactgctgcgcctttcttggtgagacagggtagaggagtcagccatgtggaggcagatgcctgttgccatccaggctacccaagagggacacggttttttgtttgttttgagatggagccttgctctgtcgcccaggttagagtgcagtggcgcagccttggcccactgcaacttctgcctcctgggttcaagtgattctcctgcctcagcctcccaagtagctgggattacaggcatgtgccaccatacctggctaattttttttttttttgtagaaacagggttttgtcatgttggccaggctggtctcgaactcctgacctcaggtgatctgcctgccttggcctcccaaagtgctggaattacagacgtgaaccactgcacccagctgggacatggttttttttaacaaattgtgagaggagatgagagttggaacccactcctcctgcaaccaaagagctcacccagcccgctgacatgggttaacagttatctcccacttgcagatttactctaataatttcaaatctttctcaacatccctgccaagtggacaagatcctcccatttcacggagaggcaagtgaggctcggagaagccaatcacacagctgttaagcgacggagggctgaagaggctggtggagaagggcagtgttctctggaagcggcaggaactgagaaatgggggtttgtgctggtcttggccctgattcacagcgacactgaccttcctgtctttaatttccccatctcaaaaaaggaaagaacctttgtttttagctccttttgaagcttaagtgtttgagctgccggtttgctataattcggtggcaatttaggttcaaaacccctgcggcagacacatgagtcagaggtcaaaaaagcagcctcttctcttggatccctcttgagagcctcctgctcgtcttttcccttattcctggtggcagtctcatctctccagcccttgtcagcacatgaaagggatttctccccgtttgtgttccttccctggattttcctgcaatgcgtcccaaaggaggaaggggttagatttctctggtaggaatgctggggaaacgtccttcccaaaagcctcgttcagatgaaaggacatctgggtccaggttgaataagctcttcaacttttgaaggaatcagataggccttggagggtgtgttggttggcagggaagtttgggtgtagccatccaaatttaaagtgctgctgtgtgctctttaaccccaaagcttctcttttaagactgtgctacatgcacagatgcctgcacacaggaggagaggaagagctgagtctggagaccatcagctgggcattagatcaatggcgatgcctacccacagggtggagttttatcaattaaaaaatgaggcagctttctgtgtaatgatgtggaacaacccccaagataaatggttaggcacgagatggaaaggtttagaaagactgagaattcccctgaaatgttacctacagaggggccttttccaaccagcttcttttcctttgggagcccaggaaggggttcctggagtcccaggcagcacacacagcgtgtgtgcgcacatgcaaagtcctctcatgggcttgtgatccccaaaggattgaaagccactgtgtgaatctgacctgaactgcctgccattccactgatggggaaactgaggctcagacttcccctgacctgccaagcaagttggtgctaaggtccacccattcatcacattttctgagcagccaatgtgtctggcagggctcggcattcgaggcccaaaagtgaatgtgataccacccttatcttccacgaggatggagatcagtgagggaggttgtcatggcaacacatatatgcccctgaatgtgccaggacagagggtcagcattggcttcagaggcgcagttgttctcaagctcagctttggaggatggggaaaggcattctggtggcaggaacagcctgagagaagatgcagaggtgtggaatatttggccagctcggtgtggaccaccgaatgttgcgttgtctggctccgaggagtggcaggcgggactccccaggcacagtcagggaggccaggcttccacacttggacttgatctcacaggccaattctggacacaaggatggtcacgtctgctcctgcattgtgtgttcctgggcccttccctccgagcagcaggcaagggtggcctgagcgtcagccgctcaccagctctctctcttcccctcctcagtttgttgaagttgaaggacagatcacatccttggttgatctttacccatccttcctaaggaagggttatcgtcgggaaatcttcatcgccttcgtgtgtagcatcagctacctgctggggctgacgatggtgacggaggtaggtggctctctcagctgtgtttcaggcttggtgctccagtgccctcctcaaggccatagtggaggcagcagctgggtgagagggccaggtaggggcttcatctcccagccccacccaattcaggggtcctgcttggaccaacactgggggtagcacgagggggctcaggagcccacagctgacccaaactacccaattattttgcctgttgctgtggcaacactgtgaccacccgctgccctctgtcctgggaagaggatcttcagctgaaatccatttcacaacatctctgttcacccctgactgtgtgcccttctcaggcctgggggtggggtggagacattctcaagggtaaacgcaggcctcccaggaaataccacagcaccacgtagaggtgcaccaccttgcaggtcacctgccacaggaccgagtcctggtgggtatgggttgatagggggcacatacactattcagagggtgagcaggggccaggaggaggggcgatttcagatgcagacaagggaagcaaagagcagaagggaacgggaacgtctaagacgtgtctagcaagaggcaagccagatgagataaagattgtactaagaatggaagcctagcatcaaagccagggcacgctctctcctgcatgcccccccccaccacctcccctgttccccaggaacgggtcccatttaacagttctccgaaaacccaattcagggcttcacttcaccatttttccttaccagaagtaaaagtgtttttctggaggtatttgtaagaacccccaccccagaagtcagattttagggccactcactgagcagctgggtgaccctggagtcttctctgtcagctgcacttggtgtgaagcacctccttgggaagcaggctcccgtggacccatcattttgctttcatttatctgtatgtgtgtttttaattacatttgtcaaacatgaagttgagcatctttttgtatatttatctggtcatcagagtctttgtccatttttctcttgggtttttttaatcttattgatatgccagagctctttgtatatgaaagaaattggagaccaggtaggaaatcgaccttctgtggtttttttcttcacagggtggcatgtatgtgtttcagctctttgactactatgcagctagcggtgtatgccttttgtgggttgcattctttgaatgttttgttattgcctggatatatggtgagtacagattttttcatgtcctttctcaaggctctcctttgggcttctctacttagaagcttcagaagcagagaatactaacagaaattcaatttgagttgaacagtaggccctccctacctagactacacaaataatctcactgtagccacactgaagatcctcctggtgctaaaggtgtgaggtgtgactggatgttttcacagattcagaacttggttgtgcaggacctggaatactccttttttatctccttgaggccttgggtttgagtttgggctgtgcctaagattgcacacctagggtttggagtgtgcctcagattgccagaaaaatacaagatgcagagttatatttgaatttcatgtaaatgtctgtttttgccacacttgtatatccatggtgtggagatgcagaggcctggatcaggtcccagagaccccactcatggcccctgagctgctgctggccttgaacgctgtgtcagaaaatgtccccctctgtctcttgcaggaggtgataacctttatgatggtattgaggacatgattggctatcggcccgggccctggatgaagtacagctgggctgtgatcactccagttctctgtgttgtgagttccatttctgtggctctggctggtggcctcttctccctggggcttgacattttcacccgctaaaccatctttcatgcagcatctgttcagcgtgggcttataataaacccagcttcagcgctgcctgggagaggggaggaaggctgctccagggagttagcttgagttgagttttgaaggataagtaggaatttgtcaggagtagaaaacaagaagggcatttctggcagaggagccagcctgtgcggggccaaggcatcctaaaagaagagggtgtatctggagcatgttgagaaatccaggggatccagaattgaaagcacattctttccccaaaccttccagagcgcatgagctctgtttgggtcactggggaagtagaggggcctttgggatatctagtagagaggtcatagacattggaaatggggtgtttccatggagaggtgggggtagtagcttagagaggggaagtcctgggttctcccaaggatagggaagctttggactcacccaggcccaagggtatcagtgtgccacgttgttcttcccacgaggatgctctcgcccaccatgttggagttggccttggcacctgcccatgcagtctgcttcatggtcgcactccagggtgccagtgagtggaattcctccatggcaaagccgtcagggtttgcaatcacttgtgatcattggagcttattgccagggagaccacatccatcctgccattcacggctccactatggggagcacaaatggcccaatattccttggatttaggagacaggtgctgaggacaaataggccctcccctccgtgacctgctatcaggccagactaagtcaatgttgctgttaactcatgatatgacctcaagcaagtcacttccctctgtgagcctcagtttccccacttgtaaaaccaggagactgtgaaggaggaccccggtggcagctgacgaccttagactgttactgttatttaatatgcatatgaagccttttcctctgaagtgcagactttctcccacaaaaataagtaatggtaagagccagtaaccacaacaattggtgagtttatctttggagatgagtttagttggcccacctgtgttctcatcctggtttaatgtttgcttgtgggcagctcttctcagcactctgaccctcagtttccttatctctctccctgaggagctggatacgtcagagataggctgcattcccaggtggtgagatgaggtcaccctcatggagaggaatgggaaacaggcaggcactggctcaagctcctcctgcttgggagggcccagggcagcatctcttgggactcactcatctgagccacagccctacacgtagggacgggaacaacagcagggccagacgtgcagttggtgcccagtaaaagatgcctgcaggctagtgctctcccttgcccatcaccgactctgctttagaaagatgcatcttcctgtcaaatcccagttactaggtgttgaagagttaggccattttcacattatggaacaatcagaggccaccctgggccctcctcagagatgctgtcattctgactagaagcagaagccccgggagccccgagccagccttaggtgctcttctcacagggaaaggtgggctttgctccctttagaggcacagggctgaccccaccccaccattcatgcatgctgatggccactagccattagcatggacccagggctgggctgtggacaccgaacagggcaaggctcaggtgcccaggcccctgctgctggtggctcagagatagacatggagggtggcagtgggggaagaaaggctttcatctacgctgctagcacttatggtgcacttgttgtatgtacctggagctgcactgggtgttaaagaactaggacaagacacacacattcctactctcagactcacagtctggcagaacacgtgtgcccaagagatggttacaaccactcgctttctggaaggagaggtatgggtggtgcctgggcaagtaaggcagacccagtggagccaagttaggatgagaagatgtgggggaaagagggccaggcagaggaaacagcccatgccaagacccagagttcagtgacagaggagctagaaggaattcttcagggtggctggagtgtggacacggagggagagttgaggcagatgagggaggaaggggtacagcttctgctgacactcccggctgcaccgaggagtttgggctgcatctgctggcactgggagccacagaagggttttgagcagggaaacgacttactgtgtttttaccggggcgggggggatccttatggcagcagagaggggtgtgagttctgagccagtcctttcccaaggagagagacccttccctcaggttgaggccagtcctagtcccagaagccccccaccccccgatgcccaggacccctctcctgactgcccccatctctccgcagggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtggtaagtgcttgggcccagggccaggggaggtgggaggcgcgaggccaaaggtgattgttgtcagtttgctgcgtgatctcaggcaagtcacctgccctctctgagccatagttccctcacccatccagtggttcagcttatgggcagcagagtgcattgtgggaagacgggaagcaagtagagttcacatgggagaaggctttatggagacattggaagccgggctgtggggtgaggaggaacttgccagatggagaatgtgagagggaaggtgttcctggtgttggcagagttggggtgggcagtgaggctggagaggtgactgtagctttggatgccaagctaagagctggggctttatcctgggaccagtggggccatgttcctgaagcggtgggacaaagccaggagcctagggaggaagcctgagccccacccagatgccttcttttattgaggagccaaatttaggatcatcccagcccatgctggggtcttctccggatctgtggcggcagccagacctctgcctctgtgcctgctggggcctcccctggccccacctaccttcagcctcctctcagaaattcctccaacagccctggagatcccaggccctggcaaaggccctactctttccaagaaattcttttctcagaatctcccttaaccttttgagcttgggctggctccaagagtgcactgttttgttctgggctgtttttattgttattctcttttaaaaatctggagccaggatgtcctggggccctggctccctgctgggctgggtcctgtttcctcctgggcaggggaatggcctggaggtggtgctggtggcaggggagggaggggagactgaggaagctggcagggcaggaggaaatccttgaaactgggggggcccctggggttatcctggagcttttgacccattctattttttcagaggacagagggcagcaccccaaccagtctttagccagaacgctaaatggccctatgagctgttaacagactgaaatactgggcctggggacaggcagggaacagtgactgtcccgagccctccaggtgaccccacaatactccaggccaacccaaccagagtttccagaatgtccttactgtccagaagccaaagggttcattagggcacagcaaggggtctctaaaggttctgattggtctaggggtctctgctctgattggtgagtgcccaaagcaattacataccattggttcagggggacacccaacaggtcactaacttggtgtccttcaaagcctcattttaaaatattggtccagcccacatttagaagtttgggtggagtggggttggcatgggggaaagaggtgggggagtgggtgagggcaggcttcaccccacactggtaccccgtcctcctgtgccagtctgacttcaccaaaggcccctgtgaaggcagttgagccaccatctgtctgtctttctttatgtgcccctcaggggctcccacctgcacaagtcatcaaggtgtcctcccagccatgagcttctctctgagccaggttctggcaaacccagatctctgtcccaggatggttccagctctgcctgagcctcctgtgtaggcagagccccaagtggctgcctgggggtttgactctcctccgccctcccaggcacagcccattgtatggatgtggagaggcaaagtgatggagggagagctggcaggtggctcaggtgagggaagtcatgggggtagggctgggagcaaactggagaaggtgctacaaggaggggacctgggcctggagttgccagatcttgcagcttttcaagaaaagatggaaaactggatttaaaaacaaaaaaaatagagacagggtcttgctcctttgcccaggctggagtgcagtggctcaatcacagcctcaaattcctgggctcaagcaatcttctttcctcagcctcccgagtaacttggactacaggcacgtaccaccatgcctggctaatttttaatttttttttttaagagttagggtctcactgtgttgcccagactgcctttaaatcctgaccttgagcgatcctcctgcttcccaaagtgctgggattaccgaaaactgggtttttaaatgaaatactgtagcttttaataagcagcttttaaaaatttgtaacatacctaagttgaatataaatgcctagaaagagggcttgttgttttgtttgtttgtctttcaactgctggcctattcaagtctctgagttgacagttggcaagaggtggactggggagtgggagtctggttgagtcccagttctgacatggattttctgggtatccttggagagggacactcaaccaactgtgaggacaaaactcaccctgctcaggagtgatctagaattcccatgcagctcctatctcttggaagggcagctcaaatgcgagcaaggttctccaagcccttaagatgtaaaccctgctgggaggactggatgccttcaggaaactagggaagacctgtctctgcaagaaggcaggaagtgtagcttatgggaggctgaggagtttggagtttctccttggggaaggtgggagccatggaggctgaagacagttgtccaactcagggcatacaaatgagaggaactcaactgctgctttgcaaggcagagaaatcagagggagagaatcacagggaggcatattttagttccatagaagaaaaaaagcacatgaaggttgagtcccccatccctgtaggaacgtaagcaggggtttggccaaggaaggaaaccaccaacaggaattccgccttgagtcagggcctagtggcaccttaggagcgccttagttcaattccattatttccaaaaaggacaaaaacaggagatcagagagggtgtgagtttaccaaaaaccaaacagcacatgagccaattcaggaggaggcagatggccctggcgaaggggagaccaggccgcctgacgtttcccccctcactcctgtcatccttctccagagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaac

SEQ ID NO: 12180 - DNA, 29871 bp, Human
agcacacaaaaaaggagtttattttcaagaagctttgctttctttttcagttagttctagataagaactataacttcacataagatgttagaaggatttaagtacattgctgaaggtataaccatccatcttcaggaagtaagaatagtgaatagtaagtataaagaaacaaacaagtcctgtgataacatctttatcataatttttttaagtctattatgctttatgcaaatgtttagatttccttgttaaaaatctgctggccaggttaggttccctttctgtagctttattttcaactcataatatagtgactattaaatattctttacccaacacattatattgtaaaaatatacacttagttctgtttctatcactaagccactactattttaaaaaggaatatcttgcattgttaagtttagcagcccaaattcttaaaggccttaggaatggtgctgtccaataagataaccaatagctacatgtggctactgagcacttaaaaaatgagtctggccaggcatagtggctcacgtctgtaattcagcattttgggaggctgaggtgggaggattgcttaaacccaggagtctgagaccagcctgggcaacacagggatgccttgtctctgtaaaataaaaaaaataaaaaaattagctgggcacggtggcatgtgcctgtagtcctagctactcagcaggctgaggcaggaggcccacttaagcttaggagttcagggctgcggtgagctatgattgtgccactgcactctagcctgggtgacacagtgggaccgtgtctccaataaataaatgaataaataaatattaaaaaataaaaagtgtggctagtccaaattgaaatgtgctgtaaaatacacactggattcctttttttttttttttcaaatcctgagaacctgtgaaacacactgaattcttaagatttagtatgaggaggggaaaaaaagatcaatgatttacatataacaatgtaaaatatcaataatttctatattgattatatgatgaaatgatcatgttctggatatacttgattaaatataccactaaagttaatttcatcttttatttttactttttaaatatgcagcattgcccaataaaatacaggacaaccagttacatttttattttatatattcctgcttgggacataatatttaaaaattattcattctatatctgaaattcaaatttaactaggagtcctatatttttatttgctaaatctggcaattttattaatatggctactagaaaagttaacataacaaatgtagctccttatcctatggaacattgctgctttagaatcacctcgctgctttttttttttttccagttagcttctgaataaactctgcacggaaataactaatctgtggggaatatttaaccctaggctaggatcgttaatcgtgaagttaaatttttacatctgcatgaacaaaatggcttgttacagacgaaaatgtggaaagggcatctggactagaatgaaaagtcatagctcccagcctctctactagggtagttaacagtcccaggttcaaaataatccccgtccctcttataagattaggcggtgtcaagagcaactatctgtgagaccctgggccagtgactttctccttacctccgcccccaagtaggccttgcaaaaagctgggaggggtgcgttttcaacactggagcttcgcggccgctctcccactcgctccccgcccggcgctagaggagcgagttcggactcggaccccaaggcctcgagtcccgctgccttcctaagccgagcccgggctacctcggtcgtccccagcaggcttggctggcagaggccgggcctcgccaggtccccaggacaggccccgcccgggcctcaggtgcactcccggcccgccccgcgccctcgcgtcccgccccagctccgccttcgccggcgccgctctgcctgccagcggggcgcgccttgcggcccaggcccggaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgctcgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctctcccagatgcgcactggacgctgtcactccccctcccccaacggtcaacaccctagcgatggagaccctccagccaggtggcttgggaacgcttcacgaggtgacctccagccacagtgtgctcctccctgcacaggtggtcagtctggcctcccgtcctgatggccactttgaagagggtaccaggaaggtcctggcggtccctgggcgatgctctatggccctgtgtgtccaggacttactctagttggggttgggggtggtaagtagcagagccaggacttgggccaggggctatcccgtttttcctctagtctcttgatttctttttagaagagaagaaatacttctctttcctgaacttttaaaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagcctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctcagtgagcctagggtgttcagctcagcataatagtgagctgaaggccccaatgcagcagcaagaaaccacccagcaggacggcggagttcacagagaggggagagttcatagagagggagagtgccacaggccctggcacagcttcaagccctgctggatgttggtgctgagcctcccctcctggagcctcagaggggcttacaggggctctggagatcccaactgtgttgcttcttggcgtcatcacccttcaatggagtctgagagctaccctgggagatccaagtgtgtgtgcatgtgtgtgttttttctttttggaaatttgatgtccccagcatttggacctgctttctccacatatatgtagtgggagtgtgaccggagccccactgggatttcttagctagtgacatagcttcagtgtccagaggcatcatggcttgacaaaagaggcactccttggaggtagccaactgtgctttctggcccatgaatccacaggaaattggaactttcagttgccacaaatcctgggtcctagcctcacaggtgggtgtgttaccttcccggaagccagtgagtactatgaaagcagaggctgtccctgaggttgcaggcagaggccacagaggggaacatgacacaggaatccctacaaattctacttggggctgcctaaagaagagggaagtagtgaagcaagaagaagcacatggcatctcttggagttttacattgacccctgagggttccccggcttactctagtcacttgttcctgctttgctgcctccatcccacattgggctgagtgatggtggcattgatgagctcccaaaggccagctgtgccagggggtctgaccttatcttgctgccaatgtcagccttttgttttttaatatttagactatttatttagctgtcttagcagtttcaaaggagttatgtgccctttcacctacttatatgttgtcagtctttgcagggaggccagattaatgcttagatctttgttttgggctactggaatgcttgacttgaagttcagagctgcttgttcccaggtgaacagctactgctggaagttgctgcatcaacattctaatggctttttctatggcctgttgtctttcaacccaaacctggcctgctgaccactgcatctagtcccatgcctgctaaatgtctctaagcctgccctctgccccaaatcatacataaaggtgtttgtaagtacactggtattgaattactagtcatattttttccactgaagactggaacctcaggtgtcctgtttggatttttttaatttgttcaagttaaagtacatacatgtagtaccaaactttgtggtggatttagatctttgcgtcttcctcaatttctgacacaattctggatgcagagggaggttctcaggaaaatttttattgaatgagttaatgaataatttaagaaatcatctctaaagtttgagaactaaagaaaaatagttcagttcttagaagggaaacttgagggtggctgaaaaggattgactggaattttttaaaggaaatgtgactccccctgcccactgactggggctttgatgccacatggatgtggaatgaggtgttgggattggcagagggaatctgctagcaattaataaataaataaatattggcagggcgtggtggctcacgcctgtaatcccagcactttgggaagccaaggcagcaggtcacttgaggtcgggagttcaagaccagtctggccaacatggtgaaactccatctctactaaaaatacaaaaattagctgggtgtggtggcacatgcctgtattcccagctacttgggagactgaagcaggagaatcgcttgaacccaggaggcgggctttgcagtgaaccgagatcgagcctctgcactctagcctgggcgacaaagcgagactccatctcaaaagaataataataatattaataaataaaaatgatttatgaggtaaaagagttttatgcccccatgttccaggaatagtttggtggtccacatggttctcggctggcctctcctctggcccctcagtcatccctggggtactggggaattagccaacccatcatgcagtgcttcttggccatggactgccccatctgctggaaacctgggttgtttctgaggttgtctgggctgtccgctctttggtttcaccatagctctgtccagcctatggacagacaggttccttgagaaacttccggctgggtgtggtggctcatgcctgtaaacccagcactttgggaggctgaggcaggtggatcacaaggcaggagttcgagaccagcctggccaacatggtgaaacctcgtctccgctaaaaatacaaaaattagccctgcgtggtggcgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgagagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacctgtcatcctgggtcaaatttctgacagttgacacaaagcagggggtcagggagccaaaaaaaaaaaaaatggccaggtgtggtggctcttgcctgtaatcccagggctttgggaggccaaggtgggcagataacctgaggtcagagttcaagaccagcctggtcaacatggcaaaaccccgtctctactaaaaatacaaaaattagccaggctggtggtgcatccctgtagtcccagccactcaggaggctgaggcatgagaatcacttgaacccgggaggtggaggttgcagtgagccgagattgtgccactgcactccagcctgggagacagagcaagactctgtttcaaaagaaaaaaaagagtattctggagattgaagttcaggagttcagggttcatctcgactttgggcagccaagcaagaactaaagtataccaagatgttgaaggttgatacctttttatttatcgattcattcactcacctatgtaccaaagagctcctgagcctctcttctatacagggggcactgccaggagttgtagaggatgtgatagcaaagataggaaataccttttctctttgctctgacaacggtggggcaaggattcatcattgatttcagcaggaggcaggataaaatgtgtgtaggaatataggaatacatggcaatcagtaacatgtggtacctagcagcatgtctgactgttgatacggtcaggctaggtacatcccctcagggaagaacttctgtcttaggggcacacaccctatcttttttcccttcctgccaattcacaggtaagaacatttagtcccagggaactatgtcatctctctacttctcataactgaaaaagcagtgccaattatgtatgaggtataggagacacaattctccctctttttaaaaatgtttaatagctttattaaggtgtaaatgacataaaaactgcatgtagctaaagcatgcaatttggcacacatgtatctctacacccttgaaaccatcaccactagaaaggtgcatttctccccaggaagaggggcaagtctaggccctttgccagagttgctcccagattgttttcaggttgggcctgcattcacagctcagccagctgaagggtgacagcattagactcgtgacccaaatcttaaacccacacattccattttaacattgatacctgtgatcatcagccagtatagcccatcccatgtgccaggcggaggcatcaataagctggtctgtagcagctttaatcacagctggggagccaggagctaaggaatgctagactcctttgtaaacaatttaagtagggggtacttagcctggactctatgtgcttctcatccacctcttctcagggagattctggccaagtcctggaacctactgcagtccatctggtggttgacagatatgtggacggattggcaggctgggacccaatctatgtttgcccttgtgttcagttttgagacctagcacctttcctgatcctgctcacagaccccctgcggccaataggaaagaagtgttaatgcatatttgcttttggagggcccaaagccaggcccagagagttgtcaagggcggtcagtggtgggtggatggcagagttaaccaaggagttacacacctgcctagactaaggacaggctggaccaagtagagagggtggggctaagggagcctgagagatgctctggggcctatctcaaaatgagcactatagtcaccctgtcccctgcagagattgtctgacctggttttaggtcacacccaaccttgccagccaaggagtctttagaagcctgatattgggagacctgtcctggggtctacaaccccagaactcactgcagaagcccacgtggattgctagtctagctcagccatatgggtccccaaccctcacctcatgatagtcctgtgagaaaccgctgctgaccctttgttcatgttttcatcttttccactataaaagacatgctagctgggaaatagagcccatcatactcaagagtggcaggagccaggtcctggcccctgaagcttggcctcacacacagaggccggcaccctgtcatcaattccctcagctttttctccgcctccactcccagtcctagatttagcagccatgtgtgggtgggggccactgcagggatacttacccacctaccagagagatggcctgtgggtgctggcccttctgaggctgtggaggttggaggctgtggcagcctgggcagtcaggctgtggtcctcccatgttcttgactcctgctagtctgggctgcctcctgattaggggttggatgctccagttcttccctgggttggggattgccaccctactcccagcccatccaggttcacgcttattccaaagcggagcaccagcagtgtgcctgctgcgggagttctccgtgtccagcctgagggttgcctgccaacccctctgagaggtgcccggaggctgtgcgcccacactgcccagcagtgcggagaagcaggcttgtttttccctgtcactggcttggaagagatgctttgttctagggagccgcatgtccccttgcctgcgttgttggtgaggagccagcaggctccgtggagggcaggctagcagcctggcaccagggaggcaagggtctgagttcctaggagggtggttgctcatgtgagaagtctgcaaaggttactactgagcaccatctctctgtctgaaaaacatttttcatttttctgtgaaccactaagtttcccgtttgggctttcttcctgcttttggctcttgtttaggcaggcgcagccagatccaagcgtctggctgcttccccatgtcttcagacctctttttctgttcatggtaactatagatggaaccacacattggaagctggaaactcaagcggtgcagcctattccttaccccaatccctgttttacaaatggggaaatcaaggcacagcatggggtgatgcttatctgaggttggaagagttaatagtagagtgggagctaaaacccagtttcttacctccaagctcagggctttcagctgtaattgagcctagtatagttggtgtgcagcatcagggattccagctctaaaggtcacaaaaaggacccgggggtcattggcccagggtgggaacctgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaagcaagacagtggggcctacaatgctatgaaaaacaggatgggaaagaagcctgctctctgccttcctgcccaggtgagccatcacctgactaagtgagttcacactcagagcgtgtggggatggcaggatgttctgacttcattttccaggatgcctttgctttaaaaccttttaaaaagaagtgaatgatacaccccctttgctcatcttgcagtggaacctggtgtgtgaggacgactggaaggccccactcacaatctccttgttcttcgtgggtgtgctgttgggctccttcatttcagggcagctgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgatccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattctaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatggcacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtttcactcttgttacccaggctggagtgcaatggcacgatctcggctcactgcaacctctgcctcccaggttcaagagattctcctgtctcagcctcccgagttgctgggattacaggcatgcaccaccatgcccagctaattttgtatttttaatagagacaaggtttctccatgttggtcaggctggtctcaaactcccgacctcaggtgatccacccacctcggcctcccaaagtgctgggattacaggcgcgagccactgcacctgcccagccagatttttttttaaaaagcaggttaacctgtttattattcctactttacagatggagaaagtgagacagagggattaaataacttccccaaggtttcacagctggcaagtggcagagttaggatttggacccaggtagtcttgctcctctattgtgtatggactactgttctaggtccctgctgtcctaaaacttgctttctagcaaggtggaatgtattaaacaaccaagtgaggaagtcgttgttgtccttggccatggtaagagatacagagaagtgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtcctttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttcaatttgtgtgtactaaatttggggtgactatgagacccctaagtggagaagtagagtgtgaagctggctgtatggatatggtactgcatgagaggttttggctagagaaacacatgtaggatttgtcagcatatagaaccctcagcagagccccagatagggatgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttgccatgtgacacaatgattacctgaggaaagcatttaagttccaaaaggtctattcccagggaaactggaaacaaaatttgtgagtgtgtttaggaccactttagtctacagaagggctaatatagtgtttttcaaacctttctaaacattttggccacagaactttcattaaagtaggataatttaagtctagtaaatgaaatacaccctaagtggctaaaagtatggctgttctgcctgcagcccctgccttcaattcccaatgccctgcctcaagcctgtctgtgcccccttggaaggcccagggccctgtgggatggacagcttctgagtgcattacttctgagtaaaccagttctaaaacctaagctaagtagattacctgaaagcaatcaattcatgccctaacttgtctaggacatcaatgtaactttttatatagtataaaggtttcaccttctttctggcctatgaatatgtctgaaattcaagagcaattaaagtactcctgggttgtcaaagccctttatgtaacactattgagttatctttatgcgtctgacttgtaagagatgcacaactctaggaagaagtagactgctgtgtcctgtttccaggtatgtgtgtgtttgccattttgttgacagactttaaaagcaaacatttctggccccaaccctgaactgccaaggactggtgctatgtaaagggttctctggatctgtctcttccctaccatcccagggagctcttaggaagggaaagggcatagagattataccagcctgccttgtggttaggaaccaccccttggttggcatatagaacatgcttgttaaaaaaaccatgcaggggaaagtagagtctactaccaggcgagagtttctcaacctcgaccctattaacattttgagccaaataattttgttctagggcattttcctgggcattttagaatatttaacaacatatctggcctctactcattagatgccagtgaaccccaagtgatggaaaaaaaaaacaacaacagaaaaaaacctcttttattgaggaaaaacaccaaactcttccacatagttgcaagaccttgtgcaatttgcctcctagccaccactgtactcttgaattgcacgcctgatgccaaccacactggttcctcatgttcaccatgccccctccagccatgggggtgtgtggtcttctcagagtctgaagcattccccacccaccccaacccaccccctgtggccttctttaaccatgctggctaattcaggatccctagttccttatgactttcctttaaaacgtctaccagaaattgggggaaaaaaagtgttattataggattaatgttggtcttccccactatactgtgaatatcattgagagcttggtccctacaccttaaatcccccatcgtcaactattttttcccatctcagtgtcccatgatcaaggagaccctccctgaatgtccagttccccaacccttacccccagtccagggtagcttccttccttgtgcctctcattaacctgcatgccgatccttcagtgcacttgactcagtgtgtaattgtatattcagtagcgtgttgttagattaaaatgtggttaatatgtgtttcaccagttatactatgacactccttaagggcagaaacagcatcttttttaatttattgatatccaagtgccctctataatagatgctcaataaacattgaatgaaagtgggtgtcagccagtactggccagactcaaactgaacccactgcttcccactagcttgactttttcctcctgtttgtggcactctctttaaaacaaaccaaaataaacccaattttaaaaactttttaaaatgagcacggatacagaaaaccacacagaacaaatgtgtagcttaatgaatttttttcagagaaataaccttatgaccaccaccaagtcgagcagtagaactttgctgtccactaagaagccctgtccatgtgccccatcccaattacagcatcctctctctctccccattaagtaaccgctagcctgactcctgtaataatcacttccttgtgagtttttttagttttattatcgaaatatgcatccttgacacaaatttagtgttgcccacttaatatatttgatgtcttttagtctacttaatctatggattctccttctatcgccttctatgccttactgattatctatgaagaacctgagctattccacctatagaatttcccagtctggatttgttgattgcacactgatgatgcagttcagcacattcctctatgctctgcatttcctcaaaattggcagttggatccagagacttgagattcaggttctgattcaggttcagtccttttggcaagaccataggaagcatgcaattcctgactgtctctttatgatgttaacagtaattagtatataatgcatagatctattaatccattgggggctataaatggtattattctaattttattaccttttcatttaaaagttagaatacttttgtacatgatactacctcttatctattattggttgctgttcacatagtttacaaaggaaaatcaggacaaatgcttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatgggcactgtgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctgggtatggccatcaggttggagttgagtacttgatcctgtatttcaccatcatcccatcacctacctttctggagacagctgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgatggtcaatttactaggactcaccagagatcctccatttacaaaaagggcctgccactgcacagggctgagccagccccagaaagagggcggcatggttggaggaggaggggctgtgactggcaagcttgctaaggtagagaaccccttgtctgcagagcactgtggctggtgatatctacggacaagaataaattgataggaaggggctttcgtcaccttcagggttttaattcagagtgcacactgcagggctttgtctcaaatgtgccagcctgttgtcactgagaagctgccaggccggcctgtgtttggaggaacctgactctagctgataaggcctttgagttccttgggttgtattgttgaaagggttgttttttctttttatatttaatattctttccttgaggcttaagtcagcatgtgctgacttagtaatgacttcacttttaataaattcttcctcatgtgaggattaaagggggcctaccatggcatctttagcacatggcttcagaacatggcgaaattttcaagagagaactgttgcttgggggcctgagaggccacagggatgtacccccaggagacagtcagacaggaggggttcagaacgccatccgctccctagcgccatgaacttagagagagttctcgctgttttcttgtctgtgtattcacaaagataccataaaaaattaataaggaaggaacccaaattaaactgctaactcgacctcccttgttttgaacagggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctgtgcgtggcactctggtggtgagtgtgaccctgtgccccatgtgcccactggcaggatgatttctgtctggccttcactagagggcagcaacaacccatgaatccctattttgtctcccagagacaggaagcatagattataaattatttcagaatgttttctccacactcaaaagagccaaaacaaaacagaatcccatgacagcaacagacttgctctcagccctgtgctgggttgccccaagtgtggggaaaaatagcagtagctgtgagaagatggggtccagcatgccctgtaggaagttcccaagcctcagggcaggacagtgtaggccctagttctggctgtgtgctgctgaagcctcatgccacaggcactggcaccaaaagcaagagtcctcagggtagccacatggaggaagccaggctccttctgcaccaccaaggtagaggagttgaacaggcagagaagaggccattccagaccaagaggggaacactgcagaggtgctaaggtgggaatcaccccttgcaggtggagaaggtgagatcaccagcccaagtggagcagagagcatttcagggcatagtgggagagtaagccgcacatcatggggcccagtcatgaccgagggtggggggcggctacctggtcccagcaaggtggaaaataatatccatagagcactcaagtgccttgataaacatgctaatttttttcctttttttcttttctttttctttttttttcttttttttttctcagacaaagtctctgttgcccaggctgtagtgcagtggcgtgatttccacttactgcaacctccgcctccccagttcaagcgattctcatgtctcagcctcccgagtagctgggactacaggtgcctgccaccacacttggctaattttttttgtatttctttggagagacgggtttcactgcgttggccaggctggtctggaactcctagcctcaaatgatccaccggccttggcctcctaaagtgctgggattataggagtgaaccactgcacctggccaaacatgctattttaggtagagtatctgactaatctgttggataaatcaggggtagggtgaggagagaagagaagctaaaaggccagtgcagaagcttctgttggtgccggggacagggaggagagtgtagcagggcctgggctgacatagacatgcacagaagccaggcttccggagcccatcttgcacccatctcctcagcccagcagatggcaacactgctcttcagaaatggaggtggccagccagcatggggatgccgtcagggggtgcagggctctcccatttttgtgcggtgtggggtacacataagctcatccaccccaggttattgctgcgtgtggatcagctctttgcttctggcttgtgatcaccaaacattccacaagctctggttctgcaaccttattcccacctatggctgtgctctacctggtctgtgggtctgctgttggcagggaggcctcactgagattggaccttgtactgccaggttcatccctgagtccccccgatggctcatctctcagggacgatttgaagaggcagaggtgatcatccgcaaggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcccagccctctctctgcccaagccccaactgcccattccccccatccccccactccccacccccacacgggccctgttaacactcagaagttgaggaataggttacagctgcctcactcttttcaccacgggtttcagattttcattttttacttcctttctaggcaatcatatattttaaccattacttctaacaataaatactctttttgagtaataggcctttcataaagtcagcatttgggaaaatcattgtttcttatacctaaggtggcttgtcaccttacaaagctaaccccaaacgtaaaatgtaaagcacaaatagatttggagttagaagtatttcatctcttgagtattagcaattattcattaaaaagaaaaaaaaagtgtttagtctctttctgccctccaatggttaattattgcatatcatcttggagtcaggtcctttttgatgtccacctcttccccctaccccacccctcccgtcagccctgttctcacacaccatgactcatttcttggctctacctagttcctggttcttgcttttccttcccgttccctctcctaccatctctgtagcaggcagttttccttggtctcgtgactatgagaggttagaagctgtaaatgctgcctggtggggttctggaatgtgtctgtggtctgactggaagatgaggggttgggtgtgggaacagccacaagcagccctgctgaagtgtgagaggcaggcatggttgggcttggaaaagagggaacagttattgtagacagcggaggccaatggccactgccagccctgcagacttcccagtgagtggtggcccagcagccactgtcagcatgcaccagaaaggggtcctgtgcgcaaaggtcaggcaggagtgtggcagagggcttttaagttaggtggttttgggggcttttaagtgaggggtcaatctgggtgaatgcataagccccactggcatctttgaggaaatgaggctatttcaggggatactttcagtccaaagttgaccttttgttgaacttctaactctggaaaaacaagctccaaacctgggtttgcttaagaaagcaacatcagtgtgtttagacgtgtggtttattaatggccttggctgtgctgaatttcataggaagtcactctgggtgaagctcaggtcaattttcctgtttttctatttgaattctttttccctggaagcacaccagtaactacatagtataaggactcaaaacattaacttttaaaaaatatcagaccaataaaccacacagccaggtactctctctgacccagagggcagggagccaggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactctcgtggggaatctctccagatcttaagatgaatccttgcccaatttgggtcatttagttcccgtctcctacccagttaccgacagtggctgaggaggccaggtagggcttttaagaaggatctgagtgaagacaccatgtcctgtaggctgcagaggctgccagttactttctggaaatgtggaagtgggatgtgctcctcctgggatgtccataaacggtcctggagtcagggctatagcctagatgtccttaccaggttcccactaatgaggcaaagtatgtcagaaagggatttgtgaattaccagggagaggaaacatgtccaagtgcacatcgctagcttttgctcagcggccgaaccctgggattctaggcgacttctggagcctggtgggttagcggtgagaagatgggcgaggagggcggacttcatctcagagtccttattactagtctcatccagctttgaggcagtcagccactgtgcctactgagggagtgctatgagtcacccgcttccaaggaatggcccaggatccctccaggcagttcaccattccctgagttggcctcaagacaggagcagcatgtagcctgcaccacagacatgcaagcctgtgatgagtcacccacttttgtgttcacccaggctctcctccctgctctggatttcctggggactcatgcacatactctttttattgtaccagctgtgtgttccacctgcagatgagtcaaaacagtctaatccataaaggtctggtttgtcaaagagtgtgggtcatcaacagagagaatgcctactggggatgcccaggtcaggggtactgcagggcatcctgatgagaggcagtgtggcccctccattgggagccacctctctgctccacaagtaccgcggggctggtgtcagctgtctctgaccagcctcttcctgactggtcaccacaggtagtgtgtgagggtctctctccaagtgtttgacctaatgttgttccttttgttatcttatcccccaaatcctatcacacctcacttgatgtctgcctcctgactcattctctagctccttctgcagttgctggatttgaggaggttcagcttaggatttttaaagctgaaaggcaggttggaatttttcttttcaatgaagtaaatctatctgaattatacaagcttttttgctgggacactgtctatatggaaggctctgagagcgcactggcgcagggtttacactgtaccacttgggctggggaaaattatcttttgatctatgaagtaagacgcagggttacagttactgctgccttactagtctctgcttaaagatggtttggaatttactgaaataattgcattgtaaaagttgtacaggttgggaaagatgtggatactgcttttccagctttcttctgcactctgtttcaggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccaggtagggaccatgtgcatctatggtttggggtcttcactgagtctcttactgtctaccaggctgtctcaattaataaagagaataaaatcaagcccatcacagctcccttgcttatatacattcttggcctaaaaatcaatagaaagtgtcttctgagactagaacacttatggcctgggctttgagggagtgggaaaaagcagccattggggctgttggttaattttactctgtacccaagttaatgtgctcatactgttttccactgcagaagaagagggaagaaatagctatcccattcctttttttcctggccctgtcttctttatttattcaacaaatagctatggcatgcctaccatgggctgggcactgtgctcggtgataacgatacacaagaaaacaagccaggcagaaccccaggccctcatggaacgtacaccctagatgagaagacagacaacaaacaagtaaataaaatgcttaatatagttcagactgtgttaccttctaggaatacaaatgaaggacaatgccgagttagtttacatagtcacagatagtgtccctgaacagggggcagttcagtagaaatgtacataaagtgacagaaagccctgaaaaagtctaggagaacattttaggaagaagaaatggcaaaggcagcgaccctgagcaggggatgagcctggcatgtttgaggaggagggagaaggggaggggccagaccactgagagggcctcacagacccttagcaggattttatttctgaaactatcttagtatcccacagatgggtgggaggtagccatttccaataatttatagaacagttcatgggccctcatctctccctctccatcactgtgcccagagacttcagtgtacctgtagatttgggagcctctgatggtcacttttgggcccatcaggctgagaacactgcacgggaacagctccccatgggatgtggcaggaggagcccagaactgatgtagaggctcacagctgagctcagagtgaccttcaggtcacacatagctctcccatcagcacagcacagagagattagaagatcaactcgagattctgatggcctatgatttttttgaggtctgagtgggaggaaagcatgaaatgagttagaactgaattctccattcatctaaacatcatgagttaattccatagtgcctgcagtgtgaggttctggggtgacagttaatccctgacagacatgtctttaatgacttatagactgggaagcaggttgattggactattaaggagcttactctggtggtctccaggttgaggaaagtgcatgtccttatagctgcaggtcccagcctcctttcagcaatcaatttggagggaaatcttggctatagccccttcccccacaataggaagtgatagaaactgactccccaaaaaatttgggaagaaagtatgtttgttttgctctcaatagctgcatgccatgggttggtacctactcctaccctctttcctttgcttctccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtaagtcccatgagccaagggcacactagagcaacgggatggaagtactaactggcttgaatgtgagctggaggttgcgtgttaacaggaaaacaagttcatacagtacatgggctccatccagtactggatctttggccgggaagggttcttgtcccagtgcactggccctcactttcaaatggaaaacaacctatagattacctagaaattgatgagaatattagagggtttgtttctgttttagccatcccaggccttccatcagagactacaattcctttatcctaagaacctacagagtggtttagggagccagtgtgcttagttggagaaatttcttggaatcagagtttaaaaggaacatgaggggaaagatgtccatgcaagaggtctgatgaacgtaaaattattataacctagagcactatagagtgattttatcttgtgtgaagatccaccccatgccattttatgtagcaggtctccagttttctcttctcagaattatgtcttcatagcacctgtggtttccctgcacatccctagccagtacctctttagggagggtggcacccacctgagagtactcagagtgctttgtgaacatgctatgtagatctcaaagcaagcaaaagcaccctgcctaatctgaaggcagatcacatgggctgggacacatctgcagaggtggaagagttatttccatccctggacaagtacctcaggttccttggaaacccaaccttggtaaataagaataatcagcatggcccagaaataggaataatcagcatggcccagctcttctcctgcaaccgcccctttgtactcctcccctgcatggtggaacactgctgggctctgggcatgcctgtgccagctctgggttctgaaacctgtctagatgccagattctaatctgactgctcagactgtgagagatgtgagaccaagaaggaaagtgatccccttccagagtcctgggagcataaaggggtagatgagagaccaagtctaactgcagccctgggcctgaggctccgtctgctttgccataggtgcctacgaccgcttcctgccctacattctcatgggaagtctgaccatcctgacagccatcctcaccttgtttctcccagagagcttcggtaccccactcccagacaccattgaccagatgctaagagtcaaagggtaagaagacctcctctgtcagtgttgatgcactgggtctgggtctggccaggtctcaggagcccctcacaatagagctactcgcaaactccctctcacagacaccatggactagtttagccattaaagggttgtaaatggcaaggtgcttacttatagcccatcctctctggtctgttcctgtgtggacatgtcactatacacatctccatggcagtagccgcactggataactcagaggctagaagaaacctttcagaatctgctgcaggattctcttcccagggaagatatcctcagttcttgtttgtttggagactgggaggcatctttttaaaatgtgttactgacatatttttgcttgtttttatagaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttactgtttatttgtttgttgttgtatccttttctccttgttatttgcccttcagaatgcacttgggaaaggctggttccttagcctcctggtttgtgtctttttttttttttttttaaacacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaatatcagcaactgcctagaatctttatttctagaatttagtgagcctgtgccacactgtcatctgccttttctctgtatcagcttgggctaattctagcaatggttgggattaatctctaagactaagatttgattcttgtgcactagaattcttcactttattaattgactatgggctgagccagccttcttgcacaaatgtatcttgggttcccttgaaagtagagactgagacaagtgcttctgtgcagttaagcagtttatgctttggggacaagattccagggagcagcaataaaggacaggaggagaacagggaaggagggaggctgaatacaaagatgcattttcaggttgactagcaccaaaggcagggatgctccatccagcaaggacttcagaagaagcttatgaaatgcatctcaacaccatctgtaccttgagtaaaagggggaagcatttctctgttggcatccatttgtaaaggcagcccacaggtgtcagctccacatgtttccaggctgcacatgcatgagtcccaaataagttctgtcccgtgggtagaaagcaagagagaatacattgcagggctgaagtaggggttgccagagcccatcagaactggtcactgcaacagtggctggagtaagtggtgggctgagaggattgggggttgagtgtggtgcacaagaggtgtcttaatctatatacaatttgcacagggcattttgggctagaaggtgtggatggacctgggtaaaaagctccagtgttggatagaaactcaagggcatgttgcataacaaaacaagcagcatcaaacttgggggagaaggaaggcagcacgtcttctggaacactgttggcttctccactctcctcaaacatggttctgtgctggactactgattaactgtcttcccaggggctctagaatctgaattgcagttctgtctacccattgtcctgtagcaggagtgaatagtttctgcattttctctcttattctccatgccactgattccagtcatttgtggccttctgagggcaaaaaccataattacctgaatgcttagagctcttcatgtggtgaggcaagagcccaagtcacttccagggttgagccaagcatgtggaattccaagtcctctgtcgaagcctgttggattcgtgtgtggcttgtttcccttagagccatgactttgggaagactgagtgtgttatcagaccaaggatctcctctgctccaggagagaggcatacacaaactgtagccacaggggcagagttggtgagtgatgaggtgttcagttaatgtgtataactagaaaccagcatacccacagaaatataaaagacaaagaaaaggaggtggaggaacaacccagattttcttaaaaaccagtttcctgccacagatcaaagtaaaggcaaagatttgccataccatcttttcctattcttggaaactagttcttatctctgtcagggttccctgaacattctcatggattccataaggctgttgtttgtcaaagagaattattctgcttaatacctggtctaagtgacggtcaatgaggtgggcacaagaccctattccctgccaggtagtaaatagcacaatagaactttcttctgggggtttgtcttttaattcttttcctaaagggcttttaggctgatagaggcttgatgcaatgcactggcaacaccttatgttctatgccattgctttaaaagcactttggaaaataaaatctcatgagattaacagaggatgcactgatgacagacacaggtttctcagcagaaatcatgttttggagctctcaggcagacccacccctgaaggtgtcacctcatgaagaagggacataacctcagggacagagttctgtaagaagccgccagagacactgggacatcatctgtctgttgcgccagccagagggcagcagccaggcccctgactggctctttacctgggaataagtctcacaa

SEQ ID NO: 12181 - DNA, 8674 bp, Human
ttatcccataaacctaatatcaacacatgatatactacaaataatttgattccaaatgaattaagaaaaaaggttttcaagtttcagattcttttaccaaaaatatcctgggaatttgagattgtgcctatgcagcctcaaacggatgaataaaaagtaatgtaggccgggcacccggtggctcacacctataatcctagcactttgggaggctgaggcggttggatcacctgaggtcagaagctcaaggccagcctggccaacatggtgaagccccatctctactaaaaatacaaaaattagccaggcatagtggtgcatgcctgtaatcccagctacccaggaggctgaggcaggagaatcgctcgaacccgggaggcggaggttgcagtgagctgagatcacgccactgcactccagcctgggtgacaagagcaaaactccatctcaaaagaaaaaaaaagtaaagtaaagttttgtttttttcccctttgggtggtgagattaaaagtaatttaaaagttttaaatactttaatatattttcacatgtcctacaataaatatataacttttttaatttgacaaaaaataattttgagtggttacaaaaagggacaggtgtggcttggtaactagaaaaacattcccagcctgggaaacaatctagtgagagcttggaggcagaagacagaactctgattacattcaaggagtttgccagatggcaacagataactgccaatgttcggttgcactataattattatacactctctgtcacttcagcaagcgctcttttcacaagacaagtggtgacagaatgttgtattaagattacccgttgctaagcttatgttaaaatgaggaaatgaaatggaaagtcttgttttggtaatgtctctggggtatgaggaatggagggaaaggtttgactatgagcataactgcatagagaattttgtttgtttatgccttttgggaatgcattattttgattgaccctaattgggaattcagagggggagatttcctctattatctataaagaaaggatctgctgagcaaacacaattgctagggtcatgtttaaagtacttaattgatctgctttcaagtctaatttaacacttcaggggctccaaacatgtgatacattggttacaaactcatcttagtctaattttagttagtgttcatattagaaagttatataatacttttctttctttcagatatattctataattcacatttttcactaattttacccagttctccttccactcccaatctatccaaataactgagttgaactgtgtgagtttactgctctattaatttattgccagagatatacaaaccatgacttcctcggctgtttcagatgaaactgtagatccacgtgtaaacttgcaatgcacagcttagctggaaagttacgtggagcaggtgacggaggggatagctttcactgcttggactaaagtcagttttgaaagagctaaagatgcctattgaattctggagtgtgtgtgtgtgtgtatgggtgtgcatatgtgtgggtgtaaggcagcaaactcttcacatttcaaataactaaagatatgggtggtaaaatgaagtcacatttttacacctcacaggctgactagggagagcagtcaaatgcagcatcgattggttaaaattagtctatcattcttggtttatgatgttttaaagacatgttaaagttattcatgaagatgtaaaagacacatttaaaacccacatcaattgcactaaaagtcaactggaaacagaaggtttttaaatcctggtggtggcaaattggcagccaaaggaacaaagtcttagtcaacatatttccatgtccccctgaacacaaatagcctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggtaactgcaggatttttatgcttagcatacggtgtgtgtgtgtgtacaagctgcaaatgagaaaggcagaggaatgtttgcatttcttaatgaaataggcaatgccccttggatacagcatgccttaagatataaagtgagtactattgctttctgttttcctttttttttctcctaagggtatgcattttctcccttcctagtaaaaaaaaattttttttctttcttgtattatggaagatggtcttttttctatcttctctaagtctccattcaaagaaagccaatgtcaaacttcctgcacaatttattcagagctttttgggttttagttcatccatttgcaatcactggatcatatggcatgaccttgacttcagggaatgtttaaaatgaaacccaaagtgtctttatgggttaaaagcagaaaaatggaacttggctgatctgaatttctgcctaactggttcattcttcctaaagtgtataaatgtgtgtgaaaggaatgttcacaccacaccttacagttagcatatgtgttgattgaattgaattcactagaaattctcaccttaactcttcatgttttattcatctaaaatcacataaaacaacaaatattcaaggtcaccattaaagtgcaagaagtagtaagaggtaaatcccaagaaagaaagaagtgtgatgggtagcctgctaattcagaaatgactgaaaaaaaaaaagttaagagtgcataaacatacacagtttaaacaataactgaaaggcaacacttctataattatcatccaggtcaagaaacagatcattgccagcacccagaagcccattcttgatcaacccccattctgccccaagatgttgggatcctcttgtccctgttattctttataatttgaccatctatgtctgcatgcctaaacaatatgattaacctccctatttttgacatcatataaatggagtcatattctctgtttcttttgtaaattcttctttcacccaacaattatatttgtgagatctacccattttctgtgtagctatagttcatatattttctttgctttatgaaattcaaatgtataactataccacaatttatcatccattctgctgttgataaacatttgagttgtttccagtttggagttattgtgataatattgctgtgaactctttatttatgtaacctggcacgcacgtccttgactgtcttaaggtagaagtgaaatgccagatattagagaatgaacattttcaacattaattctaagaaagctaaattgttttccaaagtggttgaaaatttatgctaactttgtttagccaggccagttaattgcagtgacaattcacttgtgtcataactcctaggaattctagtaactagttccagtctgctaattctagctttgcctctaacttgttatctgtcattacacaaacatcttaatctcctctctctaaaagtcagtttctcagctgtaatcttgagaaagataaaaactgcagtaacacttgcctgagttgttgcgaaggtaacacaaacagagctgtggaacagctttcaatagtatttttctcattttctgagtatatcctgttggatcactatccatgattcccatgacttaacagcttaatttaataggcagatttggtgggaccgttgttttgctctccttgaattgttttgaccattataagccaggcttcatattttctgcttatctctgcatttcttgagaacttacccaaatagatggacatttggactatggttttatttcattgataagtttataagaaagagtctgtcttcgtttctcattcctttgcctccaggcaccttggcaagactcattaccgttctgttctcctctgctcttttgtacattctcataaatcctttttccttgatccattcattttattctgtttactttctcctccatgcaaatctttgtaaagattttctattttttcccctttttattttcttggagagacagggtcttgctgtgttatccaggctggtcttgaactcctaggctcaagtgatcctcccactccagcctcccaaagggctgggattagaggcatgagccaccacgcccagccatttgtaatggttttcattggcaatttactatttccttcatgctgaggtctaaaagatggataataattaaaagggagatgaaatataaatctgtcatcatttggctatatatctactggttggcaccatctgatttgaacttgtatttttttttgagacagggtctcattatgttgcctaagctggtcttaaactcctaggctcaagggatcctcccacctcagcttcccaattagctaggactacaggtaccgactgccatgcctggctgaacctgtatgttatgccaattacacaatatgaaaaatgatcattcagttggcatttatgcaattaacaatttggtccattgataatataatcaatacagtaattacaattaataattcagtcatgctagatagtttaaaaataccactcagaccaaaagcttgctaacaaccctttcagcctcttgaactctcacctttagcaaacacacaaaataccctttctccctaaactttcactctacagtagactttggtcctaaatgtctaaaacatagatatcgaattatctaaaatatataaatctttaatttcatttaggctgcataaataatgtgcaatttacaccatctcactgaagacaatagtttgatgacttcattgcacatgttctcaaagtatgatttcctgtatggacaatctgtacatactatgaagataccatccctgctctttgaaatgtttacaatctaggcacatcctggacctgactaaaaatagctggcacaagcccttgttgaaaccgaagtacccatgaagttaacacttgctctttcggctgaatgcctgttatgccaggggcttttggttgatcccagtaggctatgtgcccaatgcaggacttgtcagaggccatgcagctgttgaaagtactttctgctttccgtagagttagatgaagacctacagcagcctgaggcctgaaagattatggcatcccacttatctatgtaattcaaagcaagaacaatactaaaccataaaatttttttgttttggtacccctgcttattgatactcttaagaaaagtatacacatgcatacgcacacacgcaaacacacacagaagttggagaaagaaaaatgtaatatttcacattttatgaaaagcaccaatacgatcatcacaggaaaaaagtcaggacaaaaatggtggtctttatgacatcaggcagagaaatcaggctctctctctgtaatcattagggctcttcagagaaacataactaatagaatgtgttgtgttgaggggattggtgtctgtttttaaggaattggcttgtgcgattgcagagactggcaagtccaaaatctgcagggtgggctggtaggctggagacttagggaagtctccagtccaaagactgtcaggaggctacatgtcccagatcaaggtgttggcacagttggtttcttctgagtcctttctttggcttgtaaatgcccatcttctccttgtgttttcacatggtcttcccctctgcatgtgtctgtgtcctaatctcttctgataaagacactagtcatattggattagggccctccttaattacctaattttaacttatttacctcttaaaagaccctatcttcaaacacagtcacattctgagatactgtgagctagggctttgacatgtagatttttgggggacacaatttagcccatcacactctccttttccacaacacttctgtttcctttgaggaaagaacgagcattgttatacaggaatgcccattaatctccttgtgttttctttgttatgttttatcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaacaacttctagaacttattttagcttccatgtgtgacagagcatttgacccttggctgggattggagtgacaagtgctaccgtatttctagcatttgaggtaagccaagatgctccaactgctgaagatttgaaaccaagtcaacacactgtgtcatatttcaagtaattccattggttcagcgctcctcaaacttttcccctaaactagtctgaagggcagagggagaataaatccattccactacggggtctgaagcacaggctgaattgctggctaaaagtgcaacatttctttgaagtcttgtgttttatctttagaatccacaagaaatgtattttctatcttataatatcttcatgtttgttttcatataaatatttaaaattatttacactaagtaacacaagaacatgagtcatgtccctaagagtagcatagtctattttgattattgttattacacaaatggagctagtctttaatcaactacagttctaaaaggaggaaaatagaaaatgcaaacttatatgtttataaaagacatataaaatagatgtttcttaaacgtgttgcctgaacaccccatgttagacagaacaaatttgctatttgtgctgaggtaaccatggagaaagggaatgttgttaaacctcatcttacatagccgccttcatgaaggcatttcttgccaagaatttgacctgtcattgaggcattgactacatcacattatagttcttaacctttggctgcattcaaagaaagtcaattatcccaggggtgatttttcaaaatactgaggctgggtccttctcagaccaattaaataaaaatcccaggggatagagcccaagtatctatctttttaaaatatcttctagatgattacactgtgtagccagaattgagaatcactgataccaacccttgcttctcaaaatttgatgtgattgtgaattactgggaagtctcatttaaacgcagattctaattccattctaattctgattcagtctggggtggggcctgagagcctacattttggacaagctcctaagtgatgccagtgctgcccttccagactgctacccttggattaacatattagaatcacttggggggacccttagcaaaaccacgcaagcttgagccccattcctagccatttctaatttattcggccttgggtgaacctgaatgttattctttttttcgaagaagtccaggtgacactaatgtgcagccaggattaagaatcctcaaatagctaaagaaaaaatgttatattttgagaggttcctctccaaattgggaaatagcagcatatagtcctcaatgcgttgtccctaacttcagttagactacacatatggatgtgcaactgctaatgatttagtaggcagcatatgtactcacagacttgtggctctagggccctcagtagacggttagccgtctttcccctatttgcagaaaacctactgtttgtgtatgtgtttgagaaagtgtgtgtgtgtgtgtgtgtgtgtgtgtgtgtgtgttggggagagccacaacattcccttcagatgttggaccatctggcctttcacagaaatctgagtgatggtgccaacactgacaacaggtaccatttattgagtctaccgtatatgaagccctgttctgggcactttccataactcatgccatttagcagatttgggaactgaggatcagagacttcactaaacagatgtgagtggggaagccacaatgagaaaaggatcatcttaacctctatggggaactgagtacaaatcatgctttgttatagatctccaaaccattggattatgctttaggttttaccctcacattctttagtattctaaaatatcagcctgtttcgatcaaggtaacaattgcagtactctatgtcatttctttttgcctgttaatcctcactcctttctttctctaacttcctgtgactgaatctactgagagggcc

SEQ ID NO: 12182 - DNA, 92581 bp, Human
gtacattgcattcaaacccctttccccctattccaacttgctttataatgaaagtaagagccatactcaagagacttttattggcaattaagtatctaaggactttgcagattttcttctttattgtatggcaatcttaaatgtttaatgaatatttaagtaaacaaatttcagcaacatgccttttttaggaatttggctttaattaacatccaaacactgttaattattatggcaaaaacatcaatacgtcaaaaaaaagccttcaggccagggaatctttaagaaacaattatgtctactaatttcgattaaaggtatcctttattaaattcttaacaacccgtctctttctaaacgcagcgccttcacaactcttcttcccttccccctaccccgcttccctccctccgcaatggagcgcaatcaaaggccgtattattgcctaagcttggctctcaggccagctagggatgtgtgtgtgtgtgtgtgtgtgtgtgtgtgtgtgtgtgtgtggtggggcgggggtggggggcgagggtgcaaggggagaggttgtacgccgcttttccgaacccagctctaaatggtttctcctaagcgagacaaggattttccatagcctaaaagaggccatcaagttttaacattgcgaggcacgacttctaatcgcatccttcccggaaaagtacaaacagttcctcagacgaggtcccccacctcccacgcgctccccagccctccctccctgcggagagccccgcgacagcctccccaacacctgtgaatcatccgggaggctgccaccgccgagcgatccgcgcaccacccccttcccgggcccgggcacggccagggaggacagttagggttgttgctttataattatcacttttaatctctaatacgaccagcacaagtagcctttgtctccccgccctgatttgagcatccgagggccccccgaggcagcctgcacgggtaccccggggtttgcgcactgagtgaacccccagattcggccgtgtcccagccgtccttgctctgaatcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactccgcttcccttctccttcccccgactcctgcaacagctcagagagcctggctctgacgtagttcaaaataacgtgcgccagcctcgctgcccggctgaccacagcaacgagagccacaagccctcgacgctgcttcgataacatgaagcaatcactcataaaaatagcaacccacgtagcctggccatatatggagctggcgagggtggacggggatgcccctccggaccctcttcggagaaaacaaatcgccgctgaaatttcccccacccctcccatcactaccttttacccctcctctgccttcccctctccttagatgactcaaccacagattccactgaaagggggtgggggtgggggtgggggggaatatatacacatacacacaaattatacatatattatacatgtattataaaatatacacacacatacatatatacatacacacacatatacacatatgtacacacacacgcacacacaccaaagaacatcaggaatgcagttgcgggatgaacgcgtttgcccaagaccgagtgttaaaatggagtcataagagtcgccccgtgcgggtgtttatagaaggtgaaaacacgcaggtttgcaggccagcgcactgggaaccgagtcaagcgcgccgcagcccgggccccgcccccgcccccgccgtgccccgcccccacttcctcccgcccctcgctgggcggctattaaaagctgctgacgtcaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtaagaacccccctccccaggtcgtggctctggctcgggatggctgcatacccagaagggacagcagctgggcagtccgagtgggcttgggtaaatacaagtattggtgcacttagggtgcggtattccgtgtgtgcacgtctggtgggggctttataaagtgttttcgaggtgagctgctggggaaaagggaaacgggagccctgcaaatggagcgacggggaggaagagcgagggtacgtaccgaataataacttactcttttgaaacagtagtgggaccccctctttcttccattttgcgatgcagttttcagagatatttaggctgttgagttttcctcccctgtcgttctaaccctattattatgactgttgtcgttagggtgctattatccagggaagaattaagggggagacagggtgtgggtgctggggaggcgaaaggagaaagggggagttcccgccccgggcaagctgagctgctgcagcgacagcagcctccatgccccgcggacttgatttatgccgcctgctccacgtcaactgcaggctggcgggaggcgggcgggtcgtgccgggtgggagggctctgcggagggctggcgcgggtgggctggcttcggggactgcggcggcccgcgctcagcaccctggatagcaacaccgagggctcgcgcgggcgccctcgacctttcagcaccggggacagcggtccggccgcagcgcctcatctgcctgcggcagaaatgcctggccggggctggatgtgccagggctggagaccaaattgtctccctgagaccccggtcttacggagacccttaatagaggagtcatagtagcttaaaagaaaacaagaaagaaataaatcttcctcacagagactcctttgcagacaatttcctgttcccctcctcacctcctgcatagcttcaacaaaatagtctacttgtggaaatcttctgtgttgccctctgacccttattttacgtagaaaataaatacattttttaaaaaatatggatttatcctccagcagggtatcaaggtttttgtttggttttgttttttaacacagagtagatctgtctacagatcttgggtgagcataagtactgtatatatgaagaagccaatgctatctgtttatagggatgatacatctctctctatgtttccatttgataaaaatgtgagattagctgaactaagcagaatcaactttaagaatgaatcactcttccttttccttcttcccccatccttgcaatcaggcatgaatacaagcattcatccacaaaaacacatatctgagaaattttactggtcctgtactgaatagatttaacctctttggccacggtttcagagttactggaagtatttgctatcagcactggttatcgcaggctgatagctttagattttgacaatattaagactggccttcctcaggagaatccaagtgtgtccttcagggtaatgcaggtaaagaaccatggtgttaaactagaacttaactctgacctaaaggtctactgcaatttctcttatggcactgcgggattttgctgaggtggtaataactactttaaccattttctactctgaggcttggagcatctgagagagcaaaagtcatcaggggtatttctctctgtttgatgtagataaaactggcataaaaatgaccagagtcaaaattatgccatttgagtcattagcaaaaaagagtaacagcgtcatatgtaataatctatacaatgcattaaagaaacgctatcatgatccccttaaaagaccccaaatgagaacttggattgtgtttagatagtcatacctcctatcatctgtatgctacagacactaaaattccctgtccatatacagaaggtaatttcattcgctgctatttaattatttcctagtgttttttctttttatagatgaccatgtgtttccatgtatgtatatgttgatctgttattttgcatggatgtaaaattatttgggtggacatttatatatgagtatgtaaacgtataaaagaagtttataactttgcaatctgcagacaaaaataaacaactgtgttttagtagtggaggagagaaaatatgggcaggaatctttaaaaatgctttaacttcatgctgcatgtccagacagctgtctgcgtagttgcgtcaaatgaaaagcctaatgctgccggaattacgtgcttggacattagtaattactgctgggtttgtttgctagtggaagactggggaggagcgggggaagtagaggaccgcagtgaagatggcaaagggcacagagctgagaggaagaagcaatgtgcacaattagaaagctaattttagaatagcttactgagaaatttaaaaaatatatcattgaaccatgaatttaacatttatatcattgacaagcttccagggaaaaaaaatcgagaaatttcccattttaagttagaatttttaaaatccagggcaatgcggtgagaagaggcaggagcagatggacataggatgagccaggagtcattcacacagaccctctgatgcctgtttgttcatcggcatttactgcattaccacctcagtgttcaaattacagaacaatttacaatcctcttaacctcttcatggcaaaatctcccaagaattcacaattttatttttactttgttaaacacgcacaaccacacatgcacaaacacaatgcaaactacccgttaattagcttgtctaaagatattcccaagctctaaatgttaacccttgagtgagggttatcagctgaaagacatgtttctgccagtgacacctagaagctgcgtaagcagtcagccttcagcataacacgtaggttttgacgattagtagaaacgagaaaaataatctgagaaagaggttgagagaggagacatgaaggagaaaaatagaaaatatgctttttagataattcactatgaataaacaatgtttctcacattatgggactgctttacaattctataaaagaaggaaaaatctgtgttttaagcctcagcgctggatactttctgcaatgtcatcccttgtcagcaagtaccaacctgataggaagatactgatcaatcggtattcaccggatacagaaatgaatcccatgggagttataaaatttcatggttttgtcttgacctcaataagtttagcatctagcaatcttaataaaagcaataaacaataagttaataaataaaaccagaattaaatgcaataaaacattagaagacaaattttgaggacatatgtgattaatttccaagtgaatgtaaccaacaataagtaacataaaatcaggagggcgatatcgcagtggactggaacaatctgagagaagaggcaggccttgagatggcttttggaggttgcagagaggtgggagagttctgttaagctgaagtcacaacatatgcagaatatcaagttaggcaagcccactctacagttggcaaaccctgaaaatgcccattgatttgggtggagtgggaagcttggagggaataggctgggatgcagagttggagccttctgtggaaggctttgaatgtcaagctgagaatttggtactttatcctctaaagttgatttctgagcagaagctgatataacaaagtaaccaggtctttttaatatccagaaattactattgacagagtggatttaatttgcattcttccagaagtagaggggagcaaattggtatcataagagatggttaatgaaaaaaaatcagtccttactgaagcatcttttaagactacttttcaggatacatatacctacatagacatataattcctgcttggaagttaattgcaagtttccattttccattattgactaaatgaaattatgcaagttgagcacttgccaggcagactgaaaagaaagtcaagaatctggtgatgagacaccccagaaggtcccagaaggtgcacttgaataataaacatggtgctgaacactctcttgccctctgtgaatattcagcattgtcaagtgcactgacgggaggaatgaaaaaagttgtcatttcttctgagcatgttttgagcagcatgacatataggaccagccccaagtggctaaaaatgggaggaaaaagatggaatggtagaattttgaaaaactggaatgggtagtatatcagatttctttccctgcctattttgctgactcttgctagttaccctcacttcagggctacctcgaggtctggattacacccatttcctttctaaccttgtggttactactctcacagaagagcttcaaaaatccaaatgctgacagaattgctaagccaaaatagtcagtgggttcatgtagaggaagaaatggcaacggtagatacagattttactgccatttcatttctggctataaggtatcaagagactatcctcatctattcttcactaaaacactggcagtagagacaccacaggataacatttttatatccaagctgactacctaggggaaacttagaggtagtgacatttgatgctttaggaggtcaggttggtggttattaaactgagtccaggggctacacaagcatcaagtaaggtgaaggaaggagatatgacatagcactgaggaagtaggacatgatgaggggacaaaaagttaaaaaaaaaagtcttacaagaggaaaaagacttcatagaaatttctagagaaccccagctacactgtgaactcctcagaattgctattattgccttaacaataatacctactctttctacataattttcttcacaagactctcaagcacttcacccaatatgaaagtccaaggaatttctgatttctaaataaatagtgcaacccacagacacatatgttcagatatagtattagatcacatttagtaagacataaattgatttagaatgacagagatacccaaatcagtgattaatcagaatgggcttatggggaagaatgtgacactcattctaaaagtgtttacctatactggctcactgtatcctcctaacaaccttgtggtcagattactattattatttccatttcgcagatgaaataactgatgcacagcaagggtaagtaacttgtcgcagagcagagccaagacttaaatgtaatcagtctgactccagagattaagctatgaagtgtattttatgctacctcttgcatcatccatatttttcatattggccaaataaggcatagagaatgtacatgtctttttttttttttttttttttttttttttttttttgcagtcttttcctcctcacttgggtagcaaggcctgaaggtaaggatgctggtcagagccaggagacccagctctagccctgaaacaactgcttgtaatttcctgtttggaattacacagtctttaaattagtcagtgcaccactgttgaacttggtttctttactggcagaatgatagaagtggactaatgatgtccaatatccctaccattcaaaaatcaatgaaatcagtgctgaaaaccccaggcaatgggtcctggcctagtgaccgatggcctcagctggcatcatcttaataatgcttcagtaactgatctggacccaattggaagattaattacattcatcgcctccctcatcccaatccttattttttcccccctcagaattgcttgccttcatctttctgaagccttctcagagttaagaaatcctgtcttcttcctcaaagccctattctgagtcatcactgctttgggtatctcctgtccttctcaatcagatttgtagctatctagcacatactgtctcctacaacctgcctaaactttgtataaatttctttctagacctcttcttgatcatctcgtgtgtctgacttagcaatgtattagctgcagttccctcactcatcctcttacttcttctgccgcttagcaaagaggaaacagaagcttttatagaatctgtgagctgtaaagtactttaaaagtaacattcctgtgtgacctgaatctcatgatactgatagccagctcaaaaactaatcacattgggaggatgtggggtaaaatgacatcacaggaaagctttaaaaacataggacaaggagagaaggaagctttaaagcctatgaggtcagaggtcagcagttggtggtacaatgttgattaattaaattcatagtcacacatcaaataaattcacatgtcccggaggggaaaaaaaaaaaaacacattcgccttgtcacaacctactgcagatttcaatgtctttccaccaaggtaaaacatggtatcacaagaggaaatcctaactgattttcttattgttgactacagaggtcaacctcagcagtgactgacttactggtaagaacaaatctgtatccctaaaaagagatggggggaaatcctatttaaggattagcatttccttctaaatgcttaacaatgattccagagaaattcagtcaaatgatgcctgctcccgaatgatgctgaataacagctgtactgggcttatggcttgctttctttggttgtggaaaaatatatttcatcctcttctttgctgttgttgatatggttcatattactcaaagatgtctaattctcatgtcttaaattgagactgttggcactttctgctgactcattgtgtcttaatcttccaaggtggtccatttttacttaaagaaaaaggttattttcctccaaagtggcaggttctacaaaatgaccatctggtcccagcttccccatcacttcctttattcaaatgacactagtcacagatcttgaacttgagagatgactttccatgcctgtaaccttgaatcagtggtttctgtcctttactgataacagcaagtaaaaaaatgaaagtctcttaggtgcccccctgaggccagagttcagccctacactcctgcctcattcctttttcagagaattttctcagttgagctctgaaaatcctgcaagttggacagagttccctttccatgaagagtctcagaccaagttgttaatctcctttatttatgttcatctttggtacagtttcaaagaataataactggcaaattccaaaacagtgaatttcttaaatttccctgcagttattccgaagttggtctggcagctaggtataggtaaatcacactgtgacttctctatcaataaacagaaaatgcacagaaataaatgccagaaagactgctaggaagaacactggcaaactatttcaatacgcattagccttgttgagtgaattttttattttaatgggaaagtccattcctaatttatgccagagaaattgctgaatgtatctactttttccaattccatgatcactgcccatgtattgcttcatcataaatcagctgctattatggcattcttcattaattaatccattgaacaaatatttattgaacacctgccatgtaccaggaaaacatacactggttcctaaagtcagagctgtaaataaaatcatcatgtttctgccctccatgtgttatgctaggtgtcccctcttgaggtgtcattattttaaaaggcatgtttcaatgggatgccttttagaatctaagacattaattcaatgtagaaaagagctatggctctctaatcaaaatatacaatctattgaaggtttctactgagctgtcagtatctacagagagattgctatatcataaacaaatacatattaagaaccagcctcagccatcaccgaactcagtaaatatctaaggtatgtctttgtgtgaacttgtctctatttacatggcaatcaactaggatgtcactaaaatgtcccttaaatacatgactatattccagtatcccaatctgttgggatctctccctgtagagaccactttctgccgctcatgggaggaaggggtcaagctttaagaaacatggtacctcctgggccagaaatcctattcccaactccaaaactcatggagcaatgcaagaataggttgactaagaaaggatcctttggatgagagtacttcccaatccaatccactttcctcctctgaaaacttcctgtcattaaacaaagttcagtgattcgggatcaagtagaattatgtagtgattctggatcaagtagaattatgtcttaatttcccaaactcctacttctagaaattcacctcttaccaatgagcaatgcccctatctcccttgtaagattgatcacactgctttgtagttacctacttatgtatttctctttcttaatagactttggaagtctttgagagcaagggtaatatcttagctttctttgaatcttcagtacctataacagtgcctgccacacccatgtatgcaggaaataagtgagcgaatggggataccagctacccctttgcagagaaaagaattctaccactgtaagtaatcctgctttttattgatcaaatgttatgatcagaataactcaggaattgttgtgtacccttgcacatagattcatcctaaatattggaataaaattatgtcccaaggaattacttaggtttaccctaactagctgccaaactatggcaaatggtataatattctaatctgttgttttatcacttatgagtcaggagttaaaatgctaacgaaggatcaaaggattctcaataaaggcattgctaaaatcaggtttatattcagagattaaaagccattcactaagagcatttaaagtcaagcagtttagcatatatgaattataagtttaaatgttttactgttcactaggatgaaaaggatatttcatacatccatttgagacatatattacattcaccagtggggtagatttatggctttggccaacttgtgttttcagggtcacatatttgctgctgtgctattagaattggcatggtggacacaagtttttcatgtcaattccgcttccttaaaagtgtccttcagagacaccagtctctgggcttttcctctcaaatagtcagtgtcctcttgcctgggagagaatcataagcctgggcatgatttggtaaataagtcccatttgtccttagaaaaaaaccttcaccaattgagcattgaattttgcatatcttttttccccattccttctcatgaaaacacgggttactctgcatccaactttctccagagaagactgaagatactaccacttaatgaccacaaggaaaaaagtaactaacttcctaaatgtctactgtgtgctgcactgggcacttgatgtatgttgtttcctttattttccatggcagccttaaaagagttcggaacacttgtctctgactgcaaagtccatggttttccccaccaccccataaattatcccatgagttgcacaaaatacattgagatcctctaacagaaagcacactgctgatacatagaacgtgagtcagccaaatctaaaaagctgagtcctccaagctaaatagccaggtgagatatggtggtgtaagtgaccagagaaactatgtgtccaaacaagttcatggagcaatgggtggagagtcagctggctgcatgccagctctgccacttcaattgtataaccctgaacaatttacctaatctgaactgagcctcacttttatttacatctgtaaaaggagagcaattgctgccatgcatatatgtcaagtggttgtcgtgagacctaaaggagctaatgcttgtgaagtagttacctccaccactctgagaaagaggaagggactgttgttatgttcagttacctgctatttgccataccagatttccagggttctttattataggttacatgaaggccatatgcttcttttcctctttattgttgtgtttgcttaaaaacaagtcttggtatcacatattttttagcttgatcagcatgcataataaaatggggaaatatgtcaacagcctttgatttttctatttggggaaagatttttaaatgcctttgattagcatctctgctttgggaatgacctcatgtttctcagggtaatgtttagatacctgaagaggcccagttgttatttaaacactggtcccctcttccttaacatcttgtattttaaagatgcttgaggagttaaaagagatgatatgcaatatgtcctgctattctttagcttttgaaaaagaaattttctgtaagctatttagtgaaccattactgaagctacatctgttggcttcattttatattcagctttgtgttaaggatttttgttgggggcggggataggtttcttattaaatattgtgtgtgcacatgtgtttttgtatgtgcacacaatacacaagcagagagatgcaaacccagactctttcttggagccagccttgaatacaaaattcctacatgcatcatctcattgtcaaaacctttagttttattcataaaccaataaatataaaacctgcacaagcaagttacaagaatagcagaatctgtgctcctaagctgcattcacagaatgatttttctttaaggttggaaaaggcttccaaaacaaccctatataaagcaatgacttcaaattctgctttggggagaaactctacagacaggagagcttgctggggaaagattttgaaagtcacactattttttgagcatctactatgtggtagatattatgttaggctatcgttgcttgttttgtatttattttctacagcaaccttctgagtggcaggttatacttcacacttgactaagagacaatactgtttaatcaaggtcttgcaatggattctaaggtactgatcacaactcttcccccgacaaacaagttcatacataaacaggggttagtaattaaaatactaggcattttgttaagcagaatttgggggaaaaaagaagaagaaaagaaaagattacaaccagcaaccagagtcagattatcagatttccttactcctttctagttctactccaagattagacattgggacctaccaaaggagaaagggctgcagaaatgtgtgtagtcagacaggatagctagagaaccaaaggcccttctctccttttcccacccatacccccaagtgacagaacctgcttccagaaacttgcaatctgggggagcagaaaatgcaagcttgctataggcaggcagatcccagagaaaaagccaaggaggagaactgagttatacttgctcactgcttatttcccatctcacagaatactttagttgggggtgggagggacaagtaaaggaaggggtggagggaatatcatcccaacactcatcttcccaaagaacggagagtcccattttgtgggacaaagtaggaattgatgagtctttgagagggggaaaatggttccttcttctacacagttaataagagagagaacttgagtttgaatttaagatctcaagtgcaatgaccttctacaatcaatgattcattactctaggacacttgttctcaaactatggtgtttagcagcatcagcatcacccaggattttgtttgaaatgcaattcccaggccccacacagacctactgaatctgaaactctagggcgagacccagtaacctctgttttaatcatctccaggtgattctgatgcatgctcaagtttgagaaccactgccctagagatctttgttgttccttcaaaccttcacatctgtctcaaactgagcctgttgaggatgaggtgttttcactgttctcaacctttcaaaagttgtgactgggtacttagcaagagaagagctgtcctggaccattggatagaaatctccatttaccctctgatttagtaatgaagatgctatttttcttccaagtgagtttgaaggatgaggaaggtgagcattcacagagtgaggacaagtgtgtgggatgggggccaactggctcctttattgtgctttgttttcttcaacagtggcccaatcccagcccccagaatcttgtctccaaagcttaaaatctcatcaaataataggacatctcctttcctctttctgcagtcccagcccatagcctctgaaggataccaaataggaaaaagtgtccccagtgcaaaggataaaggagtttctatcactcctcctctgtgtcaccccccacacttcctgcccccatccctcagcaatgagctaccacagaggcagagagtcatcctggccttttctactcatcccctgcaatgtcttgtttctgccctggattaaaataccaattgcccttgggaaaaggatcctgatgtcttacattgccctttttttcctgtcctcctcttgcttagaatcatgggttcagagcacttgctgagatttttaaattgtattttcaaaaacattgcagatgaccaggcccagagataaatttcacaccaaggtcacagggtgagcactgcagccaaggctcctgactcaagcttcagctcttcttccactgccctttactgccttaccacatctgcctccatctcttccaaattttctctctggtgcaggtccaatctcctggagtttccagatccccaatcaggaactctctcagtctgttgttacactcagaggtcttggcctcaagtggtgtcccaaactctacaaaacagggtaggaacattctcataaccctgagctatcaggcagagcttcctccaaaatttggatgtacagattgtacccaaacccaaaatgtttcacaatctgaaactttttgagcaccaatatgaccctcaaaggaaatgcctattagagcatttcagatttcagattttcagatttgggatgctcaactggtaaacataatgcaaatattacaaaatctaaaaatatctgaaatggaaaacacctctggtctcaagtattttggataagggatactcaacctatactgcttacatctctttggatttttcatattatagaaacccagctataagtggttttggcaacaattgagatttattggcttaaacaatctaagcaaatgttgagcagtcaagccataggaaaagcagagacgtagctggaattcaggaacaactcaatcccagtgtgcaaacattaccaaagctctctctttctcagcctcctgtccctgattctttctgtacattgattccactttctcttgttgaaaaacacttcctccctccccataccagaaacatacacatgcgatttgtactctctggacttccactatggaaaaggaactgacaattgttgtctgtatcctcgattcaaaaataccaaggaagatctctgattggcatagcttgggccaagtgctcaatcaattgtgggtgtggagtggcatggaggaatgtgatttccatgctggaaccacacagttcagttgggaagaaccagttgcaaagcagacacagtaagccatctttccttattttctccaaaaggttgggttgaatagcaaaccacaggtaaaatctctgctgctttggaagaataaactactcacctctgagaacattaaggagacttcacagaagtgaggaaggatgtttctttcacctttctgtgctcacactagcctggttctgcaggatattccctccacgttacaattcattcgccaaatatagattgtgcctccaccatagactaggcacagttctaagcaatggtaataagcagagaacaaagtagatgaagtcctgttctcatagagcttaccttctagtagagaaagacaatgctatgagttaaagaatgcaggatagagacatagagtgatataccccaaggaggtaaaatgatgatttagaaagagctatgagagaatgcatctctgagaggcagcatttaagcagagaccaaatcatctgtgggctcaatgatttttatgcccccttcccgcaataacatcagcagaactccagcacttgatccctttatttttcaacaataaaaataaacttaaccttgatctgaatcatatagatctgctttcccatcattttctcatttgtctccccaatttcatgaccaggcacacttacagctcaaggatacagtgagagaaaagaacttcataaaatccaaacagtccacagtggctgaaaataagggataactggtcctctggttcacgtctttcctcctctggctcattttgcctcctatcatgaccatattatgtgcacagatatatggatgagctggggcacctatggcctgtgtgggctaaagggctcaaagattagagccaaaccaaagattctgtcacaggatattaaactgggtggtgaattcccattaagcctaagattccttccagacctgcttaggccacatcccatgtaagctttatgaaaatatatgcaacccagagggaaaagatatgaatgtgattccttgacccagccaaccgtaacatttatccttgtcacaaattttcttggacacagtgaaggaagggaaagggagaatctccttcctctgcatttactaaccaaaacccatcgttccatcaatcacaaaaaaggcccagtgtaaagctgagttgtctctggtccattgagaaggtaagcattaagggatggcatctaattggataatgggatgcaggaaggcatacagacccgagaactagaccctcttctgcttctctctcaaggtggaagaactgggccaaatatgctgttaggctgcaagattgtgcctctggaccagcaaatttagtttcaagatcacgttctccctcgacttgttctattcccttcttgtcctagtatctcaggcgtctggttttccttcctttttatttctttaagcttgttttcaactttgtttgcctgcgtgtagctttttgtgtattattgaattggaaattagtcctccaccttagggcttgagactcatatgggtggctcttttatgtgctttttcctcccaactctattaacaattttggcccaatggatcacagttggcttctcagtgaagcaggcgaagttcccttaatcatttctgaagttctccttttggatatgacaggctggtaacttaaaagaaccatgtcctacatagatagacttaagttttttcaggtcacttaccaagcaattgcgttgatttattctgcgtctgtttaatgatccttgtttcttttttctcaaattgtttccccactattatttaattttttttttgaacttcatcacagttctggaaaggaagatgatacagaaaccacagccattttgcagatatgaaaactgggacatagaaatttgactgccctggaaaagatcacctacttatttgatgacagagccagttcagggatgaaggttagccagatgtccagttccccaatcttgttcttaatccataaatggaacactagtgctctataggcttaatactacccacaaatttattttatttggctagtactggatttacaaaatcgttaatctgaaatgccttaaggcagggtacttcctctccaatttgccgcaaagcctaccattacttatgcccaaggcataattttcattattctcccagccctataggcatttgagattgcttccattgcttacaaaagttgtgcaatttgtcatggttttatgatctgccagaatcagaaatggctagaagtttcttgggttattttaccacaactctttcctatgaatgtcttcttgagttatgtcagtatttggggaaacacgattagacatataaattgcactaaatagactatggcttttgatctgagttgaattcaagcagtctcagatttttgttcttcccatggatcccactggcagtatggtgaagatatactgaagccactttcagagtgatactttttaatgtgtaaaataaaataacataaaataaaataaaataaatagggattagctgggcatggtgatgtgcacctgtatcccagctatttgagaggccaaggcagaaggatcacttgagcccaagaattcaagggttcagcggccttgaactggaccatgccactgcattccagcctgggcaacatagtgagaccctgtctctgcagaaataaagtaaattagttgggcatggtggcatgcaccagcagtcccagccactcaggggactaatgtaggagaattgcttgagcccacgagtttgaggttgcggtgagctacgatcatgtcactgcactccagcctgggcaacagagcaagacctcatctctaaaacataaaaattaaaaaataaaaataaatacatggggactatataggaaaccaattttattgaagtacaactattaaaatatttttagaaaaaccacatttgtggtataatatgtgttttttaattaaagcattaaataacaatatttagtggtaagtctaataactaccataatttcaaagtggtaatgagaatatctgctattttgagatatctgcaacaactgtaaaatgatatgaagacgtcagtgtcgagctctcctgaatccctgtgggtggtgggatggaagaaaactagtcaagtagagggaggagtggatccacatgtcatccaggtccagtgaaactggctggccctgaagcagttatttttcttgtataacaaaccaccccaaaactcagtggtttaaaacagcaaccatttcttattgtgtatgtgtctatgggctaatgagttagttcttcagtcaattggtagattggctggagcctgcttggtgtgttcactcccatgtctagtggttattgctggctcttggctagggcatcaggggctggaccacatgtctctcatccaacaggctagccctagtgttggcatacagacatggtgggagttacagagtttctcaaaacagcaagagagaacaagccccaatgtgcaagtaccttccaagtctttgttgaggctacatttgctattatctcattaaccaaagtaagtcacatggccaagcacagagtcagtgtggaagggggattatggattttgggaggggaattatgccaactatatttacaaaaaatcaaccatagttcccaccaatcttgggagcataggtcagagagagccccacctctgccatagatagatggcctctgcccatccatcctgtggctacacatcttccactaagttccacaaaccaggaaacttagacctggcttattagtaccctgtccccatagaccttggagccctcaagtttaactttggatatccttggttcaagagggcacctgaatatctagttgcatctctccaaggtaactaaggaatcatagacccaggtatctgatcaattcagcagggaagtcaaaggggaaattttctcctttgaacattgaggataagtaaacttttctggattcaaactggcagggtggagcagaaggggatcagcatcttattgttttatggtaatgttgctttatctgtaatttcacttgagcctgtcttggtaaagacgattgcattttaagttttttccctgtctctccagaagtgccctctgtttaagcaaattctaccttctcatctaattacaagagctacccataatgttaaaaacaattctctgccagtcctctgcccaatgagcactttggtaatgggaacacaagggaggaggcaatggaaaaaaactctgaaggcctttcagctgtgttgccgcgtcatggaaaacaagccaagcaactgcgtggaagcctcgcagcaggtcccaccagagccttcttagcgattccagggattagcagggcacggctgactcacccagctgcctagccaggcacttccatagggcattctgatacctggctgtacatttgctcgactcacttcagatatcaaatagaagacccctaaagatgaggccctgggcagaactgtctgtgtcagttcctgcaccagcttcagtttactgagcctccaaaggaaaatacataaataaataaataaataaataaataaataaataaaggcttctaaattctttggttggaatgctgtcctaggttgagccctcccaaaagcagatccttagtgaaggacgagggtgcacatattttatttgggtggtgatcctaggaagcgctgatgggggagtggagaatctagacagggattcaaagaaagtcagtacagggggcactcatgagcagtttgccagctgctggggctcagcccagccagggacctctctcagagagagtgtacaacatgcctggattgcctgacctgaaaggcaaggaagctggagtattatgcaccaactcccatccttcagtggctaagggctgttcccagagtgtaaacttgcacccagccctgcaggagacaaattctacacctcagattggagaaaatcctaaggcaatgagtcttgcctcactcacagtagaggcactagcagaagaggccttcagaatacacagaaaaggcgagtgccaagggtatatggtgggcaccaactggctgctagaattttgcgaactgttatcaccagacaccccaagtatcacaatggctgtctccagctttggcacattgatagctcggaccttcatttattcactgggtccctagtgggtaccattcattcaatatctgtgtgccaggtactgagataaagttttttcatacatcatcacatccagttctcaggacaacatgcagggtattattagcttcattttatagctgagaaaaccgaggtacaatgaggttaagtaaattatcttaagtccctcagcttaaaaataacaaagctgagattcccatccagagccactttaaagcccaagctctatccacagcaagcttcaccccaattaggtgaggagtattttctcctgctgagaaaaggcccagccatgtccagcccccataccaccatttctcctgaatccttctcttcctttctggtctttcctgttcctttatctcttgttttcaggttggctccatggaattaactgatgtcccttcagtgttctagatcctttcttgggtaagtgggctatccctcttatcctccagacctccttaccctaggggctgggatcactgtctgcatactcaagacatctttgaatctccaagtccttaaacactctccaactcatacccacccacccatgatctggtctcgttccacccacacatggcaggtgctttggtggattctactgattctggcattctagtggggaaggaatcatggaaccatttctttgtagcatcttgcaggtttaggactgatcttactggtgggtcccaagcaaattgaactgcttgatttgtacataagcatcaggccacagtgtaagccctgatttactgtggttaatattttaaaactaagatagcatgcagcaaggactaagagagggaataattaattctagcctggcagcgagggagtgggagggaggtggcagctcctgcagtctcaggggggctccacagtaataaacaaaactgtagcttccaggtggcaaaaaatataaggggaatggatgggtgcagaaggatgctgtgcaactctattttagagtcaacatatccaacttcatgaggatcatactattatttcaaaaagaatatcaataggttgggcgtggtggctcatgcctgtaatcccagcaccttgagaggccgaggcaggtggatcacatgaggtcaggagttcaagaccagcctggccagcatagtgaaactccgtctctactaaaaataaaaaattaggcatggtggcaggcatctgtaatctcagctactcaggaggctgaggcaggagaatcacttgaacctgggaggcagaggttgcggtgagccgagatcatagcactgcactccagcctgggcgacagagcaagactccgtttcaaataataataataataataataatatcaataaagcatcaatgctggcaccatctctggtggggactcagaagccactatcagtgagtagcagattctctccatccaacacaggccaaaaacaaaaaataaagttagaccacaacataatgtgacagaggttgttgatggaaaatgccctggtatagattagggagcattaattttatacactggttccaaatggagcatttaaatgacaaaatctaaagtgttttatagagaaggaagagtagggggcctcgagtcattcaaacctcattttaaatcccatcttagattccaactccaggttcttttgaaccactgagtgtgccgtgccacctctgtggctgtagacaatagtcgaatttcatgcacacatatatgaaattcacataggtgatatttcaggtaatgtaagtgctctgaagacaaataaagtaggaggaacagagagaacgaaggagatactatatttggacagagtgggcattcatctaagaattttggctttggaacacaattgaattctttcttggcccaagcctgtagatctttttaaactacaaagtagacttcatttggtggctgcaggcaggtgtacaagcaggggagaattatttcaaaaagtcattacaaatttcacatgctcccatgcactaactgagcgctctatgcatatgaagtcatttgctattcactctgccaaatgcagtaggtaatctcaacatttccacttacaaatggggaaactgaggttctaagaagttacaaggaatatgcccagaatatggaatatgaccatgctagtcagtggggtggccatccctggaacctgcatgaccttggggcaacgcttctgtgctactccacaatgtcccatgagccctccctaagtagaggagcagaggaggacaagacagagtagaagccccctgactttggggaggcagcagcaagaacctacaggggcctttctggaacccgggtgtattcattagctattgctctgtaacaatattactgcaaccccagtgacttaaagcaacacacatttcttatctcgcagtttttgggaatcacaagtctgggcccagcatggcagggctctctccttagggtctcccaaggctgctgtgcaggggtcagctagggcacattttcatctgcagctttctccacttccaagctcattcaggttgtttgtagagttcacttccttgcatcaccctgagggccctgtttcctggctggctgtcatccaggaatcatgctcagtcccttaccacgtgaccctcttggggcaactcacaacatgacagctgacttcaagcccagcagaagaatctctctcttcaggaagggccggtccttcttttaagggccttcatctgattaaatcaggcccaacccaggcaatctccttttttacttatctcaaaatcaagtgattgggagccttaattatacacgcaggatccatttacgtttccctaatatcatagctaatcacagaatggcatcctgtcatgctcacaggtgccccccatgctcaagagaaggagatgataaagaacttgggcaccagggcacagaaatgctgggggtcatctcagcatggcaccctgcatgccaggaaagcgtgatcctgcttccttctgccattctccatgcctccctccaaggctgcaagtgttcctgccctacagagagccttggtccacatcacacagccagaggccttccaaacgaacatttcttagccgccaggcctcgttctgaactgggtaattgtgatgtttgcagacccatccacctgcctgagttggggcctacatgcattgttctgatcatgattgcctcaatctacaatcatccctccagaggaggctaggctcgcagagccctggaagagcaggcagggggctctggagcattcagtctttcagtgtttgccattagcgacctggggagtgatgcgaatggcttcaattgctccgtggagccagcaatcacagcaggctttgggggtccctgacatgagctggagaaaagcctctgtgaagcagctgccagggtaatggaaatgccctgctgccttgctgcgcttccatggagctgggcaagagtctagggctgcgtgccctgctcaagagaggcccagtgtgaactgcagggccgacatgggctttcctgatgaagctgttcttgcgccgaagagaactgcagaggccttggctgggaaggcaggaatcagtatgggagggcagggtgggtgcagtgggggaagtgagggcagcatctgtgttctgtgattcacaggcaacctagcagtgtctcctgagcctcagagtgcatggggtggctccgtaccccagctgctcatcaccctcatcatcttcatcatgcacagttgcagcccccgggtccatcaatatcccctcctccctctttctgccactccccatgtatttactgagcatctattacatgcctagtgctgctctgggcactgagtaaacaggggtgaacatgccaggcaatatttcctctcggggtgattaaattttaatgggaaggggcagacatcagtcagacagatggacaagaaaaatatcagatggggatggtggctaagtaagagattgaaatagggtgaggtggtcgagagagacgggtcagggaaggtctctccaaggaggagatgtttatgctgaggcctgatgacaagaacggccaatcatgagatggtgtgatcaggtgttgcagacagttcatgccaagcctgaggcaggggcaaggtgggtgctttcaagacacagcaataggctgatgctgttggagagaagcgcagaggaaagtgaagtgttaggagggagccaggttagccagggcctgccagcctgcagaggagactggcttttgttcaaagagccctggggagcccttggaattgtaacacggagattgataccatctgatttatctttctacaagatactctggattggagtgtagcaaggaggtggctgcagctccagagtatgactatgggtgaagcaacctaacccagggaggcagcattccttactaggggatccctactggacagtaatggccagcgggtgcgcaccatgggagctgctggagaaccctaactgctgtctccacagtctccgcctggagcagaagagaagctgattctaagtctgttcctaaatgcagcagaatgtatacgcaagtgaggaaggattctcaagtgaaacctatgtaagaaagtgagggggaaagaatggggcgggagaaagaagcaagcaaggatgtggttgcagctggagactagcatcagctgatcccagaggagccctggagtgtggattgcatcacagttactgctgccttgacactcggagtgccaggctttggtagccctgaactggtcagtcattccagcacagagtggaggtgttagaaactcccagtaggggagggggttcctgtgtctcaagggcaaggctcaggagaagtcacagttataaactctaagccatgtgaagcctggcatctggggaacaggtgcacttgctagtggaaagtaacaggaatctgggcagagcacctccagcatctgttatagtggccacgactttactgagagaggagagggaggatgcctagactaagaaagtgtcctgctgcaagaaagcacaggacccacatttctaaaagcaaatgagctaacaggaggcctgttacaggaggaacctctcattgcctacagatgctctccaaatagtcagctcccagtatgcacttaaaatagggatcaatttatgggcattccattcatccagcttcccaggaataagttcattgcattctggaaggttatatctaaatatccatttagccagcataaaaggagattaggattaggtgcacttaatcagtacattagaatcttctaccaaaggtatctgatcctgtttctgagaataaatgcagaataaacatggcctattagcaaggagtggctcttcctgtcccctgctctgtgattgcagagaagaaaccagtagctaagaagtagggccgcctaacagctgcttctgtgatggccacagctttgcttaggggcactggctttaccgttcagctgtgtagctctttagaatgtagatcagtggtttccagaccttgcctgcacatcagaatgccctgggatcttctaaaaatccagaagcccaggtcgtatcctgaaccaactgaattacaatctctgggaatactttttaaataaactttttattttggaatatttttagagttacagaaaagttgcaagggtggtatacctctcacccaatttcccccattgttgaaacctaacattatcatgatacatcaattacaaccaagaaaccaacatgagtacattactattaatcgacctccagacttcacttggattccatcagcttttcaattagtgtttcttttttgttccaggaccaatctggggcaccacattgcatttaattgtcatgtctcccctgttttctttagtttgtgacagttcctcagtctttctttgttgttcatggccttgagagtcttcaggagcattgacagggatcctgtggaatgtcatccaatctgggtttgtctattgttcttgtaatggaacaagactagggttgttagactcgggttatgggtttttggaaagagtgaagctaaggtaaagtggcctactcatcatttcatgtcaggggatacagtagatccatatgacattactggtaatattacgctccgttatttggtgaaggtcatatttgccaggtctctccaatgtaaagttagtatttttccctttccctattctaatctttgactgagtctagctcactgtcaaagtatggcgtgtgtagaggtgggtggaaatcagtcagaaatctatgagacacatttttatggccaccaaactatcttcatctctttgccttagttcccaatcactgtttgcaaactttctcaaatgatctaggactttgcagacccctcagttccctgggattgagacagcacttcctgactgttaccttgggtaagttatttagttttgtctcagcctcaatttcctcctctgagaaatgggtattggtcaaatatctgtttctaggagttattgccatgactaagttagataatgcctataaggttttgactatggtgcaaacattcaacaaatgttcactatcaatcatgttaatagtcgtggtaataattgccttcattactctgaccttgtgtatctgatctctagggccacaataatgcacctcagtgacataaaccagtaagttagaacttacatttgggaaagagagacatattataaaactaaatccaccaggtttatttattataaagaaacacttagcacttactatatgcccagcactgttcaaatcatttttataaatattaacccattccatcttcataaaaagaattcaaggtaggaactattatcactgttttacccattaggaaactgaggcacagtgaggtgaggcagcttacctaaaggcacacagccagtgagtggcagagccaagatttgaatgtaggcagttcgacttcagagtctacacttgtaaccactacatgatgctatgtgggataaacaagaagtataaactgtgtgagactgtgtgaaaggtgactgggtctcatcaggagcaggaacccagtgagacataacatctgctaaatcttttttgtttctttctttctttctctctttttttttttttttgagatggagtcttgctctgtcacccaggctggagtacaatggcatggtcttggttccctgcaacctccacctcccaggttcaagcgattctcctgcctcagcctcatgagtagctgggattacaggcacgcgccaccaagcccaggtaatttttgtatttttagtagagacggggtttcaccgtcttggtcaggcttgtctcgaactcctgacctcaggtgatccacccacctcggcctcccaaagtgctgagattacaggcatgagccactgtggctggccatcatctattaaatcttaagcaagcatatgccagacaggagagaggggccagggttaggaaaagagagctgaggtgtttggaaagattgctaaggaacctcccagtctagtgtggcatcctctacaaaagccagctggtattaagcattctcccccaaagccaactaatattaaattttctttcagagaaatatctcattctctctctcactgtctatatcctgctctctcaatttctgaatgtgcccttgggaattcagacggtctttggttttagggaggttggagctggcagggtgtctctttcaataactggaactgatcgccggtataaaagaacctggaccactcaaagcacatcctcatgctgtgtcttccacagtcaacatcaatccaccctccttcgcttttaggtcaggagtttcgtaaggcaaaggaagtttctgattgggagaacttagattagccatcaaattatatttggggtaagtgaatgttcatttcaaactggggggtctaaaaaaagttttgtttctggggcagtgtgggtttcaaagtatcgcatttacagtttcaccccgggcgtgtgcccagatccaaagtcttgcatcagaattcaactacaaacttctgggcgacagaaatgctatcttcatcttatacacacacacacacacacatactgacaattcccacacaataagtgctcaacatgtgtcttaaatgaatctacaattagacttatgataaggtgccataacttgcttatttgtcactgcatctgtatttgaaatcccaagaacacatgtaaatcataagctttgtcctttcctttgtcccatcttgtcaccatataaaattatctttctacctccaaaattggcagggaggaaaagcatcttaattcacttcatgactgaaattttaaacatacctttaccgaagtctgagacttcaaagctgtgtgcccttcagcccaggtaactagtgagtgtcctcaagcattgacattatttaatggaattcattttatgcctgaatatgttgactccacttctgtctaaagtctgctgggaaaacttggaattccagtggcttcacggagagcatattgattctaagctgagtctgagctatttctgagccattatgtttcaaagacagggtctcacactgaattttcctggtttagagtaaaagagaagatggtgtgggtgtatgcgtgtgtgtgtgcacgtgcgtgcattcgtgtgcgagcgcatcctgcacacatctgtgcatgtatgtgaggtgaggggagaaggtggagagagagataaaagggggttggcctatttattgagagggaggggaattgcacttacaaggttctccttatcaatgaagacagaatgattggccgagcccaggaaattttgacgtttatctaaaacgtcttatggagaagaaagaaaagaggcaaaccaccctgacagtggcaggggaatgagtcctatggctacccaccatccccaggggctcatcagtaccccagccctcagccacaatgcacacacagcctcagtgaaaactacatgcttgctaaaaaactcactttgcagacaagtctcctaaacttcccaccaaattgccaccttttaatttcacagcccccttgaaatccagaaagaatagatgtgcccttcaagtggagagagaaggacagaagaggagaataaatatcactaatattcattctaaagatgtgttcaccagccgctgggtacaatattcctgttagggctcacatcgttgggcacaatatttgttgagcatttattgtgtccaggcactgtcctgcatgtagttgcaatttagcataaaggttaacagcctgagacctaggggaaagttatttaactttcctgtttctccattcttcatgtgtagaaaaggggtgatgatcataacattgttatgagcactgacacacataaagaagttagacactgcttgacatgatgtgagtgattcacagatgtcaactatggtgtttctaagcatgaagatggcctcatgcgtccagttaagatccatgtgacccaaaagttagaaaagaactggcaatttctcgatggcaaatgcaaacatcttttttacttcttaaaggatttgggaagctgcagagagcaccctagttcttcccagaaggctgcccctgagctcttatactgatgaccaacaacagagtggtcaagtggtgccaccaacaaccacttgttctgatcagtgatgacatttagggccggccctgtagcaaacttttttctggctcctgaaatgaaatgagatgacgagattttatttcaccagtgacattcttcctgtcctagcccacaacttcagtattcccttttagaccaacacaggcattaaactggaaatacatttcagctttgatagaggaaaaggctaagaatagaatcattggttgttcctgagatgccatgtgaaaaatttagattaagtcaggcttccttttttcctcttggcctattttcttttggtaaaggatgtgaagagagcaccttccatgactgatgcgccttccaagcatgctgcatttctgctctacttgctgcctgctgcttactcatcctgatagtccaactgtctctaaaactcctaacatgaaagaagagaaaagaaatttgactgcagggtatggagggcagagctcggagagaggatgatggcacgaaagcaaacttttgagacatactcagtaggtcagttagcttttgctttgtaacaaatgaccctcaacttaaaacttagaggcttcaaacaacattcatttatttagctcatgattccataagtcagcagtttgggctgagttcagctggactccctttgtagtctgttgctggatcagctggagggctcgttggtttagagtgccttagctaagatgatttctctctgttccacagggtgtatctcatgatccattagactagcctgggtttgttcgcctaatggttgcatggatacaaagacggatggagaacactccaatctaatcatgttgagcccatgcttatgagataatgaaacctaaaaagttgttctccccagctgaattgcatgggaattatcaaacacacatgtgtgcacagaagccaacaaaaagtatacttggctttaaggataagggtacagggtgcagggagacccgggagacccataaaatagtttatagccaaccccaacacctcatgtaattttgctgttaacattttccctccttcaatgcaaattattttatagtgtttttttctgattataaaagtaattcgtgttaattgcagaaaaataggccaagaggaatataacaaggaaaatataattaaccataatctcatgtgcagaggcaataattatgaataattattttattatacatacggcataacatgaccttgtttctatctatatttaaatatccagtaataccatttgttatgtgctatatgtcagaatgtctgctaactgctttatatgtattaattcatttaatccccacaacaacgatcatttttgagatgaggaaaatggggcacagagaggctagacatcttgcctgggatcacacagcaagtaagtagtagagccagcattcaaagtagtgcagccccactcctcagagcatttttgacccttaaaatctgtactattgatccacatccaatgttactcaaacattagtgtgcactagaatcccctgaaaggcttgttaaagcaatttgctgagcatcatttccagatattatgattcatttggtctggggcctaagaatttgcatttctaacagactcccaggtgaggctgatattacaggttcatcaaccactctgcgaataactctggtcacagcagtgtcaaggtatgtactgttaattccgcttcacagatgaaaaaacagaagttcagaaagattcgataaataggccatggacacacagcttgtcaagtctatgttatatccattttccagtttactctcatggaaaacaataacagccaacgtttacttcatttgatagctcgtgcctttcttctggtgaggctatagtgctaaggagatagttcagaagttagatgcagcctctctgagagccaggttttactgggaggtatgtggattgcagccacgcatttgtttgctcattcattcaatcccttggcaaggagccctagctgggaagccccatcggtgatggttggtggtaggattcctgcccccagcagcttccacatgctgatactgaagtgactgtttctgactgaaggaatgacaatctcatcaagtgaagtatgaacagaaaaaaaaaatggcacaaagatgttaccttttgaagctattgacgggaacctgttccaaagacctctgtgctattttctaacagcaaagagactggtattattttggcgggttccttacaagaaaaaaaataaccctcctgtgatggcagagcctctgtgatgtctgcctagatggagtgtagcttttgcagccatgtaggaccagcttggagctctctgggtgtccatccttcctgctcagtgcgggccacagacaatagcatcactgtgcaacttgatagaaatgctgattctaaaccccaccacaggctgactggactagaatctctagatttggagcccaggaatctgtgttttaataagttctccaggtgatttttagaagccctagtctaacaagaaccctgcaaagctaattattttgcttcccaaggagaacagctaaccctctggaaagttaaaaccctttaggtctagtgttagacctaaaggtctactcttctcaaactttagtgaccatcaggatcacctggagagcttattaaaacataaattcctgggccacaccctcagagattccaattcagcggatctagggtggagctcatgaatatgcatttctagtaagttcctgcatatgctgctgctgcctgtcctggaccacattcctagactcctttagcaacatccttcttaaagaaaaaaaactgattgcaactgtcagaccttttcaagatctctgtttccgtcattccctttcaaaattatattttcttatttagggaactcagtttcttcagaaaactacttactttttaaacttatttttcaatcaaagtccacaaactatgttaaaatagaactggttctggtcgtccagggcatttctgaaagagcttgttgagtgtaagtaaatggaagaggtatggtatggcttcatgatttcctgttcaggagactttaatcaccttccatctgcttagaaccagagctctcatgatacacattgtgggggactaaattttctgagcacattagtcaagccctgcaaaaatgacacccaaatgatcacaagtggtctccaagtcccctgaggaagaaaccttaaagtatttatctctagtctcaaaaaccctcagtatcttaacccacagtctctaggatgctaacgcttaatgggcaaagtatgtaaagaattttttaaattactcattggactctcctgtaagtattaacatgctcaaattaatttgatatatattgccttaaatagtccaaggaagattggtgccaaaaagcttcatgaaacaattaaaaaacacacacagtcatgtgctatgcattttgatcaatgatggatagatgggtggtcccataagataagaataccagattattactgtaccttttccaagttgagatatctttagatacgcaaatacttactattgtgttatagttacccatagtattcagtacagtaacatgctaaacagatttgtagcctgggagcaataggctataccatatagcctaggtgtatagtaggctatcccatctaggtttgcctaagtacacactatgatgtttacacaacgatgaaatcacctaatgacgcatttcctagaaggtatccccatcgttaagtgacgcatgactgtatactccaatttaagatcccagcaccatgtcaaacaaaaaatgttataaagatgtgtgagacatgatccttgccctcacaattatttacttgctgctttctgcatggtaggcactcagactaaaaggatgctggtggagtgacctgtcaaacacgaatgtacacagtatttttgtctccaggagaatttgtgcttcaaggagaatttgaggacctatcacagtttcctgggggatagagatgacatagaggccaaagtagcatgaagcaagaaatactgggaaggatacctgagaaccacacaggagtccaaaggcagccttggtccaagctgccagcctactccaggagatgccatttgttcagaattttgaaggctggatggaaggctggaaaagggttgagggatgatattatggcaaaagaaatagcagacattggaaggattacagtaaaagtaagtagggaagcattttcatcaggcatgctcctgaaggagcaatgattaataagcatgagatctgatcccttggaaaatgttaaacaaacctgtcctacctccaaaaaggaacacataaatctatttgaatggagccatgtttgcccttgtgattaaagcaggctaacctttcctgggtggcttttgtctttcctttttgttattcatgagatcttctgttttcatcgtatatcccctcaaggttctaggtaaatgaactacaggcccagaaaagcttgtttgcctatcatatgttcctcctagaaagtgaatttatggaaattttggatatttgtgcagctacagaaaaggaaatctcaaatctggggagatggaaagaacaggaacctagagagacttgaggcacaaattctctgtacatttgtgtttgacaggtcactccagcagcacatgccaaaccaggatgagcaaagttcataagcttgctttcttatatggctgccacgaccttctagaaccatctggaactctaccaccctccagttaacaggccctatgtgccctggtttgctcttggaaacattctgtacatctgcacatacggagacacccacgtgcaaactcagtagaggcaatgcataatttccagagttagcacatgaatatcacatgaatgtatagtgactatatgtcagagatttacttacttcattagtgagaaaaccagtaggcagatcaagtcagttcacagagtatttgaggaacaaagatttatatggtcagtcaggaaagggaggttaaaaaaatttgtttaattgggttcaaaactgattaatgccctccaggccatacaactacaatgcttgggattatcttttctaccacagatatatcatttgcttctttactagatgaaagtcatgtgctcaatcttgtataaagtaacatgtaacttgtcagtctggtctctaatcaagggtaaataacaaaaacttttgacggtgattgacatgtttattacttttattgtagtgatggtttcatggcaatatacatatgttaaaatttaacagattttgaaataaatgtgtgcattcgttgtatgttctttatacttcaataaagctgttagaaaaaaatagtaagcccaaacaagttacattcccctaaaaaattacataatccccaggcagtcctattagaaaatgttccaatatgatataaaagaattttctcatcttttttttttttttttagctttcaagctttagataatttttcttgactttaattaaagtagttgttctcgactcaaagagatttaagttttggccacttagtaagtgtgtaaccttaggcaaaatatttaaacctccctgaggctcagattctccatctgaaaaaaaaaagggagataataatagatctctgtttcataggtgtattactagggttaaataaaaatatgcatttgggtgcttagcacagcacctggtacatcttaaggacctagtaaaggttacctgttcttaattatcatttccaaggagcaatgtagctcaggagctatgtgaatgagagacgatgagacaaaaaatatcatagaccagggatgagaccctaaggacactcagaactgtgttcttgaccaggtcacttgtctttaccttttttctgattcctcagctacaaaccgcaaggagtagatgagagctaaagcaggtcctaatttttagactaggattcaccaggccttggactgaatcctgatggaatcctggcttcttcacatccagaatctcataagctcttagggctctctgtccacggtattgtatctcagtgatgaggactctggattcgaatcctgattctgccacttactagctatgtgactctaggctacttaccgaacccctctgtgttttggtttcctatctataaaatggggatgatgaaggcacccacatcacatagagctggtgggactatgatactgagttatcacataccaggatctatacagtgctgggaggactctacatgctcagggatcatccctgttactatgagcacctgtgaatgagtggtcgggcagccaagggtcccattcagcaagcctgaggagtgctggtggacttctcaaaatgatgagacttgaaaatgtaatttttatatgcaggacaattcccctttgcggtgtcacccagcaataactccaaaggtgtatttgggggtactaatacaagctgtctggcagttgtagatgtggtttagtgacatttgtacattttgtgatctacatgtcacacacaccctgggactggaaaaaaggtgttaacacccacaaaggggctgaccaggcagttctcagggtggcctagccagaccttccaccctgctgactggcagggttccctacgcaggatgtgccctcctcctcccacagagcccacagatggcttaccacctgctttggggaagacggctgcttcctagttctggggcattgctcagcctgagctacaagatttatccccggagggttcctttagcaggcactgtgggtctcctatgagatccctttgttcccttttaccagcccattgcatagcttctgcatgttttgctgctaaaggcaatctatgattttactcatacagaaagttgcttcatccatacagagaccagaaatggctgggagtttttgtacctcacaagtggctttagccaatgactgactgacatagaagtgcgcaaagcccagctctctctcctggaggtgaggcatgctctgaggtgcatttaagactccagagctccatggaggatgatgctgatgctggcacaccccccttgcttggcttcttcccctttcttgacctatctcctccactcccttcctgatctccccccagagcattccctcaacaaattccctttacatagactcttagctcagggttggctcttagaagcagcaaacccaggaggagctccttttcccgcgcactcccacctccagtagagaagtgcctctctgcaagtagcttatggaatcccaaaggaggacggtcctgctctgaagttcttagaaacacagaactttgagcagtttgccctatcctgagctacctgctttgtaaacactttgggagcaggaggagaaaccagatgggaagacacaggccttgcggtaaatggagaaaacagcaattcaaatcctccaaggaaaaaacagttcccccagggcaaagtgctggagacgcatacctgcctcgggtctggaaaattattttttaatgcactgggcagtctcggagcctcatgaacttcttccaaaacagatatagcctgcctgtgtctcattggcctcagggaaaatctctctagcttccctcttcagctcagcctctatagaaaagggtctgtgccttccgactgtttcttcatctgaagtaaaaagattgatgggacacaatgggactcctgagcccagccatttgtggctaaggtacttgaaatgatatagagggatcccttctccccaagccatcagggcagcccatagcctagactttgggtaagaaaaatatctgaaaatttgtcttttggagtttgccaaatcccagggtccaagtgggcccacggataagaataacggttgtgacagccaacctgccaagtttccaaaagactggatggtactacacagactcactggtgtagcaaagcacttcaaactttgattgcttaaacggccatcaaacgatgcttgctcctctggccacaagtgacactcttaagtgttgtccaccctcttgtatgtttccttccaatgggcaaataactctttgagctatacagagactaggtgggagagggtgaatgggtcagggtaagttcctccaagtttctggaacagtaacacccacacacacacatacacacacaatttatttcctctgccaactcagggttctggggtgggaattcactgtggtctatacactacctggcaattggagatgcaaaatgtagggttttgggcccaagaaagctaataaagagtacaacttgagtactagaattactaatgaagtacaactcattaaaaatattagtaggcaaatctaccttttctgtgatttaacacaggaatcgtgggttagaagatttgtgtcctccatttatagaatatttttctgttttcttggacataattaaacattctagcctcctttccctttgttaatatggctttgataactttgggcttcatttacggattttgtatagggctattaagcgcagaacagtgagactatgataattataagaatagaaataaatgcataataacaaaacttacaaaaatcgattccattacattcagaactggtaataaatcaacattatgtaaaaaaacctttatgcatagataatgcaagggcataaacaatgtttcaaagggagaacatgtgaagtagaacagatggatttaggcagacctgttactggcaaagctacaagctgcttgcagacagattaaagccatcttagagaggatgagctttgggttgtttttcaacacctaagtgttccataaatgagtaagagttaaaatcagagctaggtatctctaagaaataataatagctaagatttaggcaagaatgtacttaaactagtttgttagtagttgaaaccttcatgtgcatctttcaagtctatccgctattacgaaggaccattaattaacctacatattttattttaaacttctttgagtcataaactaatggagaaagaatgaattattcaataaatgatgttgaaaaaggagctgtttggaaaaatatagaattagggctttaattctttccgtatgtacactaaaacaaattttagctggattaaaacgttgaattaaatatgaccactgagaaaactagaaaaaaatgaacttttaactcattttggaatatgcaaacattttacagataaaatactgaggaaatcacaagttaaaaatatacactgatgagcctttgttgaaagcactttggtaatatacctcagctgtcattaatttattttctttgacctgtaaatccactcctgggaatctattataaggaaataatccaagatgtaaatgcaatgtttgtgtaaatatgttcatgatagcctaacttacaatggcaaaaagaaagggaatggaaaggaaaggaaaggctggggaaggaagaggagagaggaaacaaaacaactctaaacatccagtaacaggagattagccaaataaatcttaatatgttatgtgagggaacatcatgcagtcattaaaaatgtcatttgagcaatgtctaatatatgaaaattttcataatgtaattgactataaaaaacaggataatatgtgtatatctgattctttaacaaataaatttatgtatatgcaggcatacacatgtatattgattctaaatagtgcattggttcccaatcttggctgcacactaaagtcactggggagctttaaatatactgcatcctgggattcattctcagattctgattgaattggtctggggtgttaccggggcatcaagattcttttaaagctccccaggagatttaaatgcgcccctccagatttgagaactatgggcatatgatttaaaaaaggaaaaaaacaattcttcactgagaagacttggagaaagaataaatatttatttagccttccgaagcaaaaagacattcacctggccacagtggctcatgcctgtaattccaacactttgggaagttgaggcaggtggatcacttgagttcagaaattcgagacaagccgggccaacatggtgaaaccctgtctctactacaaatacaaaaattagccagcatgggccagacgcggtggctcacgcctgtcccagcactttgggaggccgaggcgggcggatcacctgaggttgggagttcgataccagcccaaccaacatggagaaaccccgtctctactaaaaatacaaaattagctgggtgtggtggtgcatgtctgtaatcccagctctcaggaggctgaggcaggagaatcgcttgaacccaggaggcagaggttgcagtgagccgagattgcgccattgcactccagcctgggcaacaagagcgaaactccgtctcaaaaacaaaacaaaacaaaaaaattagccagcatggtggcatgcacctgtagtcccagctactcaggaggctgaggcaggagaattgcatgaacccaggaggcagaggttgcagtgagccaagatcatgccactgcactccaacctgggcaacagagtgagactctgtctcaaaaaaaaaaaaaaaaaaaaaagttcacctgctagctgccagcaaatttcatagaatagtgcccaaggaaaaccttacctgtttgtattactaagaaaaattatccataacttggaaataaagcaaaatgatggatgcacatctttcatttgacatactggtcatctaatggacccactcaaggattatcccattctctttctttgacgtactattaacttttatcagggtccagactctgtgaagttacatgtttgttaatttagagatctcgtgtcatggaaatttaaatgattcctgtgtgatagaaaaagcaactgcaaaggtgacacttttattgctccgtaagatattaaccagctttgtatttcagttagtaatcttattccagtattatgtatgaattctctttgaaccagctttaccatcttgttggctctctcattaatgagttaataaatcttcatcacatactccttctatatttttatgagactcatgtttttaactttttgaaagggtaccttgaaaactatccatgatcaaacatggatttagtgacagaagtgaacctagaaaactcatcctgagtggagactgatccagcaacaacatcttagcgtttggccacaaaatgcttccttctcccaatgttctcagaacatgcgctctgtgtggcttacaaaaatctccaggccctttgcccacaaggtctaatgcaagcgccttttaaatccactccatgataatgatagggaatgccaaattgagtaactggagaagtcaaatttacccactagggtagttacagtcacagtagttacttaccttaagcaattcgatatttgggtaaatccaattttaccaatcagtcttctgccatcattgactcccacaatcacttcagagacactttatcatcatgtggagctcttctgccatcaaatgggactcctgacactttggccagggacctttttctattttttgttacccctctctgtgtcaaatactcccataatgatctataaaattctagaatataagctagtagctttgctatttaaagaaaccctgcagtgaattcacttctagagcaaataattttccggagagtttaactgcttagtaggttggcgtatagtaggcttgttcagagtgggattgtgttcataggtcctggtttcttcaaagagggacatagcagaactgttatctaaggctatatatatacaaagatatatgtatggcagagtatggcagaatatatatatattcagcagaggtgataataatgatgaagtccagggtgaatgcccatgttttttgatatgagattatcagattaatctgaggaataacaattaggttggcatttttgtttctctcacctccatggaagcagaatttgcaagtgagtcagctccttcctgggagtttgctggcttaggaaatgtctttcttgtttccacagtggttcctgtaatactgaggagcagatggtgtttcttccagcatggtaaacttttccaaaaaggatgggaggatagaaagaattaagtccatcagcattctaatctctatgacagtcttgtgggtgcaattagattctgaggaaccattttaaaggaccagctaatcaggactttttttatttttatttttattttttttgagacagagtctcattctcttgcccaggctggcgtgctataatgtgatcatagctcactgcagcctctaactcctgggcttaagccatcctcccacttcagctccccaagtgtctgggactgcaggtgcacactgccatgccagctaacttctaaattttttgtagagatgggtctggccatgttgcccaggctggtctgaaactcatggcctcaagcaatcctcctgccttgacctcccaaaatgctaggattataggcttgagccgctgtgcccagccagaacccattcttatgaagtgacctgggtttgtgtcatcaacactatacatacacctcggcttccttcatagagccagagacctcaggtttggaagagaatttgcacatcacctgatccaacgtcccatcttataaatgaatcatgtccatcaaggctaccagctggttggtcagcctttccctgaaatagggaactcactttttctgagtcctctaacccagactttggacagatctcttagaaatttattctgtcatttcctcccagtgctgatggttttattccttagagtctgttgcaaattttcctctgccaatttggtaattctcagtaattattttaatagatgtagttaaagtaggtgaagttcgtaggtctcctccctcatgacattgaaactaggtattatatttaaggaaaacaagcctcaggatggattcttccctcaccaaaatatttcttagcaagcagacacaatactagttggaaaacttgttctataaacacaatgaagtatgcattttctgttcacttgggcattccaatcagcaccttgcataatattctagtggcaggattcaggtgaccttgcagtcagatcagattaaaacaaacaaacaaaaaaagtggttcttaaagtgcattccctgaaccaccaccagcagcagcatcagagaatgagaatcttagaaatgcaaattgctaggccctaccccagaatcacttactacatcagcaatctgagttttaacaagtgctacccatgagaatcggtcaggaaactcccctaaccatgacagaatcaaggagcaaatgtaagccttaggttaatggcatacttagactcactacacacacacacacacacacacacaaacacacacacacacacatctggcttatattatgtgggatggtagtacatttacagtatttctagccaatttttacattttgaacattcattccaccaataaaaaattattcctaacatccattaggttaattagtaaacctttccatagatcacaggcaaaaggagttgaaacactaatagtagctatctcagaaatgtgagctcctgatataactctttcaaatgctaactgcctatcctagaagtctgtatctctgcttagggtaccatgactgtttactaaccacctcttgggtacagattacaactaatatacattcatgtcaatgaattttaagttaaattacaatttaatggctaatattgaaccaatctagtatctattccttgcagtaaccagagtcatgctctgtcttcttttctccaagctaaataccttcataccctcaatcatttttagtacaatgggatttcaaagcccttgaccacattgttctcctcccagctttaaggtaactacaaacgaatgagtatgaacatgtgattcaggaaatcgctttttctgtgggcttccagatcccaggataaaggtacctacacacaccctaaatgttccacttctattccctgagccaccccaccctagaccttgctcaaactcagagcctctctttgccaagcttcccttgcctacgtttgcaccctctacatgggtcagacatatggaaacataggcaagaatgtgggtgtgtgatccatccccttatctatagcaatgaattccccagcatagcacatataccttcagtggctggtgaaatgagcttaggaggatgatagatgaaatttgcaatatacattttagtaattgtgtatctactttaatgtatattaaacaaacataattagccataacatttctgattttatagatattattacttagaatgaggctaggtttgaaaggtgcgttaaaatcaatgattttaaaaagacttagggaattaacaatgtagcgtggatttatgcctaaattgtgaagaaaacataagaggcccagggttttggaaaaactattcacaaggataatgagttcaggatatggggaccctggccagagttgtcttcaccataagtactttttctaggaaaacagaaattatgttgatcagcattatttacctgccaaactgttcatcttttctccagaaggcagtaaaaaataacacaaagtgccaaaacgcaatgagtttagcaacacaaacaccactgattctttgataaataccatacagctcatgtgcctgcttttaattcaggagagaaagccttctataccaaggccagcacccaccagagaagatctaagtcagaaaaaagtagagttttagttttgctatggaaggatgatatcatgaaatataaaaatagcaattgtctgaaattaacagtaggaaaaagacaggctacattggccttagtcctgttatttttatatattctaaaaacattctcaactagcatagacgagtcccttcctctccactattttgatgtttgccatttcaaggataccttaaggtgagccctagattgggacttaaagattcaggctctgcgtgactctgtagtttcaagttactccacctttctgagcttcccttcctcctgtgacaaatgacacccagtaatcctcaagttctagccattctgtgatattctgaatgtggagtcttcaaatccaagtaagttcagccaagctgagaacacagagaatttttgttctttttcccctcttttcctgattcagtggtttgttgattcctctaagtacatggcgtccagctatccatacgtgataaaaaaaaaatagctcataaacaagtggaagttgtcttcggttggattcctcagaagcagacccttagacagggatttatgtgatagtgatttattaaggcagtgctcgcaggagaaaccagaaagggagtttggagaaggacagtggggacacaaggaagccaagccaaggagcccttgccagcagggtcccaactttggcatgatcctgagagaatctttggagtgtacattacaccttatggtttgtctcaccttaaggcacagaagcagtacaggagctagttttttgtactcctctgccagtcagttgttagctaggggcctgccctgggggtgggcggtggggggagtagtgggtcaaaagctcccaggtacttgctgccactcccagtggatcaggcgaagcaaccctggggtgctctttttttttttttttttttttttttttttgagacggagtctcgctctgtcgcccaggctggagtgcagtggcgcagtctcagctcactgcaagctccgcctcccagcttcatgtcattctcctgcctcagccacccgagtagctggaactacaggcgcccgccaccatgcccggctaatttttttgtatttttggtagagacggggtttcactggcttagccaggatggtctcgatctcctgacctcatgatccgcccgcctcggtctcccaaagtgctgggattacaggcgtgagccaccgcaccaggccaaccctggggtattcttacaaagagggtcacaggcacagaaacacggagatgaccacaaagaacccctaagggagctgagcagatacccaataacattgactactgaaggcaaaactgttactaagcctgaatacataccagcttccttccaggtgttggtgtggtcatagcagcacagaaatagtttggttttcatgagaatggtgggagtggggtctttctgtttggtcttagaatctgtctgttcacgcactcctgagaggaatcattttgtttagggtataacaagactttcttttattgtggccaagtgttagccccacagaagattactcatctcccaagaaccaagctgtgtacctcagaatacaaacattttcatcagttctgtcctaggatggggaaggaagagacccaaacgcaaaggtttcttgcgagagctcctaaaaccatccctaaggggcggttctccactccagcttcaggctggatgcggctgcactaacagtagcactctgtaaatattggttaaatgaatgaacctgttaccgtggtttgtttaactatgaacagaatcaatgagacaagattggggcccctcttctctcctggtcagtgaggctgctgtgctttggctcctaagtaaacaatcaggaaccgttgcataatacaaaccacagggctaaatacccatttagccacatttgcaaaacagacaaaagaaacattggcattttcgaaaaagagagatttaggcataatcagtgttggttgtggctggatgccctgttacaattaagaaatgccaatgctggctgcatttcaatgccaggcctccccagacccagcaccctaaaatacaaaacccaagcagaggccgcttttcacgatgctgtcactaatcctggactagcccagggaaggggcatatcagggaagccagacttcccttctcagaagaaaccagatcaagactgtgcctatttatatccagacatacagatatagaatcccatttaggaatggtgtggggtggaatgttctgggaaatagattagccaagcttgaaaggaattgggctttaatgctagtgcctcttctcagagacactgtgggagagggtgacaattctgtgggctggttaaagtacttgtcacttgagattgttcttcagccaaattctcctataagaagcatactaatggtgtttaacacatgctatgttatcagatattgaaaacaacatagtgggaaggaaaagggaccaccacctcagatcaagatggcctcctcaatgctggggagccgcgttcttgtgtttttggatagtttggatagtttggatagtttatcataaggttacccttatgggaaaccagagtttcccactggatccttgcaaagaccttcagccctaagtcatgctacacatggatccttccactctgggggaccataagaaggacctgtggttgttgttgaaaatgcagatgctagcccgacctccacagattgctttccataggtaatgtaactgggaatctgcattttagcaagcaactaaaaaagattttgatgcaaggagatctcagaccatgctttttttttttttttttttctgagatggagtctcgctctgttgcccagactggagtgcagtggcgcgatctcggcttactaagaggccctgttatgagccactgtgactcatctgttatccagaaaatgggtgtaaaatagatgcaagatggtatatcaattcattcacaagacatgtgttcatcatatttgaaatataatcttttgatttaagtaggaaatagtttaaaaccagtatttcctgctatgaaaagaggagattgaatttcatgcacaggaatattcaaaaatacaataacaaggagccaagtccatcccatgctttagaaaatttacaactatgaacacggcagatttaagaagtgtccattcttagtgatagaaatgtaaacagaaacttacagcatgttatctgctgaaagtactttttgctctggtccttagtttgccttaaaacataagctttaattatttgcagagggagaagaataatttatcagcaccatccacagagtctccaatgcgcaaaatcctcagtctcttcttcctctgtcttacagaacaagacttcacaaaccttgttatttgggagagacagaacatcgtcagtgtgctttttctaataactatcttctcttcattttctgaatacaagaatttatctcatggaaatcagtcattttgtccaccctccagtgcagggcaccattaggagactcagaacccatggccccgtggagctttcagtcagcttgggaggtaaatgatgttgggagtctgtaggacatgtgaattggtgaggttaaaataacatcgcgtggtcaagagtggagcacaggcacagagtcacccccaaggtgggaactccacctctcacacctaccagcctaatatggagataatgtgatttagggcagcacttctcaaacttagtgcttgatatgttgttcagtacgtgatccaatccaataagtctggggtggaactcctaacaagctccctggtgaggccgatgctggtctggggaacacatttggagtaccaaaggtttgggggtttctatataatccccctagtttcatataaagttcttagtttgattcctatcacattgcaagttcttgacaaataactattattatgaagagtgttttgacaactaacagctgtgcggcatagaatgttagaatagatgcagctgattttgcctaacagggaaaggctgcttcaaacctggggcaaattctggtgattcagaaaatggaaggaatcacctcttcaccagtttcactcaccccttcaatgaggggacttagggagttgtctcagcagcagtcactgtgcttaacaatatattcccttagaataagtgctttgcatcttacggttgcattctcttcaagaaatttcatccagtgaaaataatagcaccaaacccatttttgatcatattcccatgccattacagtcagggaaagagattattagtctccaaacaaatccaagtactggctctttctggagggcaagaatagaaacccagagaaaaaaaggtggctattgtgagccaaatgagagcacattaacccatgacttagatgcttagatgcattagtttgatgttgttgctgttgttttggtttgtttgatgaagatgagagacataaggctaagagaaatgaatatttgattggattgagtttgatcaaggttgtgcaatatgaataacatagtagaacagggttatggtagcaacacttatcttcaatattgataaaagcaataatgcactatgaaaaggtagcaatcatggacctataaacatgacaacacagctgcaaaatgtaaagagtgaaaatgggctgaaatagaagaaattgatggaacgaactcactgttgaagacctgaacacatccctttcagaaatcaataggtcaaattgactagggaatttagagagtttgaaaacataaactttccttttctgcttgatttgatgtcaataggtaggtagttagagtcaaagacagaatggactttcttttcagacacaaattaaatattcacagccattggccatgtgttaaggcacaaaggaaatctcaacaaattccaaacagtaaaaatcatatggaccactttcaacatattgaaaataaaattagagatcacaaaaaaacctctaatatttaaatcttaacatcacattttcaaataactcttgcattagagaggaaattaaagctgaaatttaaaactatatagaaataaataacaaagaacatactatatgacaaaacctgtaagatacagccacagtaacacatagagcacaatttatagcaataagtatactatacccagaacaagaaaaatgccaagtaaataagtcatttgtcaattcaagaagatataaaaggaacaacacaataacacatcttaggaagaaaaaagaaataagaataaaggtgagggtgggaggtgtggaagaatcagtgatttaaaatataggtagagatgataaacaataatgaaaactgggatttactgaggtgtacctgtcaaatcactctgtgttgttttccaatatgtaaatgaaactaaaaatagtctccaggttttttgtttgtttctttgtttgtttttttgagacagagtctcgctctgtcaccaggctagagtgcagtggcatgatcttggctcactacaacctccgcctcccaggtacgaggtttctcctgcctcagcctcccgagtgcctgggactacaggcacacgccaccacacccagctaatttttgtatttttagtagaagcggggtttcaccctgttggccaggatggtctctagctcttgaccttgtgatctgcccgcctcggcctcccaaagtgctgggattataggcatgagccaccgtgcccggccaatagtctccagtttttaattaaaacatgaaatagctacacactttgctttgagaataaatatgctatgaaaatatattttttaaatcacccaaactcttgatctaacatttagcctaatcttaatagttaccgctaagcctgtttcataatctcaaagtggggatagtaatagtatgcacagcgtgtgtcactgaaagtttgtgtaaaggtatattttatatgaaaagcacttaaaatagtgcccaacaaagagcaagccctccgtaagtgttagttaatatgattattattaatagataaggagagttgtcccacttggtttataaaatcctttttttcttctttgggctttgttgaatatagtgagttttcataaacttttgttgaatttgaaggtgtacctccaccagaaaacaggcagggtctgcaggaagagaaggatccatcctgcagaagcttcatacaaatgatgaacagtgtggcgagacatcaagatgtaggttttggctctctgtgataattcagctgatgggtgttgatttatacatatttgttagtttggtttatttattaaaagaggaacagaaagaaatatattagatcagggtacactttccttatgcctttcctgagacattcctgtcctttggcacttggactaatgacccatgtccccagcataatagccatgtctctattcactttgtatatcaaaaagcacaccctgctctatccacactcacctctcttcctgggccctaaactcatatttcagttcagagtcttcagcaggaacgcatttttaccctaaggcacctaactaagtaagccccttgacagggaagaacagttttctgtggagtccatttgctcctcatgtcattaaggtttcagatagacttaagtgtagcattaaagaataaagagcttttcaaattacccttgacactgaagaataactgcagcctgcccaccgtgaagcaagtatcttgacagtgacagaccctcagatgtttccgtttctgatgctaaacatctgtctcagatgtttctgtctcccaccactactgctggggctgggaacatttgtccacaactggttgcagaagttagaaattgttttgagggccacaagggcaccctataaccttgcaaatcaatcatatagattaaatctgatttgcaatcctaaaatcctgtaggaatagtcaatcaaaggcaaatttgtttttacatcttgtattttacttcatgcattgttttaaaatatgttccagaagtccggcgcagtgtctcacgcctgtaacccggcactttgggaggtcagggcaggtggatcacttgaggtcaggggttcgagaccagcctggccaacatggtgaaaccccatctctactaaaaatacaaaactagccagacatggtgtgcatgcctgtactcccagttactccggaggctgaggttgcacttgaacccgggaggtggaggttgcagtgagccaagattgtgccaccgcactcccacctgggcgacagagcaaggctccatcttaaaaataaaaaattaaaaataaactatgttccagaaaacactaaccccaccttagaagctccatgaaaaggggattttacagacacatatgaacagaaaaaatataccatgtgtgtctataggaaatgtataatgctctggggatattaagattgattttgaaaaatttcagaatttttgcttaattctttttaggctaaggatctgcaaatattttctgcatagaaccaggtagtaactattttcagcttttgggggcatatagtctttccactcaactctgttgttgtagcatgaaaggagccattgacaacagataaacaaatggatgtgtgtgtgctccagtaaaactttatttatggaccctaaaatttgaatttcatataattttcacatgtcacaaaattttttctctgagtcttttaaatcattttaaaaatgtaaaaaccatcctcagctcaaggccaatacaagaacagctggatttggcccgtgggccctaacttcccgaaagcccctggttaatgtagcctgccccttgtttcccactctatataactataggactccagcccggcacggtggcttacgcctgtcatcccagcactttgggaggccgaggcgggcggatcacctgaggtcaggagttcgaaaccagcctgaccaacatggagaaaccccgtctctactaaaaatacaaaattagcctggcgtggtggtgcatgcctgtaatcccagctacttgggaggccgagggaggagaattgcttgaaatctgggaggcagaggttgtggtgagccgagatcatgccattgcactccagcctgggcaacaagagcgaaactctatctcaaaaacagcaagaagaaaaaactacaggactcccaccaccccacctggtgatgctcatgaacattccaagagagaaggtcctacagaccagagctactcaacgtgtgctctgtgaaccagcagcttcagcatcacctgaaggctggctggaaatgcagaatcagctggccacgatggctcacgcctgtaataccagcactttgggaggccaaggcaggtggatctcttgaggtgaggagttcgagaccagcctggccaacatggtgaaaccctatctctactaaaaatacaaaaaattagctgggcgtggtggcatgcacctgtaatcccagctgcttgggaggctgaggcagcagaatcacttgaaccaggaggcagaggttgcagtgagctgagatggcaccactgcactccagccaaggtgacagagtgaaactctgtctcaaaaaaaaaaaagaaagaaagaaatgcagaatcagtgaccccatttcagaccaactgaattagaatccctgagggtagggcccagcaatccattttaacaaggtttctgcatattctgactctgggggaagtttcagaagctctgtcctggaccacaccttgtaaagtgctgatttgggaacactgaatgctacatgggagtgtcagaacagttcatccatgtcagttaacatgaattgaacccttactaggggtcagaccctttgctaataagcactggtgatttgagataattaattagatactgttaggctcttaatagactgggagtttgtcttacaatcagagcctcggggaatagttttgagtggcttttcttcctaatttcttctgcttcctagtttcctctttctacctgctctgcaacacacaagatggcagtttattgtgctaatatgagggatgtattgcaggctgccttgatcataaatgccacttcactactaacgtcctttcagctactgaaattactattaataaacatccttatgcctcttcagctgctgtcttttagaatgctaacatgcatgagtttggggtttataggaacaatttattaaacactagcagtaaacatcccaacagaagatctggaggtacgctcagcgcccactctccagccgttcttattaggagagggggaattgctttttcagctttgaaatgctgtgtgtttgagatccaccagattcatcagccctcctcccaaatcacagacgtatctccatgttttagagcaggacaaaggtgtgggagttcctgggggaaccgtgaaagtgatgaaaccaagggtatctgccacatggcttctccgccatcgcaccagctgcccatcagccaggcctggataggctgctgtcagcttggagccagggcgccctacagctgttcttcacatgctgagaataacaactttgagaggagattgccaaggaaacacaggaaacttgagtatgtgtgagagagagggagagcgagagagagagagagaagagagagagcatgcacagaaacattcatcagcaaatagacctgaaggagtgggacagagcaatagcactacaagtctgaaagcacatggacccctgccttctaataaactggcctgtgaaaaggaaaggtcaatggcttgcttaggccgaagatacacatttcccccccaggaacccagcagcaaaatataaagatggagcgtggggccagaaggcactcttgtttgtctcctcgtggtactcctgtgagaggtgctgcttggagactggaggctcaggcactctgctggtttccctggtttcaagcttccatgggtgctcagcaccacagcaacatgtcttgtgcctagccgttagtagaggaaagctgattaacaaataccgggtttgttccactcttagccaagggtgtagggctgtcctgaattagtgaggctttctgaatattaagctccacatccttttttacaaaaaatgttggccagaacttttctgtaatttattcccctcaacaaccccatgagattggcattgtttgtcctgttgagaaaactaaagctcagagatggtgatgaacttacccagactcacccagcttctgagcgccagagccagcggtccagctgggtctttctgacatcaatgcctttatccacccactccactgaactatggtccatagtctactcaacttccccacgggtccactgctttattctggagggtagatccccggtcacttgggaatactaaaatttcatttttgtgcatcttaagattctggagtgacttggtgtaaattccttccagtgtctgttttctagatcctaatttgtaaaatggagacatggaaataaagtctcatgtatttaaataaaacacagtgttcacatctctacatcatctcacgagcacatgttctagtggccagaacacgcattcgaaaattagcaggctcatcgtaagatgctctgtcagttataaaatgactgcccataaagctaacctcacataaacttactccattatttgtttaatgccagtggtagaataaggcaaccctgaagttttgttatttctttttttactcagattccatatttgttgctttgcccggcaatcactgggtagagaacggtgaaacctgttatctccaaagaagtttcactttaggattccttctaagaaccctaaagagtatgatttctcctttttcacaagagcaataaatttggaaagtgatattaatatgtactaaaattccatccttgttgagaaagcaatagaatcgtggacctggagggtgagatggcagagcctcctcccccaggatcagatctaggacctgcctctgggaacttttgttcccttgcctcccaatgagtatgttcctgattttttttttcatacagaattttcatttttatttttccgaaaagtgattctcattctcatgcaaataataataataataaacatggtagtgccccaaggccccaaatctaatttcctctcccagcttcggttttcaatagaaagacaaacaaaaatatgttttttggttaggaaatcatgctcatatgcaatgtttctgtttcattttaagtttcttcagacatttactagttagtgtaacacaggctgctataacaaaacaaccctcacattttccatagcataatagaaatatattgtttgctcacgtaagagttcaggtgttactggccaggagtcatttttctccatgcagggatatggagggcccaagttccttctgtctcatggtctcatggcttaaccatcctttaagactgtatttctggcagaaggagaaacagagggaggagaatacctgcttctgaactgccttagactgacagggacacactttgttctactaccactcatggactgtctctagccacagagcaccacttccttgcaatgggaattagaaatgtaattcctggctgcacagccatttcccagagatcatgctctaccatgcaacagtgaggttaaagtgcacagttgaccatctccgctacaagacaagagcccatgccttcttcaaatgtgctactcacagagaatttttcattctatcagatacctaccccatcgggccctttgcccccttcccttcgatggcctggggacatggcttcctcagaaaggcctgttgcaaacccatgggcacccatgataccagacatgtcccctagtgtaattatcatcatcctgaatcatctaattccctcttttgcttgcatctccccaattagactgaattctgtaaaggcagggaatttgcctatcttgtccatcactgtatccctagtgcctaacactgcctggcatattacaggtgctcaataaatatttgagaaggaaggaggaaggagggctctctccggaatagacccagtccttgtacctgtcatttgtaccatgtgggatttcaagagagtagccaagaaatggactggtcacctttcaggaccaaggacccaccctctttggagtgatagcagctcaccctcacacaagcccttttggcaacctctgatgatgactgaaatagatgaaagattttctgcctttggcttccacatgcttctaaacacaatggaacactattcaacaacaaaaattgaatgaactattaatacatgctgcaacatagataaatctcaaaataattatgctaagtgaaagaaggcagacaaaaagtagtacacactatgtgatttttatttatataaaattataggaaatgcaaactaatgtatagtgacagaaagtagatcaggctgggtgcggtggctcacgcctgtaatcccagcactttgggaggccaaggcaggcggatcacaaggtcaggagatcgagaccatcctggccaacacagtgaaaccccgtctctactaaaaatacaaaaaattagccaggtgtggtggtaggcacctgtagtcccagctactcgggaggctgaggcaggagaatggcgtgaacccgggaggcagagcttgcagtgagctgagatcacgccactgcactccagcctgggcgacagagcgagactctgtctcaaaaaaataaaaaaaagaaagtagatcagcagttttctgggcatagacatgtgggatagggcaggggccagtgggtgggtaggaaatttggaggagtaatggctatgttcattgttttgattgcagtcatggtttcctgggtgtatacatatgtcaaaacttctcaagttgtacacttcaaatatgtggggtggactgtatatctgttataccttaatagagctatttaaataaataaataaataaataaataaataaataaataaataaataaataaatgtgatgataaaagtacactaaccccaaaccacatccctccaacctcatcattcccaacccttgggtagtttgtctctttaaaaatatttcatcggtagataggtgtctatctccatggcagaattggcaagtatgtatttgtggcatccttcggagaaacagcacaattctgttgacccctgtctgagtatggctttcagatcagaaaactgagtcatgtggactgagtatgggccatttagattttctggtctttgcacacacctacatgaacatatataagctctcatattttcatatctacttcttcccaggtccagagccaaacccgtcactgaccccccagcccaggcgcccagccactccccaccgctaccatggccgaagacgcagacatgcgcaatgagctggaggagatgcagcgaagggctgaccagttggctgatgaggtaaggagtggagacctaggaagggaggcaaaagatgaaggcctgagtggtttgtcttattcaggttcaggtagggaaagcctttctttcaatgtctcaatttcttttagaaaaagtaatatgactttgattttctgtacacctaaggcttctgtggaccagaataagttgattatagaagctgcatacaaattactgtcttggccctaactctcaatttccagaaaccttgagaagtcaaggtcctctaagaaaagaaagcaatgtctttgggtgccttaattcagtgctatgctggagaaggctcagttccgagaacagattgttaacattttcaggaactttgcaagctggttgctaaatgcagccattattaaaactgaattacataaactgacaattagatagattctattaaaatcaaaagtaataaacactcaaacttcatcacttcctaattattttgctacattttactattatccatgatcttgagattcatccattttatctgtagggtggaaataaggtataataatgtgttaccatgtgtctttccaacttcatgatcagtaatatgaagttgtagcttaaaatcaggcagagctgggtacagcggctctcacctgtgatctcggctacttgggaggctgaggcaggaggatcgcataggccaagagttcatgaccagcctgagcaacatagagagactcccatctctaaaaatatttaaaaatttaaaaatcagacagagtaagagtatttatcacccaagaatctgcaaatactgcagatcaggacttgacttattgttttgctgattgtctagactttaaaaagtagagaaaatattaataatgcagattaaagttaaaagtatgtatgtctgcagccattatactatgaataacacaaaaagaggaaatcttccagtatttgaaaattatgattctctaaggcaaagaaatcctttttgtcattcacaaatgagtacaattccaacacatgccttcattgtttaattttcttcttactcattaatatacatgaaaatatccaaccaacattcatgtcagaactactctggttcatcacatggttagctgtagacacaaaagttcagcaaaaatcagtaaaagttttctgtgagaatcaattggctatgcggaatttacaataaagagagtattgtttattttattattatttataaattttgtgctattcatcctttatatcagtaaaataataaacttgaatacatgtatgtatttgtgtatttttcccagagagccggtagttaaacctttaccagcagactgctgcttgcagccattctatttcaaaaagcagctggctgacagctcttccagggaagttaacatccttcaggttcctgcagaatcttgttcaaaataagtttgtcagttaaaagcaaagctttgagaaatcacactggttgttggattctagtcgtttcaaaagaactgagaaaaaagtgacaacgcagtgcccgggggaccattgcagagctcagcctttccgtctcgttttttcttatctaaggatgaagataattattatagctctctcctataggctggtcatttcaaacatgcttgatttttttcaccctaaggcaacaacttaatttgtattgataagaacttccaattgtgtttctaggagctttgtaagaaacttgatgttatattcatctcgattcatgaaaaattatgtttgtgtttaaaatttaatgttcctggcccagggaggccaaattagtcctctgagtaattgagataatttttcatgcattctgagcatgcaaaattatcttctccagattactttgtctttgatatcaagatcagcttcatatggtttttattttctgaagataagctgtaatgtaattgctttagggaatctgatcatgtaaaaagcctgataggaaagagtttgaaaatgtaatgacattttttgtttcacttgccaactgaaaagaatatgtgacagagaccctttgtgtttctcaagtaaataaagtatttctgattttccaagatctctggatcctgcactcataaagtttatgtttgtttgttttttaaatcttagtcgctggaaagcacccgtcgtatgctgcaactggttgaagaggtaagaagtgacagtattttaagataaaggaacaaatcccttatgctgatacatcctttcctagttgctatgatgtttccttgggccatgatcccctagattccagtgtggatgtagcctatcagaaaggcacagaatgagggagatgctgtatttaagttgccagatagccatgaagacaccttcaccctccttcccagcccaagccacctctgtagtctggtctgggaagcagagaataatagaatttccaagtctgtgctctcaagaaatcacagacgattgtatcactttaagcaaattagagcaattcttaatatacaaaggaattatctacataaaactttatttgtaattatttttgtgcctataaattacatctaatcttgagattctgttctaactttagccacatatatgacttttaaaaatatgtacgcatataggtgtatcatttttagaaattgttctatttaaagtcaagcactaaaatttatgaaaaaataggaaagccctttaacaaagggaaatatcaagtccaataatataaatacagaagcttttttatattcctgcctggattgagcatccatttgccaggcagggttaatgaatcccaaactatttttaaatgggtaaaatggggcaaatagcaataatggaatcaaaagggcacttgcaatcataaacctcactcattccaatttggtagagcagcagtcggccaggcaaaataaatggattaattgaacttgcccaatgggagagatgaagtggaaaaagaatgggttggactatacttatcttaacctaataagacaagcctaatagtttttattcagcgagatgctgttttagctgtgctttgaactgcttatcagtatataaattcatgtgtgattatcgtttttagagatcttgggctttctctggcagaatgattaaatgagcctactcccctcatgctatcataaatttcatatgcaacaacttgaaagggaagaaaagataaattttacaaaggataaaaggaaaggcagccgcctctcacactctaggagccaatgtcctccttctcttatttctgtagcttcagcttctcacctaggaatgagatatggctaaatgtgaattgccactggaggagtgggaaggaggtggcaagcatgcactccctaggaagccggggaagtgggtggggcggggggtgggagggtggggcgaacgtaacaaaatctgttatcccccaaaatgataattcgagcctgcaatgtggcacaaacgggacacaccggaaggcagccctagcaaagcaggtcctcagtatagggaagcagcgttctgtctaagtgaagagcaatattttatctgcactgtccagggaatgctgctgctcatgcagaaatacttgaggatgaagaaggaggtagatattctaaatctacgagtacaggcaagactcttagcatggacttattctctctcaagttttcaggaggaagaaaaatgaaagaagcccatcttagtaatatgcctacatgagctctgaagttaacctgaagggagcctagaaatcaactgagatatttatttgattgtatattattacattattatcataatacatccttatggctttcaaccatagcctccaatcccatttttctttttttggttacgtgtgtgcacatctgatataagtttccaaaatatcagaaccgtcactaatttgcctgcctgtgcaatgttgaaatgctgcctagactgtggaaaggagcaaaacaaatgaatcagaacgcacaccttgaactgatcccttacacatcagagtctgagacatggtcactttttcatgtatcgtcttaaactgcaagccatgtcgtccagtcttcaaaaatgagtatctgctctaatttattctgggggaaaatctctcaaaagcttattgattgaagtaggattctcgaatcatatgtttttgtttctcctaaagcatttttcaatcaagcatgcagctatatcttagaacaaggagcaaaagagatggaagctatctcctgcctctaataaatgagaggaggctattagactttccatgcttaggaaattgtgagcaaagtgttattagagtagattgatttgctcttacttcctcctgggttattttctatttatggtcaaacatcctgatgtctaggacatttgctgtttagatgatattctgcttttcaatcaaaaaggacgttctctaaagagaatctgcattaaatattcatcaaggacagaaatcatttggaaaacctgaggattgaagtaccaggatcttactcatgatcccaaggtttgacagcgccatataatctgaattgagctgaatccttattgaaattcagtctcaaagacaggaaaggttactaaacttgtgaagtctccctaaggcaaacaatctctcagcggaatatacaactttacaccatccttaacagactccagggtgtagccgtggttaggggtggggccttgctttttaatagtcatcattatcagcatctcaaggatagtgtaaaactacacagaggtgagtggagaaagttcagaaaaaatgaatgccatagataggtaaaaaggttagaaatcatgtagcacttggttctcagcctggagttaggaactctcttttggtgaatgcatttcaacaaatattcacagaatgcctaactccgggataggaagggagatgtaaattggtatcttgctgggaaacagatatgtaagtagctctgcaaattcaaggccatatttgccttaggtgcataggggagggaacaactgattctggtaagagactcattaaggtatcctcgaggaggtagtatttaattccaggaaaaaaagttaactctgctaatgctaaattcaggaaatggagtctgcacatcaatgccttgggctatgtaaattaagcccaggaaaagccccacagccttagggcaggccaattcagagacaccacataacttccatggagtggttattgcacaactaatatttcaagaatgttttagcatccttctttttatgccaacttatctttcaagactttcaagacactttggccatgcaaagagaataagcattctaaagtggtgtatgccaaactttcccctaaaaatgaaaaaaatcaggttgagcagtccttttcagatatgcagatgtggggtcttttggagagagtgcctggagtgttctagttttagttcagatgttttagactttgggaaaagcatctcagaacggcaaaagaaagatttgaaacgttctataaagattgtcttagttcatctggaaaaatttttttaaaaattaaaatagagaaataaaagagaacagaaagaaatggaaaagaaaaagtaatcctttgtatcttcaactcccctgtttttaggtaggcgattttcccagcaatctcaaacagaaactaagaattgagcttagataaaaatagaaccacctcctcacactcctagctactaaaacataatactatttaaggaataagagaaagtaatattctgcctccctgaaatcatgtctctatccctgcccatctccttaagcttctaggtccccacaaaagcaacctagttatttttgatagaagctgtcagcaaaagagtggagccaaacgcaagttctaacatgtaccgaggtgaaatgtgccagatactctgcttagagctatcattgtcatcatcatcaaatgtacattacctaatttaatctttgttagcttccttctactactactttgatctctgttttactgtagaggaacttgaggtacacagtggttaagtagcttgcttgagacacacaggtataaacggcagagatgaagttaaaacccaggtctacctgatttcagagtgtaagttcttacgcatcacacttctcttccaccagcatctcttacaatcattatttttctttgagaattccacaaaaagaaaggatctaaggaaacaaagcagctcattctaaatggattgagattctactcaatgtcttatttcctgaactcacggaggcgtcagcttcccatagaggtgaaccttgagaggctggaccctctgaggctcattttactctcataactactgtgagaaattatgagggagcagttactctccccatttgacagctgggaagctgagacacagaacaggtgaccttagagcactagcattatgaagataggtctagaattcagaagtaatgactcccagatcctggttctgcccacctgaccaaattgtctcacaaacaaaggaacacatttgagaggtcatgcatttgtctacccgttatccttagtgcctagagcagagtagaggctcaataaacactaggaaggaaggagggaaggaaggaaggatggaaggaaggaaggaaggaaggaaggaaggaaggaaggaaggaaggaaggaaggaaggaaggaagggaaaggaaggaaggaaagtaaaaaggagcctgtgagtgattaaccaaccactcaatcttttcaatcttactcggcatccctatccttatcttaaacgtggagaaacattctggaaggtcagatgtctcttccagggtctcgtgactggttgctggctgagctaagagcacaacccagtgttcgtgactcccacatcagtgctctctgcttctgttctcccaaactggggcaacctaaaaaactcttgctccctcaaattagttgcgtgaatcattctagtgttaaaacattcagcaccaaattggacaaatgtgcaattatacttgcagggctccacataaaaataaatgggtataatagaatatcaagaaagtgtaaacagatgagggctggactgaccaaactaaaatcactaacctttttcccatccactgtccccagtagaatggagcgaagatttcatgtgtggcctgattgggccctcgaggagaaagtgctctccgagatgcctctgccctcagcagaacctgcattgtcacatccctatgcccgaatagccatctgccttttataatttcatctcacaagaaatggagaaagaatgcagaaaagagcaaataaatcattaaaatacaggctagtacagacaaaagcctgtttacaacccatttaaagaaaatattttgaaatgtcttttgtagtctagaatcttgctactcaatgtatgtccctgaaccagctcaatatgtcagggagcttgttagaaatgaaaagcccaggctctaccctagccctactgaatcagaatctacattttacaagatgattcatgtgcagaggattcatatgcacattccagtttgaaaagtagtggtctagaagcttcagatactcgataatgatgatatttttagtttgcctagataggctgctatagatgcattttctgaatatatttattttagaaacacttattttagaaacactccattctagcacattccacatattaatttgtttaacgcacatacttcctcaatgaggtattaactgttgtcattgctgtcttacaaaggagaacggaggcacagaacagtcaggacacttgcctgaggccccacagttagggaatgaaatcaccagcattccagcccagagtctgtctccacagtctgcgctgtcaaggactcctgaggccaccctgggccagccctgtccatactacatcctgactttgccactaaagcctatcaaagtgtgctcaaaggcaaggtaggcttttgtgtcctggagatttaactgcacacgttctctaaaatggtgagtttataaaagctcacagaaatcattttcagcattttatttttcagaagcactattgaaatttaattgttaaaatactatttttttaaaagcactttgttggcctccactagtatctctctctttctttcttagttcaaagtacatcagtggaaaataagcaccatgagagaggtcctagcttagaatttcttctgggggtaccatgagctttacttgaaaaaccaattcatccaaactataagcaatgccattttatacccattaacagtcgccctgtaaaatggaaggcattaactgattaggctttctagaaatgaggattcttaagtatgagtgatacagatatctttgttccttctgtcctgaccaccaactcctgcccatggttcaggtggtatttggtttatttgaacagtaaggagatgagggatgccttttaaagacttccccggcacagaagaatttctgtaaagcttgtaaaggaattattttctcacactagattattatgcagaatgttagatttcagaattaagagcccttatttctcatctcaaacccattctaaatactgtagaccctctccatagagatagaaaaatggagagagagtgagtttccttttgagctgtgtttcccaacctttgtaaagccatgctctcttctgatgaacctgaaaacctcaacccccaccaccaagattcttgcacatcttcccatggggcatccctccccaatttcactgatgaagactttctgatagatagtgccaaagaagaaaatttagactagaagatttccaaaggtttgctttctgtgattggtgttataaaaactgtagacacgtttatttccaaacataaaattacagtataatatgaagtatgtgtattctgatttcatgcaggccccaccccagccctaccccatggagacagtgctccatttcctcattctgcctaaagcatcactggtagatcaagtccacagctggcccattcttctatccctccataacccctcagggctcttgtcatactttctcccttttttcttttggtccttcttcattttccatttatagggctaattgtccccttactgatttctctttctctcttttctctctctaactccttttcaactttgctaccattattggaatgtagagtaaagatgctggtatcaggactttggttatgttggatgaacaaggaggtaagttcagatttcttcagtaagaacaattcctcttctgaataatgtgcattttaaaattatttgtgcatacgcagatggtcgctttgacatgtgttacacatgtacacgaatgtgagggttctagatttttcatcttgctttttttctttctctgttgaaaagattggtaaatgtatggaaatgttgaggccttcttcatgagtgaatcaatgataccactatctctgttatatatgttggggtaactgaattttgaaggcaaaagccattttttttaaatgatagtattttggacagtgtaagaattttcttattatctttgcccctaaactttcccaataaatttgattttcttctaacaatacgtagatagaatgagcgtatggcatatcatgttgtctacttcttttgaccatcccaactcagtatctagtagttttgggtatttcttaaatacctgggagctgtttttcacagaatataacctgagggaaattatctggaaaatacaacattgaaccaattgaaatatttggcctgttttaaagattattacagaaatgctagaagcaaggaaaatcagagagccagcattttaatatagcatctctatacctaacatggaaactgaaaagggtaataccatcatttttcttcatctcaatgtatctagccctatggtgagattgtacataattctagccactagtcagttacctgattccgttctgaattcttatcataataaacagatttctgcaaagtttttttctttttattcatattttgtaaaagcattagaaaattttttggagtcatgactattttttttatggcaaagataaaaatgtacaatgtattcacaacacaggaaaccttaaataaactctaagcataaatctcaagctgtgggggggaacgtgcctgacagataacagagagaaggcacttctcctaaaattcagagagcccttgcatatcaaagaaaagggcagcaacctaaaggaaaaatggatgtaaaataagacgtcatcacagatgtatgaaaccatgctctaatcaccaacaatgacaagataccactttttagagcagactggcataaattttaaaaaatgataataaccagtgttgtgaatatgttgggaaaacagaaactcctattccacagttaggcactgtaacctgatacaaatgtcttaaagaataatttgaaaatatcttcacattttaaagggcactcatctttgaccaagacactccactcctagaattttacagtgcagatatacatttacagttatatgaagtaaaatgcatgtggcttactcataatagtgtaagactagaaacaacttaagtatctgtcggtggggagaccaacccaattaattgtggtacggccataaaagaattgttctgccaccaatataatacatgaggtagatctttatttactgacttctgtggagttggggtgggagcaagaagggactggaggaagatgcctcatttggggtcccctggggagcaaatgccaggaagcaattagaagcaaaagagatttgttggggaaatgtctgtgataggtcaaggggagagctgccgggagcaggcagaggcagccttcagactatgaagcaggtctgatgcctataaaagtagatgggtactgctctgagaagccctcggccaggccaatggggagcccgagagcaaagattgctgattagaggagccctgtgttgggcagaaatgttctagcactagtagcccattgtgctcagccattggcttgaagcatcccaggaagagcctggcctcaatgtaaacactgtggcagcctgcataggtgcacagctggaggcatctggctgtcacataaaggctttcggttttacattatttatttgtattaaactttttcaataaatatataccaattgatccaaaaaatggagaaaaaagtttgaaaaaaaagttgaacataaaccccaacatttttccttcaattttcacaatacaaattgtcaaaagttgtacacaaataacaaagtctactagagttccatgttgaagatactgcagtagcaatggaagtcttaagaactcccccaatgggtttgttattattacgtgacttgttggctggatctgtgtaacaatgtcccaggctttgaaactgaggatgcagcaagtcattgcttttaaaaaaaataactaaacaacaggtgcccaatagaagagtggtacctgatttccggtgcaaaattgaaacctatacactcaaacctaggcattatcattcaggacataggcatgggcaaggacttcatgtccaaaacaccaaaagcaaggcaacaaaagccaaaattgacaaatgggatctcattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaataaccccatcaaaaagtgggtgaaggacatgaacagacacttctcaaaagaagacatttatgcagccaaaaaacacatgaaaaaatgctcaccatcactggctatcagagaaatgcaaatcaaaaccacaatgagataccatctcacaccagttagaatggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgacccagccgtcccattactgggtatatacccaaaggactataaatcatgctgctataaagacacatgcacacatatgtttattgcagcactattcacaatagcaaagacttggaaccaacccaaatgtccaacaatgatagactggattaagaaaatgtggcacatatacaccatggaatactatgcagccataaaaaatgatgagttcgtgtcctttgtagggacatggatgaaattggaaatcatcattctcagtaaactattgcaagaccaaaaaatcaaacaccgcatattctcactcatagatgggaattgaacaatgagaacacatggacacaggaaggggaacatcacactctggggactcttgtggggtggggggagaggggagggatagctttaggagatatacctaatgctaaatgatgagttaatgggtgcaacacaccagcatggcacatgtatacatatgtaactaacctgcacattgtgcacatgtaccctaaaacttaaagtataataataataaaataaaaaaatttaaaaaataaataaataaacatatacactcaaataattagcagtttcaccttatttattttttaagttaataatttgtaacttcatgtgggtggaaaaagagacattacaatggagggtagacttaggaaagatttagaatagagccttttccccccgaacaataaagcagtgacataaagacatggaaaataatatatacaaacctggaatgaaaaagagaaaacatgaataacaggcttacatgagtgataaattgcattgtactttgatgaagaaaatctagagatataatttgctgaaatcttcataaaaatgcaaaaatatatcttctttagcacaaattatctccagaatcacctatgtactattctccgagaaacaaagcagaatagaatgtctgtttgacagatttccccatgagacagttaatgttctcggctaagacatttcaattatagccataccacagtaaatgctgaattcctcagttaaacaaggatagactgggttttaccagatgtgtggtgagtagatagacactgatgagaaacacgcaactgtaaaacccccgaaagtaggtggtttctggccggtcttaaatggtacacatttcatttatagtataataggaacttaggaccttttttttttttttaattaggcagtagagacacagaaggacctttctaattgacagatgagcatgtcaacagctatcttaactgccatataagtgcattttaattttgcctttacttgtttagatcagtaactgctttgaaatttctcttcatttatgctctactaattttgtttatgcgtgagcaccaaaagtgttgactatttctacctcacagcagcacgggagcctcaagaaacagccattcttctaaagaaccatctcaaccactgttgggtcaggccaggccattccaggttgtccagttaaatgattgcactaggaaatttcctatgggattcttgctttatacccaggtatcgggagacaccaaggagcactgagcatgacaaccagacctggaaacgtactgagccctgggactttcattcctctagaaaatttgtcaccaagggaagtccccaaatgaccctggcactaatgtgggcttttacctgcatatctcttgttccttttgctggtctttgctgagttgtatgtctgttttgatgctgaagatgtgacttttgggaaaatctcctgggatcagctccaaactaaacagtgaaatatttgactactgtctgacagaagaaagacaaagtaaattcctgtccggagagtcagctatcttaaaaggttcatggcactacaaggtggcatctgaaaaaccatctctctagctaaagtccattcaccaatatctgttatgaatgactaaggctgtacttagtcatgatagccacatagggctatttaaatttaaataaatttctatatgttcataaatgctaagaaaaatgaaattcatagaggcagcatcttgtaactggatatactcatgaaggctgcatactagattaatagtattaatgcttactattcttctactgatttttactagattgagaatactaagggccccatgttggcttacttaggagagattagtagaaattttgttttcaccagtcattggaaaaatattaatggaaaacattaatatagatccttgaggattctgtcattggtggatctatcacaaataaccagtgatccaatatcatggcaaaagaaagcccaagctctggccccaacatatagtgtcacctacctgaagaccccctccctactcaaaatgttattctcctcccagcccccaagaataaacagaaatgagccagaaaacaagcttagggagatcaaaagcagtcaacactggatggtgcgttgcatcagcctcagagatgctgctgttcatcccagaatgagatgcttataagcatttcctgagaagcatcttcacagaaatcattgaagtgccatgaagtcccaatatgccaaacatctccacaaacataactcagtacactctaaaaattaatattattgctagaatttctgcaacaaaatgactccacaatattttttaaattaaaggtttgacttagaattcttatgtaaatatatattcaactgatattggtagttataaaatagtgttctgaatcaactattttctgaatagttttctgaatcaaattcagcttcagagttttctcttttagtcaaaactttgccaaattaagctggtaaccgatggcagagcccagctttctgaaatatggatttagacgtgcctgtttgtttttccctttttaatatcaattatctaattcataggtccaatacctgtgcaccaattcacatatatatgttacctcctaatctctggaagcacagtggatgggtccctaatatcttgtcagagagttaatattttggccaaaaaaaaaaaaaaattatcaactcgctttgtaacttaggagaaactcctcaagaaagacaaataattgcatatgtgtccccacgccataatctatgcttatttcagctgtcattagctgggggcagcatctctccttctgagtccagatgcctcctccaatccatctcaagcctgcattcccagaggccattagcaattacttgattgggatttggcatccctattgtctgtatatataatggttcttcatctgatgatgagttcctttccccacaccagtccctccacttgaatatttaccttgatctacagactaatttattgcattcttaaaaggaaactggagtgaaatccttagaaaagaaaaaaatcttcttgaatgtaggggattgccatatatatagccttttaaaaattttttttaattgtaatttttatttttgggacggagtttcgctcttgttgcccaagctggaatgcaatagtgcaatctcagctcactgcaacctccacctcccaggttcaagcaattctcctgcctcagcctcccaagtagctgggattacaggcgcatgccaccacgcccagaaattttttttgtatttttagtagaaacatggttttaccatgttagccaggctggtctcaaactctggacctctggtgatctgcctgccttggcctccctaagtgctgggatcacaggcatgagccaccacacccagctatatttgcggatttttttttttaagccatcactgtgcctgtatttattcggcaaaagttctcctgcactaccttattatctcctccaggtattcaatgctggataaacaatgaaattttgttttcacctgtcatttcaaaagcataagagaaatagcagattcctcatgaactgaattctgttctttagcctcacgaaagaaaacacagtaggcttttattttccaaattcacagtctggcagtttgggtcactagtgaatgtatcttagtttttttggaagcacaatttccactgtataacttaatgtgaaattgtgtttaagtgataatgtatgcccttaggctggaaatgtacttatcagttgtattctaggcatgcctttattccaggaggcacaggcatgcatgcatgaaaatacagatgaaaagaggaatggaaatgtaattaggttttgtaattagccagcgaagacatccattgctgccttcctttaatggtcttttaaagctgttttaaaaatcctttcattgaacttgtagttatctcaatttggtgatacaattcaaaaaaattaatcaagttggtgtatgtaaccttggcaacctagaagtatgattcatttttatgactattgatctatgtacttagatacactaaggtcagctatgctggcagcagtgacaccatattgtcctatgttccaattcataatcctacttccaaagagacattcattctccctgctctctgcctgggcttggagcatgacccccattatagacttggaaatcagggggcagagaagtgaaatgccttccaaaacattcatagcaattaagtcataggatgatagaggaattgcaatgttccaggacttacaatgttgctgtgtggatgttactctttttttaaaaaacagcttttacgaattacatatgcacaatcaagtgcagaccatggctacctctggctagactgccactgctaggggaagaaaagacatccatacccattgcttatgattgctgctgctgctgttgtctccaaagaagaaaatggattctattttctacccttatctggttgaggatgcttaaaaaccaaaagatggagatattttaaagttgaagcagatcctttccttagtagcgttaaactggaatgcctaaaacataaactaacaccctgtttttttttctcctggatttcactggtgcctgagtaagcgaatatgctgtgctgttttcctggacactcagaatcaaacaggccttccaccccatcccatcatgttgaattacaaagtattttgagcatcgtttggtttgtttctttccacccatacctgtgtagggcagcggtagcagtcttcaacaatgcatcctcttggacaatgcattgtaatatctctctttcaaattctgtttcacatagtcatttctcatgttctgttggagacccccaaaaaattcattccacactgtcatccctttgtcctaaccagaacaactcgatcgtgtcgaagaaggcatgaaccatatcaaccaagacatgaaggaggctgagaaaaatttaaaagatttagggaaatgctgtggccttttcatatgtccttgtaacaagtaggtactgggtaccagctctaatctgtggcgtccagttttctttctttttttttttttcttttttaatgtcaaagtgaatgtctgaagttttgtctttttttctttgtccttttccatctgcttcattctgtggggataaaatacttgtgtttaatcagaacaactggaacgcattgaggaagggatggaccaaatcaataaggacatgaaagaagcagaaaagaatttgacggacctaggaaaattctgcgggctttgtgtgtgtccctgtaacaagtaggtgctgcctgcctgcctgaagctttgatttcccaaggcccatctccaagccttgacaagctcattcctgccaagctcataggcaggatgagcatgtggcatgcagaacagatcaataccgtctccaatgcattcatctcatagcatagatgatattagcaggagttactgttgatgcattaaaaatcaggcatactacagtgaaagcttcactgtcagcaacttttattgatgaacgtttcaacattttccagaaagtgtaccttgagacagaggctagcctcaagaaagaggcacccagggaacttccttttccccaaccccaagagtcaaaattacagatttagaaaaggctgcgggtaagtttggaagatgagaaacacatatgcgaaggtttgattttttccaaaataaaagagacaggtaatttggcccagggaaggattctataaattagagaatatgacagagattctccctttctactgcccaccagttgccaaattttgtcaatagatgctgccactgcacccaacacagaggcaatgagctcttcagcaagaagtgctcaagccttactcaaattggacccatccctcccaaatttttctccttggaagatctacccgtacactggctgaaatgttgaaatgtgtagattttgcatgcacaacatcacaaaacattcaactgttctcaaggttctgcaacgcttttttggaatgtagcagaaatgtgacatgtggttataaaggtttgcaatggaaggaacctaaaactgagggttctggaagattgtctcatttgactagtggtggaaaaagaaatgcatgagtggattgcccaacatgcatttggaaaattaaactccttatccaatctccctcacccctcccacttcccccttctaaaagaagactttttcctaaaagctctcctgatcctagcttttagaatagaaattgacgtcatttttagcagattatatgaccattcacatcctttaaactttgaggctgatttaaaatatcccacttcctgtttaggagggggaggggctcatattgcaaaaaaattaaaaaattctgctttttaaagagtgatctacagtaaagcctgattaactggaatctagctaactggaaacctcagctgcatgctcttgctcccttccatttttagcaaaaaagaaacaaagaaaaaaaatcacatcagaaatgtaaaatggtttttcttccagggtagtttgcattgtctcacttagtctccatcctcctgcaacttccacatctatgaggaccaaacaataagagttgatcttcacagaaaaggccatcaagcaatcagtataaatgataaccaaggaaagattcaatcaggtcttctaccttaagactttcaggcaggaaagtggctcaggagtctagcaaagatattcactcatcatccatgaaacaaaactttcctccatggccccactgttcattaagaaagtcatataattcatcagaaaaaaaaaaaaaaagcctcattaccaagcattccagttagtcaagatttgactgtatattcctttcagtggcaacttgcccccaggtgagatttccatccatttcatgataaattccaacagatacattttccccccttcatcaactgtgtgtgaagaaagggtgaaggcagggtcccctgggatggattctgatgttctaatgaaatgatggctcctacgaattccacttttgagtggtcactaatttccttaatgcacaagagaccctaaactaagcttcaaagcttgactgaggtgttccctattgtgtgtaaataatgctttaaaaaccatgtgtcacaacgcagtggctggtggtgccctggactctctgagggcttcgccctgtctcggcatgtttcaagggacgatggtagatgtacggcagtgatgtgagtctatgtgcagcattgtgggtgcagtggtttgccttctttcagaaacgcatacttcccactcctttgactttgccaaagatggtatagcagacatttgacatagcagaaaacatcacaaagtccatataacttcttttaatctgaggagggaggagatggggagttggaaaaataaaaattaaaaaagccagactctaagccctattaaatttagtttggggatctcgtttcattgaatgggtccatggccctttggtgcaattaattttgactgcactaaggcctgcggcattatagacttgattgtgggagttgctgaaattccattggtacaattttcctgtttgtctctagggttgcttggcccccagtctgcaagtattagagccagttttaatagatggctgtggtcctctggcgaaagaagaagataaaatgttaaattctggtgtcttacaaaaaaaaaatgtgaaaatgggaccaaagaatgtctcttgtttttggactaaaaagcatatggtttctactatgtaaagaacctaaaaacatctttgattgcctttaattacaacactcaccaaaatatgctgcacatgtttctattgggcacaataggtatgcctggattttaagtcttttctccaaggcagctcagtgaaatacagcccatggagaccataccagcattaaaccactctcctccattacaaccccaggatagtttaaactaggagtttgtaagcactctctgccctgcccctcagcccaacaaagaagctactgaacctgcgtttcaaatcctcatgaaggctattactgtcctgctagtgcctttttcgagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggaaaaaaaaatattccacagggatctttgcatgatggtgtgtaaaaacttggttgaggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcaggtgagcctcatgcagcatacactgtagcagttctctattgtcaagtacaaacaactccaaaactgagtggttttctaaaaaacaaccattttattgctcattaatctacatacctgctaagtgttcttttctaagcctttcctggaccttgcctgggtggggtgatccaagatggccccattcacttgtctggtggttggctggggctgttggtggggcatgtctgttcttctccatgtggcctcttcagcaagagagcccaggttccttacatggtggtagcagtattccaagggggcaagcctcagtgcacttaccaaacctttgcttgcttaccttgtatttgccggtttcattagacaaagcaagtcacatgaccacatccagactcaatgtggcagtagacaggcatcacattccatgagtttaattgaatagagcttataaaagagactacttacagaggggtgggcaggactaataacaaggaatggtgaagcacttctgagctagcaatagcaggaagttgttaccaccatagtcctgggggacaggagaaggaatgattatcagaacccagcaatagttacgactgtgggcaaggaactatcagtagagaaatacagccactaccaaagctaacagggagtgaaagagggaaataaatgctgtagcccctcactcctcttgccctgcagtttcattggccattagccaaagcctactgaaagccagagggtaagaggagctgggtgatatagtcatgaggtcagctcctgagagcacagagcaaagaaggtccaagaacggatttggagtgaaaatagagaataatgagcttcttattaatgatttattttgaaacctagaatcaaaagccaatttaaatatctatttttaaaagttcaaattatgactcaggggcatttcctttaaaaaaaaaaaaaactcaagttacacacatcagccaattcagaactcagctctccctttgctcccagggaaagtagcccaagggttctcaagcctggctgtacattagaatcaccaggggagacttttttttcttttactaccagtgtttgggcccaatccacaccaattgaaccagaatctcttgaagtgagacacaagcacctgtggcccattaaagctcctcaggtgattctgatatgcactcagggccaagcaccattgaactagaagtatctcttagctattgatgatcatttaaataaacttcttccctacaggaaaaagccagaaagttctcctttagttttttaattttctctgccctgggctgcttttgaaaccataatgagccagtctgcattgggagttaccatgggggaaggattttaacccttctgaatattttttagctcaataccatatatactagggaaattctgaaataagtacctccttaactttcaagttggactgtgaaaaaatgtaatgtgttttgtgagccagctccttcctcccattcccattccactcaacctgaaacaatactcttttgtcacagtttcacagtttttgactctgaaatcacctatgcaccatgccactaaaaaacccatgttattaacatatgagtaaataaaaatcatcttgaacaagtagctctccttggagttcctgggagcaagcagggttaaggggcaaactgtaattatcattactcttcccattggtgtcaatcccaagtgtgaaaagagatgagcacagagactctgacttagcacaataagctttttattgtattcttaatttgagtcttagaaattttgagacttaatttgagtcttagaaatattaagaatattcttagaaagaagaatatcgtttctaattccatcttcgtgctctgacctaaagtcctttcaaagaaaatgttttcatccttaaacaataaaaattgaaataaacatatgaaggggaaacaacataatggaaggagtgagaaagtagataaattaatctatttaatataccttctttaagaatagaaattcaagggttcaaaaagcaattttaaacattttttttaaatgtatgaaagctaaaatgtgtttttgtactggatggagattaaagatagataaagttgatgcccagaggacgacagatttccactatgctttgggtccttggtattcaatatgttttccaccctctgtcttctaaaacttgctctttggatcccagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggtgagcacgtggcagtcagcaagtccctactgcgagtcacttctgaaatgaccaacaggaagtgtgaagggcataacaagatcctcaaaacacgaccttggattcaggcgcactgatagctggaaatgttcttcattttccaagagaaaaatataggactcagcaacagaattggagtgaaaataagagggtcaaatttaatccagcaaatattctcaaaggctcctgtcagccaggcattgtgctaggcactgtgggccatgtacacatgagaaagacaccacccctactgccaagaaattcacggcctatgggaggctacgagcctccagatgaattttctatcactcaaaatataattcactaagagatccacagataaaatgctaaacaaggttagataaggaaagatctcaagaggcaaagttcgggaaaatctcagaataagttgactttgaattgaatcttgaaggatggttagtattaatagtttgtcaagtggaggtggtgaagggatagaatcagaaaatgggagaaagaatagtcagtatagccaggacatgattatgagctttgcttttataaatgccaaagctttaatgagaattcaaaaatatccaggttccatttccagtttaacagttcacatccccagttctaaaaacagggaattttatatgatgaaattgagtttacacaaggacaccagacttggctctaagatccaccatgtcaacgtgggccataagaaagactggagggagtagactgggaaggggtgggtttgggggcttaaaattagaagagattggaaagaaacactggaacgttcctataaagagacctagggcaccaaaacctgatattctacaacacagaactccgacataatttatatttccatgtttcatgccctttcctcaatcagtagggtcttgaatattgattacaaactcttatgtccaaatgctaaaaaggagaaaaagagacattatagatttaacgataattgtacatctataatctactcaatgtgggtaacttatgttgtgtgtttattccctgggagacgttgaagttctttgtctgatatcctaaattttcttataataattcattccattttggtgagcagagaaggatacttttaagatttttagaatcataaatctaaatagtagtttcttggtatgcaagcaacctccaatgacttgaaaaaggagtaagtaggcataaagggaacactttgtcctgttgtgttgtacatactccatgttaaaaatatctgattgcatattttgcctgatcagtatgaaaactacgcaaactttagtgttggttggcaaaatacttgtgctttgcttacttttgcaagtaatggcatgcttatcgttgttaagaaggctttcatatgataaagcttttaaagctgtgtaaatcaatagatattagaataataatgagagtttcaaaactcactagagccaacacaagctgacctaacccattacggcccagaataatgaactaaaaaatcattgctgagctgccctccaacagaaaaaacaatttgaaaaaaacaggaagtattcattttctattaatggacccactttacttgcagatgcagctagataatgcatcaaagccaattagggttccagaaggagcgtctttactaatagaagggtcaaactcttattgacagagttgaactttaagcaagaaaatgtgttcctggaaaggcaagtggcatcttgattctgccactttgaatttctagttctcatctttagggagaaggtttttcttctacgcccagtgtactataaagacagagacatatgcagctacaaggtttaatcagaagccaggcaggtggatggataatgactatttcaatttgtatcattccttgagtgcagaatcatttaagtgggagaagggtctaattgcctttgaataactagtttccagtcagcactttaaatagccccttttttttccagaatcaaaatccacacatgatttaaatagagcccacttcaacccagcattgccccaaatgatcatgtcgcatgaactgcacaattattaatagatttccaccttctcattgaagttctcatttctgataacgggacagtatgtggaagtttcctgcatatctaagatgtaattgcaatcacactgtaggggtaaggagagtcttatgatgtttctctcataatctctcatgaccccaacagcaacctttacccagctctatcaatcatgatcttttctcatcacttggatcaatagtgaagttttgggagtccttaacaatgagattttcaatacatcctcatggattgtcaagaaattactttatttaaaaatctcgttttctgcttaagggtatttatgtatataaataataaccttatatatataaataaataactatatatattatataatatataatatatatattatatgtatatggttattatatatatataaaaaccatatataaaaataaccatatatagatataccttctaaggttaaaaacataattttttcagaaaacttactgaattggaagcaagcctatatcagagggtttatgggaactgttgctaaggaaataccttagcaatgttcaaactttgatttaaagttatcagtggtaagttaggcatgcagtcccagctactccagaggctgaggcaggagaattccttgagcccaggagttccaggctgcagtgagctatgatcgtgccactgcactcgcactccagcctgggcaacagagcaagatcccatctctaataagtaaatatataaataaaaataaagttgtcagtggtagatgacaggcacacgttggaatacagtgaggctgattctttagcagtcctcacattcttctatcagtgagaaaacacagcatttgagagctaagactttgagttctaacagggttttgccattcaccagctctgtgacctgattgcctcacctgaaggatagtaagagaactgttcaaacctaggatcagaacaggctggaagtatgaactgggttctaaaagtcacctggcatggtctgaagttgaagagattcccggagcgttcagaagatgggctgaacagctccttctaaacttttactggctctttggtggtcatcctggccttctcacaaggacaaacatgtaacatatgttgggcactccagcaaatttagaattttctaaatagaaatataaaaattggaatgggacagccatcataaataaagtcctacagcatataagtagggtgatcataggggcattctccaaataccaggaagacatctacaaggagattccagacttttttttttttttaaaagaagctaattcttttatataataaaggggcagtactttctgtgtcaaatattgcatggggtggaattttcatatgcttcagaagtaagttaggtggaaatcacagatgctcattgaacataagtctgtttcagctcctcccagatcctttaaggatatacagagtaacctcatgctctacttcaaatatccccaggtgaaggcccctcagtgcattcttgtacaggagatcctagaatgtttgcgctcaggaatgccatcattttaaaatgaattatttttctcatttgagcttttcagagcatttagtctggcaacataataattcaatctacaggaacatttcacattgctctgatcctgtaactttcctttgcactgaagtgtcattatttctgataccatttgtagctggaaagggagggcttaagaaccaagtaaaattggtgagattatccattttccaattgagaaacctgaggtcaaaaatgtgagtctgtagttcaaaacaatcaaaatcaatgccctatcttactatgtaaatactgattttaaaagacaagtgtcaattatccaaacagatgacagagaaccattgccaggtattcaaagttatgattaatctggaaatatgtttgttttaactttgcaaatttctatttgaacatggataattctaatgtcctgagaattcacgatatgaactgaatacagaagactcagctcaataaaaattgggaagtacagcaccacaataggtacaaagctggtaatcattgagtgatactggttgagagaaaaacagtttggtttccccacactgcctggcagcctcctcctcttcttcccaggctgtagaaggatagacagcattaccagtcagggaaggacaaaagaaaagcctccatagaatcgttgtcttcacctctggttgctgatgcatttttctcagtggtgatgggaatcattcgttttctggaatttaaagatttatgctggtagcagccctaggtttcatgctgcatatacagcaaacataacccaagcagtaaagagatcaaccaagagattaaagccagccagttacaaaatcatagtaaatgtgcatctgttaaagaaaagacagttattaaactcatagaaatgaatcttcagaaatgcaacttaaaaactattaagcatcccagaagcaagccaagttctcatacggtaacaataattgcaagataaactaatgagcccttcgttttgcaaaacattattccaagcacattatgtgtataaactcatttgatctcagcaaattgaatagtaagtgatgaatagtgtggactctgactccaggttgctagcattcagactctggtttctccatttattagtactaagacttcagacaaattccccagatcgtttctgactgcttttctcatttggaaaagtgagctaataatagtacacactttatagttgatattgttaatcttgatgttgtcaaagtttaatgagtggaacaaagtacagttgacccttgaacaacatggagatttagggtgtcaacccccatgcagctgaaaattttttgactcccccaaaatttaactactagtagcctactgttgactggaagccttaatgacataaaaagtccattaacatctatgttttatgtattatttactgtattcgtatgataaagtaagctggagaaaagaaaatgttattaagaaaatcataaggaagataaaatacatttataatactatgctgtatttattgataccatcagtttatatcatttgtttacaagatgaatcatcagtctgaaatcttcagtacacattaagcaattcaactttttcttgaaatgtcgtgacttttttttgctttttgggagcactgctagcatcactggtggcactttgtatgggtgcatgatgttattcaaggtttacagtattgcactaaacatgattttttttaaatgtgaaactgcaagagatcactttttactgcactatgcaatttactggagagatggtgaggatgattagtatcacagagcattttaaacggatgctcacaacacttgagttcaccacaataataggaggtggctatgaaattattagagtagtacagtatggactacagttaattttatacaattatgatttaatacttcacctttacatttctctcaactgcaaataggcccatgtatggtctatatttgtttaagtctcatcaattttaacttttcatagtagatttatatgtattttatgatagtaaataatagactagactagtatctacatatattttatccattcatgacatgcctaattttttctaaattttctcaatatttctaagtaacacattcatctgcaagtttgtcttaattgttgcaaatctccaaagcattttccagtgtatttattgaaaaaaaatcctggccaggtacaatggcacatgcctgtaatctcagcattttgggaggctgaggagggaggactgcttgagcccaggagtttgagaccagcctgggcaacatagtgagatctcatctatacaaaaaatagaaaaattagccaggcatggtggcatgcacctgtggtcttagctatttaggaggctgagatgggaggctcagttgagcccaggcagtcaagggtgcaatgagctatgatcacaccgctgttccccagcctgggcatcagagcaagaccctgtctcaaaaaaaaggaagaaagaaattcacacaaaagtggatccacaccattcaaacccatgatgtccaagggtccactgtacatgctcatgctcattagcaatattttttatcatccaggttggagaagagaaagctgagcccccaagatgtaatttgttcaaagggacactgctaataaattagccatggtttcaatcctacagtataagaagtgtaattcaacttggtccaacagatgtgaatgcctaccacagaagtcattgagtgtctttctaggatagaaagataaatcatatataagcctacgctctctggtagggaaaattattaaaaatgaaaattaaaaaagcaatgattctgaaaaaatatattcgttcattaaaaaaaaaaaatgaaaattaagcttctacggtcacattcaaatagagccatagccgtcattctgggaagacaaaagaaaggatggcccatgctgaccaaggaggttttaagtggtttcacccaagaggaagcattggacccggacccagaagggtgaatggatttttaaggggtaacctgagttctgtttcttttcccccttttctaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaatttcttcatggactcgtctgattttgcactcacacgagaagagaaagcctggctaccctatcccagctactaaaagccagttctgtgcaccgaggacagtgtgggggaaaatagaagatttaagcatgattccagtggcaactgacaacttggcttgattctcataacctgctccagaattactttgtgaattcagtgttgactaagggagaaaatgtagttatccagaacacatagaaagaaaaatttataggaaaaaaatctatggtacccaggcatggccctacatagattcaggtatatctggtgtctgtcaactccaatcttccttcctttccacaaaatccccaccatctaaaattgagggcttcactaccacaccaccactgactccatgtttttttaaacagctttactgactcactataaaattcatccatttaaatatataattaatttcttttgtatattcactgaggtagcaatctaattttagaacatctttatcactgccgccaaaataccccatacctattagcaatcactcccatctcacttctcccagccctagggaattactggtttactagttatctctatagatttgcctatacatttcatataaatggcatcatacaatgtgtggtcttcgggaactggcttctttcacttaatataatgttttcaaggttcctccatgttgtatcacagatcagtacttcattcttttttaaggccaaataatattctattgtatgcatagatactattttgtttatccatgtatcaggttatgaatatttgcattgtttctgctttttgacttttttttttttttttttttgagacagaatcttgctctgtcgctcaggttggagtgcagtggcatgatctcggctcactacaacctctaccttccggttcaagtgcttatccttcctcagcctcccaagtagctgggattacaggcgcctgtcaccacgcccagcttttttttttttttttttttttttttttttgtatttttagtagagagtaggtttcaccatgttgtccaggctggtctcaaactcctgacctcaggtgatccacctgccttggcctcccaaagtgctaggattacaggcatgagccaccacgcctggccactttttgactattatgaataatgctgctatgaacattgatgtaaaagtttttgtgtagacataagattttttattcacttgccccacagttttaccaacatcattgcctgtcccaccacaaccaccactaacacctccaccgccatcacctccaccatcactatccctactcctactaacaccaccactgcctcaattatcaccaccttaccttttccactggctctaccacctccacaccatcttaaccagcatgcccattacctccacctttattaccaccaccattataatcaccatcatcacctccatcaccaccaccgctcccactgccaccatcaccaccaccacctgaccatccatctcctctgccaacatcatcatcatcacttccatcacctctgccacctcctccacctctctctatgtccacatagtagcaatgcagatacattcatcctggttgccttggttggctgtcagataattttatccataaaagcatctctggaggtttggtgagagcaattaaggagcaagaacagtgatgacagtaaatatgagtagttctttaaccttttcacaagcctgagaacaggctctataagtagccagtggcttttggaagttattctaaggcacaatagtaacaacaaacttattccttaaaattaaggtagtagaaaggatgctagaagatgggaaaagtgaataaatttactgcatacgtcaaagctgccaaggggtcaaatatgggccacatttgaaaattctgttccaaactccatctgttcttagccagatgagtgagtgtgtttccacatcatttgagtaat

SEQ ID NO: 12183 - DNA, 43577 bp, Human
  misc_feature (1)...(43577): n = A,T,C or G
gcccataggaaaattcctcttatcctcaggttctgcaacctgggaatactgtaatttttgatatgtggttggttgaattggaggatgcagaacccacagatagggagggctgactgtatactactgggcacatgcccaagagaaatgaaaacgtatttgcacaaaaatgtgtacatgaatgttcatagcaacgccaaaaggtaaaaactttttgataaataaaatgtggcatatacatacaatgcaatattattcagccaaaaaaggaatgaagtactgacacatactacaaaatggatgaacctgttacaggtggcaggtatccaagttaccagggcaaatctgtatgggtctgcagcaacttcagttcttgcctcctcagaagaaagaatttgaccgaggggcaataaggcacaaaaagagactgaggcaagtttcagagcaggagtggaagcttatttaaaaggcctttaggaaagaaaggaaagcacgctcggaagagtcccaagctgtcactgaggtcaactgtgatattgacctcgatcctaggactttataggctggctcctttcccatgattcttcccttagggtgggctgcctccatgcgcagtgccctccttacccttgggaagtgagcacagcgcaatatgtatgaagttgtatgcgtgcccatctgaggctttcttcccttttccgatagagtccccctgaaaggtcatactccccgattttgtctcttaatgcatatgcccaggaagttgcttctccctgtcacctgcattcaacgagcactttagtgcaacaggtgtgagccatcaggaaatggcctctccctggcaccggctgccaatttatcacttttagaggcaatgtgataaatgcctaagcatcaccccacattcctagtgggtgagggaagagccctctcctgccctgctcatgcctaactacctgtaacaaaccttgtaaacattaagccagccaccaaaagaccatataattccgtttatattaaatgtccagattagttaaatctagagagacaaagtaggttcttggttggctagggctggaggagttgggaggatcaggggtgatagctaaaaagtacaagtttcttctttcgagtggtaaaaatgctctcaaatagtggtgatggttgcccaagcctgtgaatataccaaaaatcactgaacacttcaaatgggtgaattatatggcatgtgattacagtctaataaataaatagtatgtcctgctgtatccttcagggcctctgagaaatggagagagctccatctgaagccagactgagttccgatcctgcttctattttccccgcaggtaaatccttcctcaacagcaacacggggtgatacgccctatccggaaaggttgttgtaatttttaaaaacattaaaaacatacattagggttaatcatgtagcgtgtgatacacagacgctctgaaacactactgcacacgcacaccaacatggggcctctgcggagcttgtgaaagaaccagatctggagggctggtcgtgtccctggtctcggccctcgccctccttgtttcttaggctctaaagcaatcaggcagcagagcagtccttgaaccccagtcaagaaaaagccctgcaccccttagtccgaaagccgcaaggaacggggcctaagcgcctggcgaggccgccctaccgggcagagacagttgctacgtaactcggggaccagaaacccagccccacccgctgcggttaaccgacagccgcaacggttcccgcaccgcccgggtcggagaacaatgctgcgccctgcacgtagagcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcgggtgagtgcggagcaaaggggctcttgcagcttggggtcaaacagggtgcagccttgctcgtgcgctcctctgggactcatccctgagaagggcctgtggtttagacctgggctaggagtattaccctttaaagctttcaacccgctggagccttcctgggacaccaggagaagtcctgggacccgaatgcacagtttctacgagttggagcaaagggacaagacagctgcatcaaagactagtttttccatttgcttattctaagagtgcttgttaataaagaaaagcaatcagggcaacagcgacgtgtacctgccattgacagacactttgacaatggaggaacctgagtaatgctgaagctgcgggagacttcatcagaggagtgttaaaaccccgactaactggtttcttttggggaccttccgggtattctgttactgaaatatttcttaaaagtgccttatttggggatgaaaatataaaaataactttaatctctttctccatttaacagtactggctgccttcatcggccttttcattataaaatataatcacagaaatcgttgtcttaagttctggcctctctgagccgcctgctggattttatctgacttcgtaattcagtaatgtatttaggaaaacaaccctaactcgctgtgaaccagatgcagagtcgaccttaaagtattgcttttcctttttgttttagccttgataaactgaaatgccttgaggacggtgaggatccagaagtcattccggagaatactgacctggtgactttggggtatggaggacttggtttttatgacctatttatttaaacattttttcaacattatgttttgaaaagttgaaagtgcagtattgattgttgtctgtatacccaccccttaaattcagctgttcttaatatttgaccatatttactttagccgtgtgtatgggatgcctgctgtgtgttttttcattttgctatcccccattcagtaagttagacatgataatttacccgtaaatacataagcatatagcttctaaaagtatcattctcctacataattattgtggtattattatacctaagaaaaccataaatacataatctataatattcagtccatattcaaacttgtgtttattttttaatatttttgaatgtttgtttatagaggtaatctacttagatctggggggcaacctaaatactctgacagtgtttttcaaactatttgtggtaaaggacagttcttgtttttaaaaatttttaatctttgacagatttatgctttgataaaatactataaaaagaattactagaaaaatggaattaaaaaagacaaacacaatataagttcaaatttttaattaaattcaatagacaaaattattcaatgataatggaagtttctaaatgcttactgtcattttctgtacagattggttaacaaataggtcatagatgaattctggtctgcctaccactctttgagaggcactgttgtatgataatatagagaaattgtgcatgtaatagtgaaatttataatttccaatttatagtccacttatttcatactacctcagctatgttctgtcgttcttgatcctacgctattatccccctcaaatattcaggcagtcatttcaactctacttgggttttctttcataataactgctaaatctgctcccctggtccctactgctgacttttacagcagcaacacctggagcactatgcaaggttcttaagtgtctttgataagtacagtcatttctcccactgatttatccatcatgctgtcgcctgagcatgccattttgcttaaaaatggtctatggccctacatctcctatatggaaaaatttcaaactccttagctagacatttgaagccttccacatatatcccaaatttgcctttccagatttattttcaaccactttctctttcagatggctcaggatgcatgtggcctctctcccatctgaaacataccacttctatgttatgttatgttacgttatttttttgagatgcagtctcactctgttgcccaggctggagtgcagtggcgtgatctctgctcactgcaacttctgcctccgggttcaagcgattctcctgcctcagcctccggagtagctgggattaccggtgcctgcaccctcggctgcctaacttttttgcattttttgtagagacgggtttcaccatgttggccaggctggtttcaactcctgacctcatgtgatctgcccaactcgttctcccaaagtgctaggattacatgcgtgagccgccacaccttgcccataccacttttttaaaagcccaaagattcctttccagattaccacaacccatctttcccttaggaaacagatgcatttatactgccttaaactcttaacatttctaaagtccttgaaggctcaatgagagtccaaactcccatctgtgtattgttctcaagcctactatactgccttgctccaattggtgctctgtaactattgttgattgattagttgtatttgtctaaaatgcacatctgattgtcactcccttgcctaaaaccttttgatgtcccttaggctgaagtcctgagtctgtagtggctcacaaaggcctctaaggagtggaccttgctgttttcattttgttttgtttttgagatggaatttcactcttgttgcccaggcctgagtgcaatggtgcgatcccggctcacggcaacctccgcctcctaggttcaagtgattctcctgcctcagcctcccaagtagctgggattacaggcatgtgccaccacgcttaattttgtatttttagtagggacggagtttctccatgttggtcaggctccatgttggccaacctctcgtgatccacccacctcggcctcccaaagtgttgggattacagatatgagccaccgcacctggcccgaccttgctgattttttttaagctttctctctgcagtgttccagccacactgcactgtgtttcagttcctcgaatatgctctctcactccaggcctttgcccagaacagtcattcttgcttatctcctgaccttgttgacttctactcatcctgcaagtcttagctaaaggactacggactccatttaggtcatcttgtatgctcatgtagcaccctatgcttccctattgaaatgctcatcacatctgtaatatacgtgtttaattttctgtcttcttagctacacttgaaagttccttaagttacatctgccacactcactgctatattaccaattcctagaactgtggtgcatagtagggagccaacaaatatttgtagaatgagtggaataaatgaaactttcagaagactcaggcaagtgatttttagagatagactgaaaaaagaacgttgatgataatcatattaaagcagactcttttttgctatagttaataatgtattcattgatttatagtaattttgttaagccatgttaaatagtaattttaagactgcttaaacattatttcccttgactactttgcactactaggtcaactagatctctttggtttcttctagtccctccaaacaggatttgtgggtagaattatatataatctaatgtaaatcagtacggtattcttcaactggggttattttgatatactgtgaagctagtgtatttaatacatgaccattgttaaccttaatggtcctgccaaaaaaaaattagacttgtggcaaaagcctaaatttgtatctctatgctttatctttctctgaaccttccttttcctcaccaataatttcacattattatattataaaaataaaacataagtacatcatttctttattatgacataaaataaatttctggtactttttctttcccacatcaaatgaaagagctcgttttatgcatataagggaccaaaggtagttggtagatattgattcttccttgatacatgttgctcccttaatctatagcaaactacatagctttggcagttttgacattttttttgactacttagttggttttaattcctaggaataggagagataattgttaatacatgggtgctgctaaaacttacttgtcattccaaaagcttcagcaacatcacttatttatttgtttatttatttatttttagacagagtctcactcactctgttgcccaggttagagtgcagtggctcaatctctcctcactgcaacttctgcctcctgggctcaagtgattcttctgcctcagcctcccaagtagctgggattactggcgtgtgccaccatgcctggctaattttttatatttttagtagagatggggtttcaccattttgaccaggctagtctcaaactcctgacctcaagtgatctgccggccttgccccaaagggctggtattacaggcgtgagccacgacgcccagcccttcagcaacattacttttaatacaatagaaattttagattattctgcccatccccctcacttttgtgaccaagaaagcactgtttacaggtccaggatgtactgtttaaaggttaacaaaaggaacttacagagtcctgcaaaaacaaaaaacaaaagaaccatgaaattggagaactcaaaactcctattccaccaaaccaaccacaaatgattttttaaaaaaacttaaacagggtggagtgcttgaggtcaggagttcaacagcagcttggccaatatggtgaaaccccacctctactaaaaatacaaacattagctgggcgtggtggcacccgcctgtagtcccagctactcgggaggctgaggcaagagaatcacttgaacccgggaggtggaggttgcagtgagctgagatcgcgccattgcactccagcctgggtgacacagcgcaactctgtctccaaaaaaaaaaaaaaaaaaaaaactgtcaaacagctctcatatatctgaagttggctagaatgacagaaaagagcaccatcaaactgggaatcttgtaaactatcactgtgccccagatgttacaaaaatgagcaagaggaaataaaatctaacgagagcttgttgcagataatcaggaaataactgtttatacagatcaactttggagactacctgttccactcggaaacaggtaaagcctgttaagtctagccggtcgtggtggcgggcgcctgtagtcccagctacttgggaggctgaggcaggagaatggcgtgaacctgggaggcggagcttgcagtgagccgagatcacgccactgcactccagcctgggcgacagagcgagactctgtctcaaaaaaaaaaaaaaaagagaaagcctataagtctgtactccaaacagaattgaatatactcaaataagcatttgagggtataaaaatgtttaccttggcttagaatttttaaaactattaataagaatggaaatgatgactaaaggagaaatgaaaaaagagttgatgaaacaaagggaagaaatggaagaaaaagacaattacctcataagtgaataaattgtaagatacctaagggaaaatagactgaaatgaaagcaagaggcaatgaagaaaggcataaaaacaacgaagagaattgaaaatgacaaagaaaaaagtaagatgaatccgagaaagtagggaatggtaggtagataggcaaagacataatattcatattatcagagtccctgaagaagaaaaagaaatggaacataattcatgtttaaaaacataatccagcaaaagtttccagaaattgaaaaaaaaactaaatctagaaagggttccctaggtacctggaaaaattaacccagacttattgacttttgggatatattttagtacaactattagatttcagagataaagatgaaatcatcaagtcttctgtgcaaaaagaacatataacttacaaaggcaaacttacaaaaagcatcacatgttgaaaaactgacatacaaagcaaggcaacatagagcagtgtttttttttaaagctcaatgaaggtgtgaattgaaggattttatatctaactgaatgttctcaaatgtcaaggttatagaaaaagagttttcgacataacgaaaacctgggtaatttctgtacctgctggccatttctgaggaatatacaagagaatgagctttatccaaccaattgatgactggaaaattttcagcaaaaggactaatacagagaggatgagggtggaagatttgtgtaaccgttgggtattgcaacaaagtacagtattgcaactaaaatgatggaaggagaaaaatggataatgtgtgggcaatagatgggttttaaagactactgcagaggagaaaaaacctgacacaccagatagtaaagtgttaaataagaaaatgggtaactctaggatttaaaaaatgtgagtagaaaggtaaccagtagaacaataatagaaatatcaactccccctcaatttctaaaaattaaatggaaaagaagggtatgcatttcataatgaaaaacagctattacaacaaaatacaaataattagaaaatattgtgatagagttgagaccaaatacattagtcttaagcaacctattaaaaaaggattttcaatttggcttgtaaaacaaaaatcttgggatgacaagagacacatctaaaataaaatgattccgaaaagctaaaaataaagggttagaccaaagtataccaagtaaatggaaacaaaaatcaagcaggagtagtgatgctgatatcagacaaatagtattcaagccccaaagtattacatgtgataaaggacactttttaatttatatcttatggaggtacgtatacataaaatttgctccctgctaatgagaactgtatgacatgttcacaaaaattgattatgtattaggtcacaaaggaaacatcaatgacattcataacatagaatattactaacaggttgcgtgcagtggctcatgcctgtactctcaacactttgggaggccaagatggaaggattgcttgagccctcgagtttgagaacagcctcggcaagatagggagaacctgtatctacaaaaaataaaaacaattagccagctgtggtggcacacacctgtgctcccagctactcaggaagccagggtggaaggatcacttgagcctaggagattgaggctgaagtgagccgtgattttaccactccactccagcctgggcaacagaaaaagaccctgtcaaaaaaacaaaaagaaaataaatttccagctcagaaaacaaaaaaagaacaacaaagtaagtgaaaagaaaatactagaaaggaaataataaagataacagaaattaatgaggaaaataatactttttgtccgagcaatcccatttctagtaatttataccaaaggtacccctccaacaatatgaaaatacatgtgttcaatacttactagtgatgtttagcttgtttctgtctgcttgttattccttgcagtattgtttgtaattgcaaaatatttgaaataccttaaatatacagacgtaggagaggagagtgttgaatacgctatgggaaatccacacggtaatattttgcagctagaataaaggatgaggaaggattaattcagagtaatttccagtacattctattaagtgaaaaaagcaaagtcccaaagtatatgccacctttcatgtaagaaaggtgtgccaggtgtagtttattggctctcatcttcaaatttacctctttttcctgctctgtaaaaatggaccttggccttttaaatacttttcttttgccaactagcacatccttaagctttgtcagtgaagggcaatggagagacttctcaggagtctcaaaggttttgcttcctgatctgatgtgctggctcagcaggatcctgcagtgcacacagcttccccagtgcccagctcctgcaatacactgcagtctgaagcaccccgcgcccagcagctttcctgccaaccccatttccctccacagctcccctgaacaggttttcctagtgcccttgagggtggatttccagcaagttccactgatgcagtaccatagcaacttctttctccagctcgtctggatctctgtccaggaagaaaaaaggacttccctgtgctctttctcagccctaggggtagggtgctccttctgtttgctattattctatactttagtgttcccttttactgcttccttgccaatccctcattattccaatcctctgttaaagttattgaatccttaacctttgttcaaattgctgttctttttttcttcctaattgaactcagattgatacaggagataacagagtatacacaaatatctgtttatttgaacaaaggaaatggaaaggacaaaccaaaactatagagattgattgcctgcaggggtgggtgggaaaggggtggaaagaagggagggaatgggaacaggttagtaggaacaaagagggagtgacacttttgactcttaggatcatagtaatgtgtcacatatttttcacacaccccaaatgtaatcagacaattaaaaccaactaggatgtagggggaacccaaaactgaattcaaaaactaaaaaataaggctagttgtattacggatgtgtaatataacaccactgaaaagggtggggaagaaagaactaaagtctgtattaaagcctgtctttttttttttttttttttttttgagcacttcatgaatttgcatatcatccatgcacaggggccgtgctaatcttaaatatattgttccgatttttaaataataaaatgctaccaaaagcgtatcttgatataatgtaaaggtgaagacagaactgtttataatttagtgtttctcacaggggtataggttagcaattctgtaactattttatgtatttactagaattgaacaaatcataggttgccaacagtgaaagctggatttctcacttgtggagaaagacgttataaacaaggaaatgttaaaggctaaaatgaatcctgtggttttagtttgggatcagaagtatcagtataaacccatagttttaaatgtatgacagtaaaatacagaaatacagatatttatacatgtataggttagtatacatacatatatttcctgcctatctcagctgagaggcctagaagcagtgactccagtaacaatgagaacgcctagaacccagatactggtctctaaacacctttttccagtaaaggaactagggctcttacaagtggttgattccggggacgagacaagaaaaatataggatgggccttgagcatcttgtggtgccggaaagtaagggaatattaaaaaaataaaaaataattttaaaaaggagaggacttgctgaaagaacgggagctcctaatgataaagctgtaccaatttgaacaacaaaatagtgatagtattagattttaaccccagaataaaacaattatctgtaggttcatactaatagaaatgatgaaataaacagatgggaggaaagaggcaggtcttcctcaaaatataattccaatgaataaatgtagaagatccaatgaataaatgtagaagaaagtaaagacagaattgctattaggcatacagcacagtaataaatgttgcagacataatctatcagtgaatgctaaaattcatgggtgaagtttgaggagaaacaagatttgcatagtgtcaaagtatctcccccaaaatatttaccaagttcatagaaaataaggtgtctttctggtgcaggaacctggcagacagaaacaagctaaacatcactagtaagatgtcatattaatatcatgaacatcttgatatgatataatgagaagggcatcattgtagtattcttaccaaaatgctaaatttattcctatcatgaggaactagcggtcaaacccaaattgaaggacattctataaaataactgattagagctctttgaaattgtcaagatcgtgaaagataaggagagactgaagtattttaacaaactcaaggagactaaggaaaaataacagatgccatgtgggatcctggataggaatctggaacagaaaaaaaaaaaaacgagtaaattaaaaattgtgtgaaattttaaaaaggcgtatagctaataatattgtgtaagaatttatttcctgttcttaattgtctcatgatcaagtaagatgttgacataagggaagctgaacaagagatagaagggaactttttcctgcttttgctacttaaaattagttcaaaataaaaaaacttgaatgttaaatatgtttttgaagcccgaataacaaatgttgaactttgatttttttttttcttttacatctacaacagggttagaaaaaggttcttggaacatcgggaagaaaccattacaatagatcgagcctgcagacaagaaacattcgtttatgagatggtaattaagagtctcatctttttcacccttttctcttaaaacagtaaaccgacattggctgagggttagtaatgacagtatggtagctttatactggatatgcttagttgaaaacaaactagagaaactcctttgagtctgggaactagtgagagaagaggacccttagaactcaagtgaccacatgtttgactttttcagatctctgcctttattcttgtttggttttatcttgctttcgatattaggctaaatttatgccttttcactaccctatttctggtctttttgttctgctcctgattttggtttaaccacattctcaatcctcatctattatctcttgtgtaaaactttgggaaaatttaagatgatgactcttgaggaattaggagctagtagacacgataggttcagaatcaatgtgctaggcactgtgctggcacttgatcatgcatacgggcacctattgtctctcccacttattttacttttattgtggtaaaatttacataacataaaatttaccattttgaccattttaaagtgttcaattaagtggcaataagtacattcacaatgctgtaaatcatcaccatttccagaactttttcatcatcccaaacagaaattccatacctgttaagcaataactcaccagttttccctcctgcagcccctgctaacctctattctaccttctttctctatgaatttgtctattctagatatctcatgtaagtggaatgcttttttgtccttttctgtatggcttttttttttttttttgaaacagagtctcgctgtgtcgcccaggctggagtgcagtggcgccatctcggctcactgcagtctccgcctcctgggttcaagcgattctcctgcctcagccttttaagcagctgggattataggtgcctgccaccatgcctggctcatttttgtatttttagtagagacggtttcatcatgttggccaggctggtctcgaacccttgacctcaagcaatctgcctacttcggcctcccaaagtgctgggattacagtcgtgagccacagcacccagcctatggcatattttacgtagcataatgttttataggttcatccatattgtaacgtgtattagaacttccttcctttttatggctgaataatatctattgtatgtatacaccacgttttgttctatttatccgttgatagacatttgggttgttttatcttttggctattgcgaataatgctgctatgaaaattggtgtacagatatctttttaagtcctttttcatttattttgcgtctgcccctaggaatggaattgatggattgtatggttaattctgagaaacctgtttttcatagcaatgataccgtattacattcccatcagtaatgcatgaaggttccaatttctccatgtacttgtgaacatgtgttttctagcttttttttaataatagccatccttgtgggtgtgaagtagtatctcattgtggtttcgatttgcatttccctaataactagtgatgctgaacatctttttatttggtttttggccatctgtatattttctttgaaaaagatctattaaaatattttgtccattttcaaattgggttgtttatcctgttgagttataaagagttcttggccgggtgccatggctaacgcttgtaatcccagcactttgggaggccgaggtgggtggatcacctgaggtcaggagttccagaccagcctgaccaacatggcgaaaccctgtctctactaaaaatacaaaaattagccgggcgtggtggcatccccctgtaatcccagctactcgggagactgaaacaggagaattgcttgaacctgggaggtggaggttgctgtgagccagtatcatgccactgcactccagcctgagcaacagaatgagactctgtctcaaaaaaaaattagccgggcgtggtggcaggcgcctgtaatcccagctactctggaggctggcaggacaatcactagaacccaggaggtggaggttgcagcgagcccagattgtgccattgcattccagcctgggcaacaggagtgaaactctgtctaaaaaaaaaaaaaaaagagttctttgtatattctggattctagacccttaccatataagtaatttaaaaatattttatcccattctatatgttgtctttttacttacttttctttcttttttttttttttttgagacagagttttgctcttgttgcccaacctagagtacaatggagcaatcttagctcactgcaacctccatctcccaggttcaagtgatgcttctgcatctgcctcccaagtggctgggattacaggtgcctgccaccatgcccagctaatttttgtatttttagtagagatggggtttcaccatgttggctaggatggtctcgaactcctgacctcaggtgatccatgcgcctcggtctcccaaagtgctgggattacaggcgtgggcaaccacagtcagcctttttactttcttgatactgttgctggatgtacaaaagtttttaaatttgatgaagtctagtttatctttttcttttgttgtccttgcttttgatgtcatacttaaaacattgccagatgcagcatcatgaagattttcccatatgttttcttctaggagttttatagctttagctcataagtttgtctttgatccactttgagttgatttttatatatgatgtaaggtaagggtttgatttcattcttttgcatatagctgtctattttttgcagactgtcctttccctagtgaatgatcttggcccttttgtccaaagtcagttgaccatataagtttcattgttacattctatcggtctagattctaacctagaactacactgttttgattactttggctttgtagtaaattttgaaatcagggagtgtgagtcctccaactttgttcatgtttttcaagattgttttgactattcagagtcccttgaaattccctatgaattttaggatgggtgtttctatttttggaaaaaatgccattgggattttgatagggattgcattgaacctgtagattactttgggggagtattgagatcttaatgatatcaagtcttccaatccatgaatgagatttctttccatttatttagatatttaatttcttacagcagtttttttttttttttttttgagacgaagttttgctcttgttgcccaggctggagtgcaatggtgcgatcttggctcaccgcaaccttcgcctcccgggttcgagcgattctcctgcctcagcctcctgagtggctgggattacaggtgcatgccaccatgcccggctaagtttttgtatttttaatatagatggggtttctccgtgttggccaaactggtctccaactcccagcctcaggtgatccgcctgcctcggcctcccaaaatgctgggattacagacgtgagccaccgtgcccagcctatcagcagtgttttatactctttatgtatacaaccctttcacttccttggttaaatttatccctaaatattttattcttttgaatgctattgtaagtgaaattgttttcttaattcctttttttttttgagacagtcttgttctgtcacccaggctgagtgcagtggcacaatcttggctcactgcaacttccgcctcccgggttcaagtgattctcatgcctcagcctcctgagtagctgggactacaggcgcccatcacaatgcctggctactttttgtatttttagtagacacagagtttcaccatgttggtgaagatggtcttgaactcctgacctcaggtgatccacccaccttggcctctcaaattgctgggattacaggcgtgagccaccgcacccggccctgttcctattttctttagtgtttttatcatgaaagggtgttagattttgtcaaatgcttttctgtgtcagtcgaggtaatgatctgttgttttttttttttttttgccccatcattccattagtgtggtgtattatattgattgacttgctaatgttaaattacccttgcattttgaggataaataaattccacttggttgtgggattcaataaaaattgtaatcataaaaagtaccttttcttatcataactgaatgacattagaaatcaataacagaagaaaagttggaaaattcacaaaaattaaacacatttgacaaaagccttttcatatgcttctgaatttgctttgctagtattttgttgagattattgcattcctatttataaagggatattggcctgtagttttcctgtagtgtctttgtctcactgtggtatcaagataatgctggcctcatagaatgtgttaggaagtgtttactccttttgaaattttgtgaaagagtttgagaaactctggtattaattcttttaatgtttggtagaatttaccagtgaagtcatctggttctgggcttttctttgttgggaggtttttcattgctgattcaacctccttacttgttacaggtctatttagattttttatttcattttgaatcagttttgatagtttgtatgtttccaggaatttgtccttttcatctaggttatccaatttgttggcaaacagtagttcatagttttctcttctaatcctttttttcctgtaaaatcagtagtaacgtctccacttttacttctcattttagtaatttgagccttcttttttctcagtcagtgcagtaaaagtttgtcaaatttgatgttttcaaagaaccagcttttgtttttattgatttttctgtattttctattctttttcacttatctccactcatctttataattttcattttttttgctagctttgggtttagtttattcttaattccttatctagttattgagattgttcttttatataaagttatacagccataactttttaaaatcactctttttactatatctccctaagtttcctatgctgtgatttttgtcgagtgttgttaaatttccacatacttgtgaattttccaatttttctcctgttattgatttctaatattcacttaatgatcagaagagttacgtttattactttaattttttttaatttaagatttgttggtgtatcctggagaatggttcacatgcacttgagaagaacctgtattcagctgttgtttggagagttctttgtatatctgttgggtctaattgttctcgttgttcaagtctcctgtttctttattgatcttctatctagttgttctacccgttattgaaagtggggtattaaagtctccaactattaccatagaactgtctatttcttcaattctgttggcttttgcttcatatattttattttacttatgttttttgagatagggtcttgctctcttgcccaggctggagtgcggtggcgccatcactgcgcattgctgcctcaacctcctgtgctcaagttatcttcccacctccacctcccaagtagacaggactgtaaacttgcgccactatgctgagttaagtttttgtattttttgtagagatggcgttttgccgtgttgcccaggctggtcttgaactcttggactcaagcaatctgcccaccttggtctcccatgcttcttatgttttagagttctgttggctttatataagtttataattgtatatatcttcttgctggatggcatcttttgccaatatataatatccttctttgtctattgaaaccttaaaaaattttgtttttagaggtgggtcttgctctgttccccaggctggcctcaaactcttaggctcgagtaatactcccacatcagctttctgatagctgggactacaaacacatgccaaaacatcttatttttctgtaacttaaggattactttgttttttttgagacagagtctcactctgtcacccaggctggagtgcagtggcccgatctcggctcactgtaatttctgcctcctgggttcaagtgaatcttgtgcctcagcctcccgagtagctggaactacaagcacccaccaccacacccggctaatttttgtatttttgtagaggcagggtttcaccatgttggccaggctagtctggaactcctaacctcaagtgatccacctgcctcagtctcccaaagtgctgagattacaggtgtgagccactgtgcccagccaggattacaattaaatcttaaaattgaaacaacttacttttaattatacacagtcctcaacctactgtggtttgacttaggatgttttgactttatgatgggtttattggggtcttaaatgcattttccacttgtgatgtattttatttatggggtttattggggcataatcccatcattgttgaacatttgtgtcagttttgtttctataatattcaaatactctgcttccacatctttgtctgtccctctttgggttgtcacagattatgtctttatatattgtgtgtccattaacataaccttgtaagtattgtttaatccatttattttgcaatcatataggaaaaacagaaaaatcgtagaggagtgagttacaaaccaaaagtacaataatactggcttctatatttacctgtgttgttccctttagcagtattctttatttcttcttatggcttcaatttactgtctagtgtcttttcatttcagcctgaagaatcctctttaacacttcttacaggtcaggtctgctggtagtaattaattcccctagcttttgtttatctgcaaatgtcttaatttctccttcattcctgaaggatagttttgccaaatacagaattcttggctgacaggttttgttttttttctttcatgggtttaaatatgtcacccaaaaaagaaaaacaaaagtaaaaaaatttaaaagctgaacacagtggtgggttcccatagtctcagttactgagaaggttgaggcagaaggagcacttgatcccaagagtttgaggccaatctaggctacatagatagatagatttaaaaaatcagggccgggcgcggtggctcacgcctgtaatcccagcactttgggaggccgaggcgggcggatcacgaggtcaagagattgagaccatcctggctaacacagtgaaaccccgtctctactaaaaatacaaaaaattagctgggcgcggtggcgggtgtctgtagtcccagctacttgggaggctgaggcaggagaatggcatgaacccgggaggcggagcttgcagtgagccgagatagcgccactgcactccagcttgggcaacagagtgagactccgtctcaaaaaaaaaaaaaaaaaaaattggtcagtcagtccatccgtctatctgcccattctctggtttcttaacctccatgttttctgatgagaaaactcctgttaatcttattgaggaatctgattttctttaagtatttggtttcctttagctaactgaacacatttttaaagttgatacataatgattgtacaaatttctggggtactcattgagcacatttaagtcagttgctgtaacgtctttttttttttatttaacgttattattatttttttaatttcattttcttcattttatttcatttatataccctgaagtgggatgactgaatcatgtagtagttctacttttaattttttgagagacctccgtattgttttccgtaatagctgtatcaatttgcatccttgccaacagtgtgcaagagttcccttttcttttttttttttttttttttttttagtatttattgatcattcttgggtgtttctcgaggagggggatttggcagggtcataggacaatagtggagggaaggtcagcagataaacaagtgaacaagggtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccacccttaatccatttaaccttgagtggagacagcacatgtttcagagagcagggggttgggggtaaggttatagattaacagcatcccaaggcagaagaatttttcttagtacagaacaaaatggaatctcctatgtctacttctttctacacagacacagcaacaatctgatttctctatcttttccccacatttcccccttttctattcgacaaaaccgccatcgtcatcatggcccgttctcaatgagctgttgggtacacctcccagacgcggtggcggccgggcagaggagctcctcacttcccagaaggggcggccaggcagaggcgcccccccacctcccggacagggcggcggccaggcggaggcgctccccacctcctggatggggcagctggccaggcaggggctgccccccaacctccctcccggacggggcggctggccgggcgggggctgccccccacctccctccgggacggggcggctggtgggtggggggggtgcccccaacctccctcccagacggggcggctggccgggcgggggctgccccccacctccctccggggcggggcggctggccgggcgggggctgcccccaacctccctcctggatggggcggacggccgggcgggggctgacccccacctcccttcttgactgggaggccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaggggctcctcacatcccagacgatgggcagccaggcagagacgctcttcacttgccagacggggtggcggccgggtacaggctgcaatctcggcactttgggaggccaaggcaggcggctgggaggtggaggttgtagcaagccgagatcacgccactgcactccagcctgggcaacattgagcactgagtgaaggagactctgtctgcaatcccggcacctcgggaggctgaggctggcagatcactcgcagttaggagctggagaccagcctggccaacacagcgaaaccccgtctccaccaaaaaaatatgaaaaccagtcaggcgtggcggcgcgcacccgcaatcccaggcactgggcaggctgaggcaggagaatcaggcagggaggttgcagtgagccgagatggtggcagtacagtccagctttggctcggcatcagagggagactgtggagagagagggagagggagaccgtggggagagggggagagggagagagggagagggagctaacgtctttgtttagtggacttttatttatgtgcgaatgtaactattgcctgtaggaataattaattgacactttgactagtaattccaatgtctgggcttcctcagggttggttttgtcaaattcttattttcctaagagttgtccatactttcctctttttttgtgatttatatgtttttttgagaactagacattctaggtatattttttcttgtgcatggctggagctgcctgtgacttttccaaacgattattgtagcacgtgtattacttgttgtacgtggtcactgatgtttctgtttcattctctctgcggtcaatcagtgatctgacaaagatttccttaaatacctggctccaaaaagaaaaaaagcatcttgtctgtaagtcttccaatatagatcctgctgggggaagctgctgccaccaagagggtgaaaaccaatgcacgtacctggaccaggcactcggcatcaccagaccaaccaaaacataaaatcctcagttcttagagaacaggtccccactgcctgccttggcaccagccagcttctccaggaattccagctgcctgtctcatcggcgaggggcgaaggagtgagggtggtagttgatttgcacacagtgcttactaatgaaaagcagcaacttctctcgtcatcaaacactcccctgattgttgtaagtgtcccatcaggttccagagttcccaaatagtttattccagtctctcattccagcttactggttgcttctgttagagggactaggccctggagctgcctactctattttgtgacatgattcccacttatttttaaaactcctgcatctaaaccagttcagcctggcccctattttatattaatttagcacacataaaagatcaaaatatattaaagatgtcatggtgttataaaaagcatagggtttagagccaaacaaatccgtatttgcgtcctaactctggtatgaccttgagtaaatcactgaacctctgagctttatctgtaaaatagctttcacaggaatatttgataaggaatgtaaaaatgtaactggaaatgccagtgttataccaacattagttgatactactgtttgctcatcaactgctaagtactcagtaccacacatcttatcagatgcattgtgtacacattcccagcaacagtacagtaagtattttctggttctgtttgtttattgaaagaagatgaaactaaagcttagagatgtcttaacagttttcccagagtataattaggtgtcaaacccaaggctgcttgactcgatcccttgctgatagccattgtaccacactgcatcttatctgagttatagtatctgatttcagtgtctctttttctttcttcaggagtcacatgccataggaaaaaagcctgaaaattcagcagacatgattgaagaaggggagcttatcctatctgtgaatatcttgtaccctgttatatttcataaggtaagtagtaaaaccttttggattttatggataatagtaacttttgtaaaagtgtttaattatttgaagagtcatattcctatgcttacattaaaaataaacactctgggagtggtggctcatgcctgtaatctcagcactttgggaggccaaggcaggaggatcacttgaggccaggagtttgagaccaacctgggtaacacagtgagaccttgtctctactaaaaatcaaaaaaattagctaggcatggtggtgcacatctgtaatcccaactacttgggaggctgaggtggggagatcacttgagcctaggaattcaaggttgtaagcgagctatgattgcaccactgaactccagcctaggagacagcgtgagaccctgtctaataaatgcaagcatatgctgcctatctgatgtcttatttttagagttgacaatctataatcttgtgccatctgttctaataaggaatattggaaataaggtcaaatttcaaacaatctctcgatccagtaggattacaggtatagtattgaaatatatgcctgatttctgcactagaagcaactgaaagtatatgtaaatccataatgattctaattctactaattcttgagggatttttgcagaataggtggctaatggaggaattagcctatgttcactaatttagaatacttgggaagttattgaactaaccagaggcagctcttctttgatgaaaatacagaacattattaagtcaagggtatctaggaatctcttaggagaaagaactctttcctaggccagagtgtatatattcttgattccttaaatagatgtgtcataaattctgatgagttgtcattgaaatattaatatatataagttgcacttatgaataaataggcttttacaaagcatctgggatgtagttagtactaattatcttatttgattaagatctcaaattgctggctgggtgtaatggctcacacctatatcctcagcacctttggaaggctgaggtgggctgatcacttgagctcaggagttcaagatcagcctagacaaagtggcaaaacctcatctctacaaaaaatacaaaaactagctaggtgtggtggtgtgtgcctgtagtcccagttactaaggaggattgcttgagcccgggaggtcaaggctgcagtgagccaagaccatgccatggcactccagcctaggtgacaaaatgagactgtccctcaccgccacccccttctccccagaaaaagatcccaaatgaccaatcataaaaagaaaccaaaccaaagtatgaatctgggtttataacctcaggttacagtatagattgcctgacctcaatgaagtaacttttaggaaattttaagacagtcttgctaaatgaagttacattccagtggatcttaatgctcatgtcagtttggtatcatcttgattataaacttcagtttaaaccagaaaatttccatggctgagtatgtcagttgtacccatgggatttttgttggtttgtttgtttttgagacagggccttgctccattgcctaggttggagtgcagcagtacaatcatggctcactgcagcttcgctcgagcaatcctcctgcctcagcctcccaagtagctaggactacaagcatgtatcacaacgcccagctaacctttaaattttttgtagagatggggttttgctatgttgcccaggttgatcttgaacttctaggctcaagcaatcctcctgcttcggcctcccaaagtgttgggattacaggcatgagccactgtgcttggacattccatgctattctaatttatggagatgactgagtgatgacatggagaggctataatgcctttgaaaggagatttttattacatttccttagaggagggggcacaccatgtagggccacaggaagaagcatcattctcatttaggaggctgaaaggggagaggggaaggcatagaccacagtttttattggggtttctgtgggaaagacaaggtagggaagagtaaacagtttaggattggctagttcgaacaattccagtaggtttggtggcagaggggctgtcccttgtagcctggtgcttggccctgggtggattgaggttgagggaataccaggggaaatagtggcttggtgtgtaataaaggaggtggtttcagagtggctctggatcacaggggagatgtaaacaattttgaccatgagtttggccctataattattggatgtgaaaatacagagcatcaagttatggggacaatttaaaattaagaaaaccagcaatttaattttgatctagtcatgacaggatttgtagttttatcgctttgtctctaaatgaacacttatttattctttgacttttagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagtaaggtgatttcctcccataaaacaaaaggaaataacaagctaagaaaatagcgattactctagctggttcataaatgtcccagtaaatccttttcttctcctgcgggattccatcaaactactacactatctcattccttccctttatcaccggaacttttccaaagaagaggctagactctgttttgatttcttcatctctcatttgtttctaaactattgtatggagacttttccttctgggctaatagggaccacctaattttcttttttgttttttttttgttttttgtttttttgagacagagtctcgctctgccgcccaggctggagtgcagtgtcgccatctcagctcaatagtgaccacctaattttctaagcagttggtcacttttccatttttatgtaacttgacctcactgtagcatatgactttgctgttcattcactcgtttgaagctctgtcagagttgtgatctgtcatgattgtgcccagcaaaaggctggagtcgacctgagagcctcaaatagttagcacccattcttcacctttcgctgcccaaggaccaatacccaacaaggagagagcatatgaagttggtccttgctggtgtttccccaatgtgttgctctcaaaaggaaagagaagccctgcataccccctggataaggatggaaagaagcagtgtggtagactggctacccacaatgttttcagaaaggatcatttacctaataaagcaggagggccttgatcccttccacatttcatcatagggcaggattgaactaaacctgctacaactctggcagagggcctcaggtttacagggccatttcaggggagggatagcatctcctagagataagtaaaaagatatttggaacaacaaggatggagatagtgtttggacaagaaccaacacaatctccttttttcctgggtcctgttccaccagccacataaatgttggtataactgaggtttcatgttaacttttttttttctccctaggctgacatataaggccttttataatgatgcttcccaaattaactttctgaactgtttacttgctgcctttacacctcattcatccatagtgaatttgtgtattttcatcagtgtaccatactttttcatgtctctgagtatttgaacatggtaggaagccctttccctacttcatccgttttgtgagttcatcctcagatttccaaacccagctcaaaactcaccaattatatgcaatttttcttgactcctttctttgttaccctggcaccttttcttttgtccattgtagtatgtatttcagtatgctgattcagtgtaatgtgtgtccgtctgctccacaggctgactatattcgtttttggtgactagtgtggagactagcatatggctcacatgtagatttcacttaagtacctgttgagttatgctgaaaatggtttttagatatttaggttcttcagggttgccatctcagtgcttttggagagaaacaataggataagaaaagtagaatttcaaaattttacgcggagcaggaaatacgagatttatctttttctttcttttttttttggatggggctctgttgcccaggctggagtgcgatgatgcaatctcggctcactgcaactttcacctcccagtttcaagtgattctcgtgcttcagcctcccaagtagctgggattacaggtggccccactgcgcccagttaatttttgtattttttagtagaaacggggtttcaccatgttggccaagctggtgtcgaactcctgacttcaggtgatccacccgcctcagcctcctaaagtgctgggattacaaggtgtgagccaccgtgcctggccaagatttttctttaaagcagcggtggcaatcttctgcaaagttttttaaccttgtcaaaaaaaacgtaagatgtaactgttaaataataagatcagtctaagaagaaaaatctgaatttaccctcttcactccaaccatctgaacattgctcaaagcagtttgagtcagatctgggaatcggtcttaccttcaggaaaccctggagaatgtttgtctgtctgttttttaatcaagtccagtctgggcaacaactcactgtgttgcccagcagaaggttttaaccaggctttgtcaatttacttggtctgtacattgctgctgatagcttcggaagttttttaagcagggattaaataacccataattgtattttaaaatgtttacatatctcctgttatattgtttctgtctcttctattattattatatatatatatatatatatatatatattttttttttttttttttttttttgagacagaattttgctcttcttgcccaggctggagtgcaatggcaccgtctcggctcactgcaacctctgcctctcgggttcacacgattctcctgcctcagccccatgagtagctggaattacaggcatgcaccaccatgcccggctaatttttgtatttttagtagagatggggtttctccatgttggtcaggctggtcttgaactcccaacctcaggtgatctgcccacctcagcctcccaaagtgctgagccaccaggccagtcagggaagtttattagtggatgacttttgatttaaatggaaaacatttttgttcttttagagttcaccttgtaattaataattatgccaaaagatagtaagttgcttaaatcacctaagatgaagttttatggcagtgttttgtaaaacacatatatattaaacttcattttgtttccaaaataatagttatttttttagaacctttattttggaccctgcttacctctttgagggtgtagaaatatattaagtggcagattttgtattgtagcagctagtcatatgacattaagtacattatacttaatgtacataatctccataacaacctatgaggaaagtaaaggctttactcacattttacatgggaaaacagtgtgagtgagatttagtgactggtccaagaagaaacaacatagccagtcttgcaggagtgtctgatgcgaacacaagataatctgtaagtgggggaatgaagacaagaaagaaaaatggaagcttcaaagaactaggagaaaaattaaaatattacggtaaaattattttagtacctgaaacatatctcctatacataaattgcttttgatcttcaccacaatcctgtaagacatcgtggcagatattattattctcatttcacagatgagaaaacaggtctgagaagtgattgctacataccaaaatcacaaagctagtaagtggtagattaaggaaaagaactcaggtcttctgaccctcattcaggagtctaaatagaaggtgaaggaccagtttaacagagtgcttctcaactctggttgcatgtttttttctagagagctttggaaaaatactgatccccaaagattcttaattaatgagtctgagttgacacttgtgtttggtgtttttgtgatttgattttgcagtcaggattgagagccactcctttgacggacactgtggtagaatgagttaagaacccttgaaggttccaaccagttgtggtacaactacagtacctggggcaagattgcttgagtaaaaatagaaattcagattctgtctgcctaagagttactgaaaatataaagagagaatttttgtaaaaacattgcaaatacaaaaaaatgccagaaaaacatagctcgatgatcattgttactactggggaaacattaaagataggactttgtttaggttttagttctagtatccaacactacttactgctctgtaagtataataaaataatgatgtttatttgatttctaattgggttcctttcatgaatctcaggagaatatacacatttagatcaaacgtagtgattataacagcaatagggtaaaattgaaaatagtagcagtttttgtaacacatattagtgtgattttatgatatatctattttgaattaatacttagagcaatttcatcattgttaatagttgattttctctcaatacaatctgttttcttgtaggacctatacaaatcagccttcttttattttgaaggaacattttataatgataaaagatacccagaatgcagagatttgagcaggtatagtttccaaaaatcttctcaaagtctttcctatttctagttatcaaagtagtgttatctccacaaatcctattattggcctattaaggacctttgccaaggaattattgataaatcttgtcttttgcattacatacatccaaaaaaaattagccagacacagtagtcccagccactccggaggctgaggcaggagaatcttttgaggccaagagttcaaggctgtatagcatgctataatctcgcctgtgaatacccactgctttccagcctgggtaatatagcaagactctgtctctaaaaaaaaaataaataaatcaccttaacatgcattattagtctctggcctttacatataagtaatagtggcaaattaacctttcactattttttctgcctatccagcatatactattgtttgccctaggtgatggtgatatatatatattgcttaagtacatagtataggaaaaatctgtaagctcattttaatgagaccatactttcattatcaatgtcttaacaattacagtatacaagtatatatattattgttgccctttttaaaaaaaaaaatgaaaaagtctcgttctgtcacccagtctggagtatggtggcacgatctcagctcactgcagcctctgcctcccaggtcaagccattctcgtgcctcagcctgccaagtagctgggactacaggtgtgtgccatcatgcccagctaatttttgtatttttagtagagacagggtttcaacatgttggccaggctggtcttgaactcctggcctcaagtaagccgactgcatcggcctcccaaactgctaacgttacaggtgtgagccacaatgcccagcatattgtagccatttttaatctgtattctaacccaacagttcaaacctattggtttcagcattttttttttttttttgagacagtttcgctcttgttgcccaggctggagtgcaatggcgtgatttcggctcaccacagcctctgccttccagtttcaagcgattctcctgcctcagcctccccagtagctgggattacaggcaggcaccaccacgcccggctgattttgtatttttagtagagatggggtttttccatgttggtcaggctggagtcgaactctggacctcaagcgatccgcccacctcggcctcccgaagtgctgggattacaggtgtgagccaccatgcccagccttgcatttctttatactataaataattgaagaccccaatgagctactgcttatgtgggttataactatcactatttataatattaaacattgaaactaagaagtatttgaaatattaatctcattacatactaacattttgtgaaaaatatttttcaaaacacaatgagtggcattgttacacattttgcatttaagctaaagtgatgcacatcatgtaacctgcagaaaactgatcccttatgaaaattcagcgttcctaatctcaacatgtgtcaaacattttggtcttcatctcaagatggcaactgtccagttagttgggtgagctaggttaatgtgaattactgcaatcacaaactgttttctgtagtttttaagtttttgtggaaaaatgatatatccttgccttttcccccctcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggtaggtgacagcacttaagacattttgttacctttttttttctttatttcagagtacaaaaccagagatagtttttttaaaaataagaggagtaaaagtaataaccattgcaacttggcttgggagcagcaaaaatactgtcttctttccatgcaaataccaactctttccatccatttgcatcctctattgttcattattttggaaaatctttaagaaatactttactattagacggttaaaaatctgttaatactttaaaaagtatctctattttgtattaaatagctgttattcagatatagtacttatccatttatatataacattgcaactttatttttaggtttgtctttttgccaaaatttgaagaagataaaagggaattggaggaagagtaattctaatatttgacaaatgtgaagtcttaatgctttgacaaagatttaaattgggaaggagctaagatagtctaaaataagacttagggatgagttataaattttagacagctaatagctctattccatgaataaggctattcatttcctctttatttaggaaatcacagtttaagaaggaatactatgtacgaataaaccctgctccattgctggtttgattccttatgagagaccatttaaaagttttttgtggaacaataatgtacctgtgtttgaccagtaattagaaaccagtaattactggtattaattagtaatttattataccactaatagaaactgatgcctgccgggtgcagtggctcacgcctataatcccaacactttgggagactgaagtgggcaaattgagcccaggagttcgagaccagcctgaacaatatggtgaaaccctctctacaaagaatacaaaaattagctgagcatagtggtgtgtgcctgtaatcccagctactcaggttaaaacgtgaggattgcttgagaccaggaggtcaaggctgcagtgagctatgatcatgccgctgcattccagcctgggtgacagagtgagaccttgtctcaaaaaaaaaaaaaagaaaaaaagaaagaagctgatgctttcagaaagtccctgcttccatttttggtcttactgactcttctccaaaattttgtatcccatgcactccatctcaggaaactatcagaagatgtaaaagtgcttcacagaaagtgtaaaccatgaacaagaaagacatggaatgcaacacagaataggttaaatagacataaaagggattctcagaattatggaaaagtgaaatcccagtgtgagagctttacaccagacccagagatttgatcaagggtctggagccaggagcatacagaactcaggaaggatgtctgggaggaaaaatagaactggtagactcccggttgttcactgttctgtcagaaaataggggactgaattcgtgacaggtacactgaaaattaagcaaatgggccaggcccggtggctcacgcctgtaatcccagcactttgggaggccaaggcgggcagatcacgaggtcaggagatcgagaccatgctggctaacacagtgaaagcgtctctactaaaaatacaaaaattagccaggcgtggtggtgggcacctgtagtcctagctactcgggaggctgaggcaggagaatggcgtgaacccgggaggtggagcttgcagtgagctgagatcgtgccactgcactccagcttgggtgacagagcaagactccatatcaaaaaataaataaataagaaaattaagcaaatgcaaatgggagagaattaatagattaatagctacaaaacaaaatgtcgtccaacagatgtcaactgtgtggcttaggtagaagtagcagtaattcgtcctgaattaaatatctgtttaaccaaaattatggtagttctgtggtgagaagttgaggagctaaattctaaacaaacaattaagaatggaaaacaattgcccctagggaagaagaatggggaggcaagagccagaagaatacataaaccttggatttatatgacttttaaaattatagacagtacatttatgtctttgatgttattaaaattttatatcagcagcctggcatggtggctcatgcctgtaatcccagcacttcgggaggccaaggtggccagattacttgcagtcaggagttcaagaccggcctggccaacatggtgaaatcctgtctctactaaaaatacaaaaattagccaggtgtggtgatgggcgtctgtagtcccagctacttgggagagtgaggcacgagaatcacttgaacccgggaagcggaggttgcaatgagccaagatcgtgccattgcactccatcctgggtgacagagcaagactgtatcaaaagaaaaaaaaaattatataagctgttctgcctgctcttcctttcaaatgtgggaaaatgtgctggccttgtaataaacataagatggaaggcaatcccctattctctctgatggccttatttttcatatatttttctttttttttttttgagacggagtttcgctctgttgcctaggctggaatgcagtggcatgatctcagctcaccgcaacctctgtctcctaggttgaagcaattctcatgccttagcctcccaagtagctgggattacaggcacgtgccaccttgtccggctaatttttgtattatttatttatttttttgagaccgagtttcgctcttgttgtcccggctggagtgcagtggcgtgatctcggctcaccacaacctctgcctcccaggttcaggcaattcttctgcctcagcctcccgagtagctgggattacaggcatgcgccaccacgcccggctaattttgtatttttagtagagacagggtttcaccatgttggtcaggctggtctcgaactcccgacctcaggtgatccgcccacctcagcctcccaaagtgctgggattacaggcgtgagccaccatgccaggcctaatttttgtatttttagtagagacggggtttcaccatgttggccaggctggtgtcgaactcctgacctcaggtgatccgcccatgtcggcctcccaaagtgctgggattacaggcaagagccactgcgcctggccttttccgtacatttcttatagtgtaggcctatttctataaacaacgtgattccaaggctgaaggataaaaacatgaccattaaactcatggtaacttcttgatacagtgatcaacaaaagaaacatgatttgtttgagtgtcaaagacaaacaatttacacttttttttttttcttgagaggggatgtcactctgttgctcaggttggagtgcagtggcaaaatcatggctcaatgcagcctcaacctcctgggctgaagtagtcgtcttccctcagtctttcccatagctgagattataggcatatgccaccatgcctggccaatttttctattttttgtagagacagggtctcactttgtttcctaggctggtcttgaactcctgagctcaagcgatcctcctgccttggcctcccaaagtgctgggattgcaggcgtgagccaccacatctgcccttttatttttttaaatggtttacatttattaagagtatgcaatgtagggctttttaaaaggcaatttatagaagtcatttttatcttacaggtggatttaatcattcattgccattccataataccaactatcaaaaggttaattattttctgatggtgaaagttttaattttaaaaaaatcaaattttagaattgttagagacctttagaacaattttgtgtagtcctttcatctttcagaagaatctgaagtctgtcatcatttaaaggatttacccaaagccatggagctgattagtggcagagtagagattgacttccatttcttttttaataaaaattatgaaacttcttaaaggtttcataattctgatacttaaaactaagattctaccaattcatattatgccaggagtcagaattagattttaataaaggagacattaaaaaaacaagaggcacattgtaacaaccagttaatctaggtaaaatatcactgagtagctttgcccaaattatgtttcattacaaggtactaaatgttagccaggtgtcgtggctcacagctgtaatcccagcaccttgggaggctgaggtgggaggatcgcttgagaccaggagtttgagaccagcctggacaacatagtgagaccgtgtctctacaaaaacttaaaaaattatctgggtgtggtggtgcatgcttgtagtcccaactactggagaggctgaggtgggaggactgcttgagcacaggagtttgaggctacagtaagccaagatcatgccaccgtactccagcctgggtaacagagtaagaccccatttcaaataaataaaaataaaaggtactagtgttaagcaaagcaaggattctctggtagaatacattcaagaaatgctctacataataactccctcttaaggggggatcacagtgtacattaccataaagggatttgagaagcctaaggaaagaaaaccttgtttaatccaaaatgctcttggagaagctattttgtggaacagaatttggtcaaacatggcataacaagtaattcagcaacatcttgtaagcaaaaattgaaaatatctattttcctaatactcaggcacagatatatttaatagctcataaaaatttgtcacttaatatttgtcaccttaatatctttattttcccacgaacaaaaggcttgtgcatcatgatgactgcttggataggacattgtatcccctccttatcaagaagcattggctatggaccagaaaatgttttgtttgtaaaatgtatacagccaggtgagtgataatgtattttttttttttctctgagaaatggcagttttgacttttggtattttgttttccactttggatctaagaatatttgtactttaggttataaatatgaagtatcatctagtagggaagtgccagaaaatcaatttagtgagttaaaactaacattcttaaatagtcaggaaatattatatgtacacaagtccagggataggtcaaatttcaggcttgtaaaatgtatacagctaggtgaataaaaataaaagtcactagtgttaagcaaagcaaagaattctctgatagaatacattcaagaaaagctctgtacaataactccctgttagagggtcacagtgcacattaccataaagggatttgggaagtctaaccaaagaaaaccttgtttaatccaaaatgctcgagagccatgttctttctgcctcttgtccacatagtttacataatcagcttcatcaataaaacttcatcaataaaaccacagtacatcacatgaagttaaaatatagttttataaaatttttactttatgtgattctacatgtttagattataaggcatttcttactgtgggtcagtaaaaaaaaaatttgttgcttttggaggctgaggtgggaggatcgcttgaggcctggagaccagcctggacaacacagcagtaactataaaaaacatataaaaaaaatctgaaagccactcagaggaaaggaaatttagtacaggttgagcattccaaatttcaagatcagaaatccaaaacctgaaagtgtttgagtggcaacatctgatgctcaaatgatcattggagcattttggatttcaaattctcagtgggatgctcaaccggcaaatatatgcataatatatttaaaaatctgaaaaaaatctgcaatttgaaatacttctttttgatcccaagcatttcagataaaggatactcaacttgtatcttcagtttgttttcgccaccccaccacaatattcttttctgaaagatcaataggaaaacatgataaatcaaagtgaaaataatgttaaaagcaaacattccatgagatgcagaattcaaacataccatacaatagcatcttcatgccattcaacattttggttgaataatgttgcccatattgctatttgtatatactttataacataatcttgagttataggtaaaaagagttatatagttttcaaattaaccagtactcatttatcagttaagaaggtatattaagcaaaagtctatcagatttgtagcatctaattttgccatggtttttcaagatggtctgttagaagaaaatgactatattcgtacttggaggataggtatgtcgtggcaaatgtgtgatgctttcaaatagatttatattcttcctttaagggtaagtattacagagaaacagcattctgcagtgtttcttaatgttagatgccctttcgctttgtagagagagtattggtggtgatgtatttgtatctatgtatacaaaattaagggattattatgcattaataacagactgataaggaaatagaatgttatatttacatattgctacaggtcataaagcatgttaagtatggcaaatttgattgtaatgatgtacttctttttttaaaaactacagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggtaaagatccttcaaataactgtaatggaaactagggagaatgaattatttacaaataagacaaaattaatagctttgggattatttattttttgagacaaaatctcgctcttgttgcccaggctggaatacaatggcgcaatctcagctcactgcagcctccgcctcccggattcaagtgattctcctgccacagcctcctgagtagctgggattgcaggcacctggcaccatgcctggctaatttttgtatttttagtagagacggggtttcaccatgttggccaggctggtctcaaactcctaacctcaggcgatccacccgcctaagcctcccaaaattttgggatcacaggcgtgagccaccgcgcccggctgctttgggggaatttaatcttagtgtgctgtttagtaatgttaggttttgttttggaggaaactaggcatacaagacatgttaataagactatgtgaataatgaatttaaaaagatcttgagtatatactcataactccagaaataacattaacttgaagctttatttcttgacaaaagctttatgaatgttatgagtttaaaatatgtcaatttaatactatgatttaaaaaacaatagcagatttcgtatgactgtggggacatggaaaaatcaagatcctattgattgctagctctggctcacttattctccggtaatgatactattggatatataccaaaattatataagcaaaaagaaaaaaaataagttttcctggcccaggtcttccattcttctggtccccttactatagtaattctagttactctcatcttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttactcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctataaaacccctgatttaagacagcttttctcttttttcgaggcagcttttctttatgcttatttcaatcaaatgtaacacgcctgtcaaattacatgtaacacattagctaatgaagataggcaactgaaaatgttgtcatgaacatgtcaacctgcttggtagttgaatttgacttttatataatagtggatacacatgcacagaagttactagagaagcaatagctatttctttaaacattcttcaggcatcagtaccatttaaggacaattagacattctagttttactaggagaaaggtcagtcatctctaacattgtgttgcagaattacacgacacaaacataaacacatttctgcctattaaaccagtttctttgtttctaaagagtttaatgatacaggtttgctatttccattagagcatcctttttctggccaatcggacaaaatagagttagcaaagccctcacagcaccctatgaaaaatctctgctcttatacaggattagatgcagacctcatcttgacctaacatctgtaaccaggtaagtgtatgagtaggaacacagacagcagtactgtatcagcaaaatctatcatattatttgaaatcactggatataatattaattataaagtgtatggttctctccagttgttcacataccaaatcccagtcagttctcagattcagatagatgtatctgcaatttctccaagcagctaagaaaaccttcaatggtcagttctgcttggtcatggtatgactcttttttttttttttttttttttttgagatggagtcttgctctgtctcccaggctggagtgcagtggggcaatctcagctcactgcaacctctgcctcccgggttcaagcaattctcctgcctcagcctcccgaggagctgggattacaggcacgtgccactgcgcccggctgatgtatgactcttttatccagtaatcaaaacacatacgtacatacacacacataccagcccaaaagaggtgttaaaacatacatattacacgtactttttggaggggtggggtggggtgggatggggtgggggttatctatctcaaaattaccttttggtgccttgtcaagctgtggagttttgaccacacacacaaattgagccaatgaacaatttcaatgatcctgaaagttcttaagtcttatgaataattatcaagagttctgagaagttatctgtaaatcagcctatgacaccatttcttgagagttatgattaaagaaacagcaattatgcttgaagcgaacatacatcaactagttagagcaaggtcagcctgtacaagctgacataaattatgagaatgatgctctatctctagaattggaatattctgtggcttctttgtaaaactatagatctggtgggtcatgggaagaaagggagggtgaacaaaagataaatattacctttattttttatcatcttgagcttactgtttagttaccccgtttcccaaaacagcacaacctctgtgaccagttaactaagaaattatttccttggcagcaaacccagaattccatcacttactcttgtaaatagcaagaaagtaatttactagcagagtttgatagaaaaattctttaatgaaaacaagtttacacgttgaacttatggcttaactagaataaatctaagtaagttaaaactgtataaggaccaaacagataatgactggtatatatgcaggttctctcaaaacggtgattcctagttccattataagacctctttaaaagcaaaaatgcaattctgtagatgaaaacagttatctcagagggtcaaccacacaatgtcatacagagacgctggtcttaagccatttttttccatattcatataatttcaaaacatgagaagtatcctacttgctgagaagtgccaaatgaccctaatattcaaaatatcttagaaatgctatcctttagttaacatacccttaaattttgtaacattgattttaccctg

SEQ ID NO: 12184 - DNA, 8608 bp, Human
  misc_feature (1)...(8608): n = A,T,C or G
ggctcctcctctgtaagtggggctgttggagggatgaactgagatacacgtggcaaggtgcctggccctgagactgggggccccgtaaacagcacctgctgctctgactgaggggcagttggagatgaggggggacttacaggcccaacacctcatcagcaggatgggccctggctctatacacatagaatgttggaaagctatgttctgggtccagttgcaagaccatcctgcccacttgctgggtcgctgaggcagagcgccctggactgtgctctggagagcagggggccgtctctgctcactgctgggcagtcagagtcaggtccccagggaactcagatcaaaatctcagggcagccttgctgggtctcagctttcagaattgatttctttggaagaacaggaggcatagccaggccagctggcaatggcttcagccacagtcccccagtgccccatgctgggtgattgatggtaggagctgtgcctccctgccagccccccaagccccattccctgccatggctccgacagggaactccctgcaattcttaggtggatcctgaaacacccagtccagactactttttcagcctcacagatggcccagagatagatactattagcccatttcacagatgggaccccagtgaggtctagagaggctctgctctagctgagctgggactcagatcctactccatgacctctgccaaggtccaggccctcttaccgtcctacggggtccttgccggtgtcctcagcctctgccttccagaccccaggtgtcctggagctctgcagatcagagaggctagtactggaagcctgggcccatgcccccagcagcccccagcccagggggcccccaaggctgaacagcaagctcaggatcatcttggtggtggggcaggctcagctcacactcagccttggcaagtagctccagaaactgctagtgacgttgtcttcaagttaaatctcaggaggaaaagaaaatacgaggacaacaaagagaggaagtggcctgggccggcctacccggtgggtcttgtcctgccccccaactaccctggctggccccacaggggccgccaaccacacaagccagttcctgtccctgaggacttggctcagggactctgggaatgtggtagacatggggtggccccaccaaatgcatccttatgggaacctgctccctgggagccatgaaaagagcgtggacttcgaggtggggccacaggaagtggtcaggtccatctcaggggacctgctgcccatccacactgctggccaggaaatggggggcaattcatgcctcctcagcaccttcagcactgggcggctcaaagaaggcaagggactattctggggtcacacagcatgcagccagaggccaaggcatgaggaagtccttcatttccccacccccacccacctcagatcctccaaccggtttcatggcagcccagggtccagcggcatccaggatgctggtgggtagctgcacagcccaggccgcgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggctccagctggcctccgcatcaatatttcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggtaagtggggcatggcagggtgggacagtgtggtggccaaagggtgagtgcccagttaccttcgccagaccttactccccagccccagggaggcattttgggagggggcgaggccctggctatcaaggtggggtctccagaccctggagcacccacaatgccctgtgcacacctatgtgtgtttgtctttggcctcctcggggcctctgggtgtcagagaccgcagacagggctggctacctgtctgtgcacgcacacacacattcccaagcataccagcctcccctgagcctggagcccctgaagccatgagcagcctgtgctcaggtggcccccaccctctccacacgggagcggctacagccaggtcacggatcccctccctccccagagagaaggggcaggctgggggatgaaacctaggctcagtgttccctcccccgcatcctctcctggcactctccagaggaggaaggggaggtcaagccaatgactcagctctggcccatcctgtcctgttgctgcttctgaggcccggccacacccgggcaggggctggaccctgggtctagccagtgtccctacctcaggcctgctctctcttgtcccccacattctgtcctgtccccttcccatccatccacttcttccagacacagcaggaagaggccctctgaaggggccgccggcccccagacaccatccttacccccccaccgaccccacagtttgtccagctgttctgttgtgtttgtcctgaccgcccccaacacctcgagggaggtctgggctgacagctccatttcctccccaggagccaagaccaaggagaatgttgtacagagcgtgacctcaggtgagaagccccagggccaggggacacatgggggataggacccctggggctcctgcatcctagtgctggggctcaaacctagagtcctgccttacccccaactggggtcccaagccctacagacccctgcagaccatgaggctaaactagggtgggcgtctccttacccccaccagcatcagaggtgccctggagtcagagggagcaggggagggtcccagcagggccagggctctgagctcctgggaaggggctgcgagcctgactccagcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggtgagccccggccctcagacctgcccagtcctctcctgggcccagaaaggctgctgggcggaggcggcatcactccactccacaccccaggaaacaacacggggggctgcggctggcttcagtttcagtacccactgagcgccggcatggggtggggtccatgcttgctgttcgacctgcattcgggtctggaatcaccacaaccaccccttcgggggacttgggagcccatctcatagacaaggaaagtgaggctcaaaaccacatcttccggacggctctcagcacttaggagacaccccattttataagtgaaaacaggatcccacacggtgacaggcagcctcccgggcagtggtcaccaggccgggggctgagtagcaccagccccgcccccagggcctagcctccctccctgggctgggcggggcagctgcctcctgctgggagcctcagggaagtagcgtcccctagtggtaagaaagcagtgctgcttctgaccctaccctctgcagctgcctttgtgtgtgtgtgcacgtgtgttgagtgagcatgtgggtgcatttgtgagaatgtgtgggtgtacatgcgtgtgaatgtacacatgcgtgtgcggcccaatagcagacagcacaggagcagtggggcgcaccccagggacgggtgttggctgggtgagctgtcccagcacctgtgacacagcaagctctgctttacgcattgtacgcttattagttcatttaatagacacaaaatccatgagacggtgtggaaactaaggcccagagagattaatgtgcccaaggtcccatggctagttcatgtgagcttggaattcccctgagcagcctgtactctgagagaccctgtggcagtgtaagtggtggcctgggctaggattcctacctgggggtggggcgggggagcagtgtccagctctcctacctgctccaggcctcctaggtggtggagtctgaggctctgagcactgagaatccctgcgttaggagtgggtgggtggaagggtgggggctgccctactcctcttggctctggggcgatgcccaggtgtctgcttccagggccagcacagggtctccatgtccttggagctggcagccgctccctctcctagttcccctttctcgtcgtatgaccttgagaagcaaaggaacctctctgggcctccgtgttctcatctgcaagatgggggtgagagtgtcggcctccctgggctgtgtgatgaggcagggccatgacctccatgaagcaattctcctggtctatgtgagcacccagcagaggaaggtgaccatcatcatcatcatcatcatgtgtcccaggcagaacacatagagccccagggggctcctccctcctcacccccagcaaaagaggccctggggtgagggtgcccgggcattccttgtgaatcccggagcagggctagtgagcccttggagccacctcgagggagactcatttcctggtgacaccccaaaaccagtcacgactcatctcccagtgaactgtgaaaggcctcagcagggactatctgaccactcatacccctggcctcatcatcagccttagggcagcaggactcagcaggtggccacctgccctgcccctggatagcctggccgactcccgccagcacagcactgcccttttatgccccactccgccaaggggcaggatggccctggggcaacacagaggtgacagtatccccgcctcccccccgtcccccgccagaggcaggtgctgaggccagagtgcagggcaatcaccagtgtggtcctacacacccagctgtcatgatatctcacgcaagtgtctggccggcatggagtgcaggagatagaagatgggaagtgagagaggactgtgtaacctctgctggccctgaccagcctgagcccagagcctgtccaggaggcaaagagagggagccatgctcctgtggactgaagtgggcctgaagcaagcctgatctgatgccaacacaccccaccactttgagctcgaaggccctgagctgcatgccaagcctccctggcctcagagtccctatgtgaaccccaatcagtcttccttgtagggctactgagggtggggtcagacctggggcttcaggggcctctgcccactctaacccccactccaccctaccccacccaggttcctcatcagtgaagcccaactaggggcttcccagagactggggaccagcttgaggggtgaagctgggctccagggtacttggtgcccctggaaggcctcggcatcatcagagccccgggtattgtctgaattgcacgcccccaatacctccagcccctccaagtacaacaaggccacgaggggcctctgctcctccttgaggccagggtagacaaggccctggttgcagggcagctaggggtctctgcattctccacatggtctcatgcccccttttgtcccctacaggaggacttgaggccatctgccccccaacaggagggtgaggcatccaaagagaaagaggaagtggcagaggaggtaggagctgggctcctggggtgcaccatggggggttccttggtagggaccccatcccccacagacgcactgcttccctcctgggctcccagggcccagaggggcctcctgaccttccacagcccctacagggactgtgtacagggctaaccctgaacctgagtgggaggtccccccacggatgacccctcaggcatggggcacagaagacaacttttctcagcccactcagggtggcccattaaggctggggcctggagctgggtgtgcaggtcattctctctcccaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccactcctgccatgcttcctctgggtgctgtgtagcttgaggaggggtccccaggtcctcccaggaacaggaacgggttcagcctgttgataggaccaggtatcctatagggacacacacagggcattcatgggacctgcgtgagccttcaggaacacccccaacccacccattgcctttaacatggaggaggcagcactgccttcggctccccaagacattcgacaggactcacagtcccatccacggggatagcttagctcagcctcaaggtagcccccgcctgcctgctctgagtccctgaggaacccactgtcagcaggaggtgaagataggctcctgggtcttccctccatgtgagttctgggctccagtgtcgcaagaggaacagggccacctaacatcctccctggggcagatggtgactttcaaagatggagaagtctaaacctagtgaggatgaagggcatcccacaggagagacaggaggtggaccctgcggcgcctcccacctggccccagccagtctcatgctccccgctggacctggagctgggtaccccttgcacccctcctgcacccagaagcctgccagttgccaccaaaaacacaacagcagagacgcacgaagccgcaccttgacagaaaaatagtaaaaagcaacagctgctgaggtcctcacaggcgttgactgggcactgttctgagcacttcaccttatttaatcctcagaataaacctctcaggttggagctgtagatccaggttttgctgagacgcacaggactgggcagaagcccaggtggctccccagccctgctatggctgcatggaccccaaggtgcttacagtggattgcccccaacccaaagtttcaaaacaacccagggcttgctggccagtggcctacatgaaaggctgtttgcccagcccactctgaacaagcctgccgggcacgacgcaaaccacccatcatgtaggccactggccagcgtgtcctgggttgttttaaagccttgcatgccgggcgggcttgttcagaccagggttccctggggatcctggcttcccctttgatactcagatggtttgggctcaaagcatctcagtgccttgccccaggccttcaggcctgggtgttggagccagagcttgagtccgtccacatgtgacttcagacactgccctgtccacaccgcctccccatccagcctctgcagtggattcaagggcagcccaggaggctgggagcccagtcagacacagcggagccaggctgtatctgttgtctggccatgggcatccactgaggaggcagaacggagcagggggctgctggtctccacatccccaagcactgccatgggcaggcatgaagggtctggaagcagctcaggccagtcagggctgttcctgctccccagcccagacatgtacacattaagcaggcctgtatgaacccaggaggaggccacctggggcctgggtgtgcccgagagtcccctgggctgtgagagaaagcaaggaggagcaaggctggtcaggtgatgggggtgagggagagggcacctatgcccggctcccagcgacaacctgccccaggtttcagggccctctgcctctgctggaggagcccagaggggtccctgctgcccctaccacagcccccctacaaccccctctcacatacactcagggcttgttcctggactcaaatgacaaacatcaccagaaagccccttcccagccatgggcactggcagtgctctttgcctttgaaacctcatgtgctctgcaccctgtgaggctgcttctgacctccctgcaggagcacggttgactccccttatccaccaggatacactcaagatgtttccagctgcctgcaaccccagatagtaccaaagcctacatatgtatcttcctacacgtacacatgtgcctccctatgatgaagtttatacattaggcacagtaatagactaacaataaccagtaagaaaacgga

SEQ ID NO: 12185 - DNA, 27587 bp, Human
gctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttatttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtgggggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagagggcatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaagtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagtttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacaaagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaattggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataagttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggtaaggaaaataaagaggcgaagccttagttgctttaggagatgatataatacaggtgtgacatcagtgttttcagaatttgtaaatgttaaaacaaacttcttgatttaccaaagccacaaccaaagtactttacctggatctttcaagacagagcttctcagttcagacaaattgactgatgataagacaaacacttttcctctacaaaccgtggggtagtatgtagagagacctgtgatttcttcccatactgctctggaactacttctaattatacttttttctttgtttgtttttgaaggggaagcatttctccttgcattggtttgctggtatggatggcccttagattttggcatgagtgattatgcagcctatttgaagaaaacctgttttcaggacctttttaattaaatatggcctgttacatgagttaaaggtaagttataagagctctagattctgcaagatgcttgcttcttgtagttattttgcttggtgataatacattttcttttgtctggagcttcctggactttttgagaatcctgattgtgatgatataataggagaaaacttgggatatagatagtataattgagtgtggtgaatcttttgttatggaatgctagtctaagcttctgtgtgtttccactagggacacacatcaacatatcagtcttaaaacattcttggtagttaatgcttgatgttacttaaaaatcatcctacattcttgcattaaactacatacacgtggctgggcgcggtggctcatgcctgtaatcccagcactttgggaggccgaggcaggcagatcccgaggtcagaagatcgagaccatcctggctaacacggtgaaacctcgtctctacaaaaaattcaaaaaattagccgggcgtggtggcaggcacctgtagtcccagctactcgggag

SEQ ID NO: 12186 - DNA, 3243 bp, Human
tgaaagtatacattatcactgagatagctataacatgcatacatttttttaatttctcaggagtaaacgatcccaattgcagtttatctgtggttcatctggcttcttctcacaccacctctgttgacatgggaggcctgccggccacacatccaggaagtatgaaatcagcggggttcctccccttcttgctccagggaagcctgagagggactctgcagattgcatttggaatccatctgccaggtaatgctctctagtctttgccaagcaggagctgcaaggtggggaaccttgctagacagagctcctcgtttcagtctggcttgtcacttacagtaaatcagttgaaggcggagcataaatacaggctttctttcccagatcccaacactgcccggttgcacaagccaaaacaagatgagggatttttctccttcctctctgacagggcaaaactcctttggaggttagactcttggtatgtgcacacacccaaagaagcccttctttatgtgaatttttgtgaattttcctgccctctcaaatgtgagcgattttggcaaaatattgcgtttcacctctatcattctcctatcattgtcagtataacagaaagtgttgttttgttcctttaacagacttgtctattttagttgtcaaatagaaacaaacatacacttgaatgtaacagcacattattcaaaataaaactaataatacataattttaagttgtatttgtcatggtacccttcatgaagctcttgatatttttgcttcatttgatggaagtttatggagttccttctataatatgtgccaggtctcatgcaaaggggtttctctctgctcatgaccaacttggaatgggggtgttgttaagtgcagggtgcagatgagacaattgggcctccatgacctaactcccagtgtaagcctcctaaggtagcctcccggaatcctctctcatcccataccatctcttccttatgagaccttcccaagcagctacgtgcccagggtacctgttcaatatactgggtctctcggtctcttttgaatcctcttcaactgtcatgttatattttttcacaaagcttcatcttggctcgggcagaagtgatcaggctttctcaggaaatctcccacagtctccaggagagaagctgagggtggaggccagagatttataagaggagggaattgaaaagtggcaggctgtaggactgtattgccagtgcactggggcattctgatttgctgtttgcaggattcttgtggccaaggcctgagcacttcagaaagtgcaatgtgccacctacctgcatcagcatcacctggcctgcttgttacaaatcagattcctggtgccaggacctcttggtgaagatagggagaggcctaggcctcacccgcagcccaggcgcctgtccagcccctgccctgccaccctagtagtagagcatgcaggcaggtgagacaggtgtgtcctggtttgtgacctgggttaggattgccctctattccttagtcttctcttctcataaatctctggcctccactctcagcctctgtcctggacactgtgggagatttcctgagaaaggattatcactgctgccagagcccaagatgatggatgctttggggaaaaaaaagaaagaaaaggaaagaaagaaagaaagagagagagagagagagaaagaaagaaagaaagaaagaaagaaagaaagaaagaaagaaagaaagaaagaaaaagaaagaaagaaagaaagaaagaaagaaagaaagatgcttgaagaagaggatgcaaaagagaccgtgtgggcttgtgagaggcagaggcgctcctctgaaacctgtgaggaaatctgagctggagagaggagaagcctcagccacggagggagaagtttccccaggggtctctcatggtggccccagggtgaggagagccactgaaggagattcacctgagacaccacatcacgaaggaggactgtggccatcagaggcactgggaagggaagcctgagagggaccaggcagattgcattgcataatgtcaaggtagaggagcagcctggattctcaggttacagagctgtgggctttgtgggcaggagcacctcggcctgaagccacttctgcatgtgctatcctcctatcctaggcacttccacagacctttcccagcctaaattttcacatccgtgatattcagatcacatttcttcctactctaaggttagagtgaggattaaaacaggaaatgctggtagggacttggcagaatgctgggccctaacacatcataggccattaaagaacattggctgggctgtttgttgccagcgagggggttgtttgggacccagagagctgcctggaggacttgatgagctcagaaactagtctgtgatatgaggcggattaaaatgatggctaagggaaggaataaagcatagcctaggtgcttactttatggtattttcaggctaatttggtttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggctaatttgttttgtatgctggggatgacatctagatgagcctttcatcaggaagagtttctgcattttgaatgctgttctagagtcagctagagacaatccctgcaaaataacttatctaaaagctctttcaaactcctccccgggcagcctcactatgctcaccagaatgctagatgtgaatgtgcattcggtgagtactggctgggcctgaaacatcgtcttgtgggattctggagacaccaaaacccaaaggacaatttaaagagcaaagagccattgctaccttcaatgttttgaagcctctgccaccctcaatgatcttggcaaccctatttgcttcaagaggaaaacaaataaccaaaataaacccaaatgctaggagaacaagaaactgttagataaatgtgtctcacagatcatgg

SEQ ID NO: 12187 - DNA, 14207 bp, Human
ttcgggcaggaataatcactgcctcccatccccttaaacatgccaagatgctttatccctaggatgaggtgacttactccaggtaactcctattgcctaaccactgaccaattactctgccctttagtctttatgtcattaaatctgcattaagaatttcatggaataggcccggcatggtggctcatgcctgtaatcccagcaccttgggagaccgaggtgggaggatcacttgaggtcagcagttcgagaccagcctggacaacatggcgaaaccccatctctactaaaaacacaaaataactagccaggtgtggtggtgggcacctgtaatcccagctatttgggaagctgaggcagcaggagaatcgcttgaactggggaggcagaggttgcagtgagtcgagatcgtgccagtgcactccagcctgggcgacagagcgagactctgtctcaaaaaaaaaaaaaaaaaaactcagggaatggatagcagcattgatgaatattgcgtctggagagatcagatcacttgtcacttgtttccaggcacagggcttaccaagaggcagattccagatttaaataattctgtaacagcaaagtccaagctattttcactgctttggagaaaagacccagacccagagcttgaacctcactttgcagcaccccagttctaatcttttaagttttttttttttttttttttttttctgctgggcacggtggttcatgcctataatcccagcactttgggaagccgagggggaaggatcgcttgaggccaggagttcgaaaccagtctgggcaacatggcaaaaccccatctctacaaaaaatacaaaaattaggccagagtggtggcgcgcacctgtagttccagctacgtgagaggcggaggtgggagaatcgcttgaacccgggaggcagaggttgcaatgagctcagatcccgccactgcactccaggttgggcgacagagcgataccctgtgtgaaacttttttttttttctccaacgggctttccagagaagtgtgtgtatgtgcgtgtgtgtgcgcgagcgtgcttgcttgggcttaaactttctgtcgggccacactttcccaagtctttgcactggctgtagggtgggctttatcctcgggacgtcctcctccccaagtccagcctgcagctggaagtcttcactgatctccatctctcctccctgatctccgtctctcctccctgcccgcctcaggactgggaggccgatctctctctctcgccctcccctccaccagccttttccagatgtatgtctgccaaagaccccccagtgcagaggatgatgaatgaagatcctcgagccagcccggtgggaaagtttcgtcgcctacaaaagcgagggaaagggaagggaagttgggggtaggggaaaagttagagctgagaggctggggcgcgacgagtctggacaccgggcggggacccaagctctctccgctcagccaataactgtgcctcccttaggaaggcgtgaggaaatgctccaatcaatccctgcactcctcccttggaatttgggctgtatttttttatttactgcaaaccccacaatccacccaggggtttccccagtgtttgcctccagcggtcccggtgcccatttactagtgctgctccctctcttccgcaagactgcgctccagtcccagcctccttctccgcgggtgcctcccaaaccgttctatcattctcgggttcagggaggcggaatcgtgcctgctctccggttcctttaagaggcgtcggctccacccctctcagagtcgcggtctgacgcgagatgacagcaacgagttcggtatgtctatgcaaataagcgccctcttgtgggccaatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggtaccaagccggggggctggccggccccggggcccggttggggtggggatgtgcaaagggagcccgggaggaccgcagagccgaggcggaggtgagaggctgcgagtccgcaggaggtgtgtgggaggggatggctcctgcccggggagggccgaaggggaggggccgccggggaaatgtggggagaggggagatcccgcgaacgctcgcaaccgtggggaaaggcgcagaggtgggagtgaccggcgccagagaggaagagggcccttgctgagtgaaggggtgaggagcggtgatgggaggctacgaggctgccggggaggtggataatgagaacccgggatcagtaggtccagtgcactccggtgttcggacgagggcgccggaaaagcagggagcaaacgagaaggtatggaggtgaggaggctggagctgcatgacaacaatgagcgaacatgtgtgggaggaagtgggcaccacgagagtagtgctggttggaaggacaggcagggttagggaccaggtaagggagcggggcaggagaactggtgctgccctgagcagcaggaacctagtcctgcgccggccgtgagtcttccatggcatccactgggaaccacatgctcctggcaggacccgctgcagaatctcctgccgttaggacaagtggggtttccagccctagggagaatctatgcttggatggggtttgggggaagtcagggaggcttgcagaggtacctaggaattcctcttctgccagccagtgaaaagtgttgaggaaaggagtcattttggggtgtagacgataagggaagagatgaaagcagaggaactgggagacaaggagctggatccttgggaacactggctggtgtttatttctgtcccatgtagaaaccagagctgcttccaaggtggtttgcagaactttgttgggagagtatggcatctatggggccatccttgaaggtccccttcctgggctcatggcaggatgtttagtgctaatctaggtctcgtctcccatcactccagacactgttgtatcagtgtcccttgtcacttgatcatcagtggagaagattgtggggggaggtaattaaggaaaactctcttctctccttccataaccttcttcccaagacaaaggagtaagggcagtaaagtattacagggcaaaaggagaaactaggctgtggcaacaagttggagcctgtgcagtttctggaaagaaacatgggacagttggagcttaaatggtccattatcactaatgtcttgtacaaattccagtgtgataggtagggatccatcctggtccctgtgacagtgagaaggggtgaggctctgggacattccaggcactaagctgtgttggggagcagctagctgggtccttcgtatcccctgaagttatatgttccatcactgggggctgttactgtttgcttggggtatcttcaggtcaatggggctgctcctcaaaggaggagcatgggtagttttgctgcttccagagatcctgataggacaccctgccctcagagtcattagagacgaaggtcattatgggaatgggggaatgacatcactgtataattctttttccaacttctcaaggaaggtagagataaaaagtttgctgacctgcccatctccctcctcacccctcaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggtgtgtttgggttgcctatgtgagaggagggaagggagtggggtccctctccctttctggcccaggacaggtggataggtgcccaccgatgtggagtggagccggattaacgaccctcgtcctaggggacaggtgtccatcctcactttcctgatagaagaccgcccccctagataagcgggcggcctccgtgcccatataaggccggcttgggctccacgccggcctcccgcccgcagcccgcctgcctggcagggcctttgcattcctcccgccagctgtctccccgctaggggcgggggtgtagtttagcccggccctccgggctgggtcgccagggagtagaaagggagcactccggtcccggggtcctgggaatccagcactcttggcaggcgggctggttgactgggccggggactaccttacaagccagccgctgccctttcagggtgttgggggcctgggcagttagggagcgcatttgcctgctgctagggatgcctgcgctgttactcctcccccttccttttcccggtaaggagagggggtggggcttcctcccttgctgtctggggagctccaccttccgggtggcacttaactgactggccaatgggaggaagcggcactgtttgccttagcaacgcctctgccaatcaagggtcttgggcccagctgctttgcaaacgtctcgtgctgacccaccccgcagcctttgagcctctggttgactcatttcgggtctgggcttggtggcttggttctcagtttccttcttccccttctaagaacgaagtcttccttaggggagagtcagtgctgtaggctacctcctctcttagtggcatatcatctgtaataatttttaaacttttataacagtagggctcatttattcccaggaaattttgttggatgagtacattcttttggtagtttacatcttgggtgtttgacatatagtgtgtcattgccagattctcaagatctctctcaaactcttaagttccctgagaaactcagttcctatctcagaagcctgacaaattagagctggaagaactctttgaaagaaaacgtagtagcccagccccctcatgcttatagaagaggaaaaccgaggttcagaaaaggggactggttatttcagggtcacttagatggtcattaccagagctaggaacagaccttggtgtcctgactccccagccaatgggattaccacagtccgctggagcagagaactcaggggattataataatgacaatgataataattatcataagagcagcaaatatttattttggtttttttatgtgccaggtagtgttttctaagtgatttacatatgctaacctacttaatccttacagcaacctagggggtaggtattatcctccttttaccgatagaaaactgtagctcagtagatcaataacttacctaagagtcaggcatcaggtaaatggtggcgttgggatttgaacccaagctcactggtttcagtctgggttctcagtccacacaaagcttctgcaaaggcaggatctggtaggggctcattgcttcatctttactctgggtataggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtgagtcacgaggggcagggagagattcgtccttcctggggcaaatcaagcatgctaagagtgtgtttagggctggcaccaagagaacctctttccctgctcagaaggaaggtgaataggggccagagcctgagcgaagcctcttatatcccgttggcaggcatacctctgcccactgagacccctgctgtccttgtcagtaagtttcaaccatatattctggccctgtctagctaccccagccccgtgccctcattgccacagggcagtagatgtttcaccacttcctgccttgactggaaggcagatcatgtctttgatgggttattgccagctcttgggtcaactgaagaaaagagagacaaggcccagggcaggaggaggagggatgggcaagagtagagcgtggaagcccccagagtggatacttgggcctgaagggcctctttggcttccaggaaagatagtgatgggagttggagaccagtgtgccagaccctgggactggggtgtccatgggtacttggtggaggtggcaattgggtgggacagagcacaaataagactctgtgtcttgcaggtggggcagtggcccagcaggtcccagtgcaggccattcaagtgcaccaggccccacagcaagcgtctccctcccgtgacagcagcacagacctcacgcagacctcctccagcgggacaggtatagctcgcagccctgtcaccctccctccctgccttcccccacgaggcctagcagtaggtgcccaacagtaaccctcctgtaactaaagtcaggggatttcttaaagtggagattgaggctttgggcctaataattatggggaagtcaggtgaggatgactgggttttgaatcccgccctgcagtgggctgcggattccagaagaaaattggggaccattgacctacctcctcattcagatgaggagcctgaggcctagaaataagaagttacttgctcaaagacacatttgcttaattatcaggaaggacttagagagcaattttctctttgtgcgagggtcttacaggttttgagtagccacagttaccctcaggtatctctagacatttcagaaatgatgagatactctcaaagtaaggttaattttaagttcttattatttataacctttttactcaaagtgtggcctatggactgggaacaccagcattacctgggagcttgttggaaatacagaatcttgagtctcaccccaaacctagtgaatcggagtctgtttttttttttttttttgagacggagtctcgctctctgtcgcccaggctggagtgcagtggcaccatctcggctcactgcaagctctgcctcccgggttcacgctattctcctgcctcagcctcccgagtagctgggactacaggtgcccgccaccacacctggctaatttttttgtatttttagtagagacggggtttcaccttgttagccaggatggtctcgatctcctgacctcgtgatccgcccacctcggcctctcaaagtgctgggattacaggcctgagccaccgcacccggcccagagtctgtgttttaacaagattcccatataatgcacgttaacatttgagaagtgcttgtttgaaagatgaatttgttagctgtgcattaagaaggagagagaggccgggtgcggtggctcacgtctgtaatcccagcgctttgggaggccgaggggggcagatcacgaggtcaggagattgagatcatcctggctaacacggtgaaactccatctctactaaaaattcaaaaaattagccgggcttgatggcaggcatctgtagtcccagctactcgggaggctgaggcaggagaatggcatgagcccaggaggcggagcttgcagtgagccaagatcgcgccactgcaccccagcctgggtgacagagtgagactccatctcaaaaaaaaaaaaaaaaaggagggagaatgagaacaaataaaaaataagatgttagagctcctaaaaggggagtatctgagttttctgagagtaggtcagtcataatctttgtttttcccaagatttaggacttagagaattcagtagatagacaattgaataaatagtacaatgtgataggatacaattaaagattgatgctgttgtgttcaagaaaaaataggcttttcttagttgatgatggagctgaggaatagtcgtgtctagcttctgacctgggaaatggcaagagggctctgggggcctggaattcctagggacggaatgggagttatcagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgcactgatgcctacaaatatttctacccaaatacaacacagacttggatgctcacacacacatttggacaccccacttggacactcacacccgcatgcaccctcagacacactggcaccctttcccttgggctcttacatctgagactgccccagtcacttgtgcatttgacaccactcctccaatatctggaagtttcaacaaacaatttgagtatctcctgtggttttccaatgtaggtggcgtcccccaggtgttcctgacagcatcatctgggacagtgcagatccctgtttcagcagttcagctccaccaggtaggtagggatatctttcaccccatcccagatagccacttctttgtcttgaccttaggggatcctgttaccagttcatcaaagccaaaatccctagcctggaagcccatctgcttttctgctcaggcctgtggttggcaggcagggaagccaggggagcctgaactggctggccagtccctgcccctcctcatacatccccttccctccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacagactgtggggtctttggttctgtttttctacttagggagggatgggggtatgaacgcgaggcaaactcctaaaattgctgctctgagtagcgatccgggctgcttgatgagaacggtaatgctaaggtgtgctttgggctgtttaattctatacgatttaatttaaggaaagttttgcggggccgaggaccttctccctgtgcgtggcttcgctaggtgttaaggccaacgcagaggagcaaattttaattaacaggaaaagtgacacaactaatccaaagcattgctgaagggtttgggaaactcatgggcacctgacctactgaaaagtcaaaaagggcagccttaaggtgggaatgtgggttaccatgtttcgtcagcatgatcgctgtgatgggagagggaggattaggagggccgacccagtgaagaggagggggcttcacagttgactggatggaaacggcttcttcctgctgctgagagaggagcaacgtgacctcgatcccaggctcctccggtagcgcgcccccacgcccctcttccagtgcagccgcccgcggtagcacgcatgctccactcgcgcgctgttccgccacgctcggcgtgggccgcggtgggacccgtaggtgcccggccgtgcgtgcactcgccgtgtgacccggaagggagctctgaggaggcggggccaggacggcgggaccggccgctgggtcccagcgagggctgagccgggcggtgggaggtgagaggagagttctgcgccgacccaatccctccccttctcctgtcccctccccggtcctttagccactgtccatggggctgacgaagggaaccaggtcttgctctctgagattcactggatcttttcagcttttttggaccgcgcccccaaccatccttccccctccccccaaacccgttccctctgcggtgctggcctcctccacctccccacggctctgcaagcttgggcttgaccttgctatctgctggtctcatccatgcgtccagagctcacccccacacctcagtttattgttgctcttctaggccgacgttacacctcctacctcctcctatccgattcttttacttccccctgctgctaatcagttgcccgctggcacatcgctggctaccatccaggcttgccccccatcctaagtggacccctacctccattgaggtccacatccatctttctccctcctcttcacctctactctcatcttctgtccctgtaccccaacatgacccctgccctgaccactatatcttcatctgggtttaccttcttccattcttattctcactattccctgttgcccctgcactgcttcatatcacgcatatctttcctgattattccactcccatttataatcggtcttaataactttgcatttatttgatgactcccctaccttctccatctaagaataataacagattatgtttactgaacactctttatgtgctagatgctgttccaagtgctttacatacatgatcctactaaattcatgaagtaactatgaatattactaccatcttgcagaagaggaaacaagctcagaggttaagtaacttgttccaaactatgcagacagtgagacagaaagccagaattcagagtcacatttatctgatactgaagtctctgaatattgcttctctcctgacctcatttcctacctttaaccccatgattaccacctctatcttatctacttaacttacttaaatccttaccatacatgcagtataagggcagggtgggacctggtcatctttcccataattttatctggtccctagggccctccccctttcacaagactcgaatatacttttcctatccagtcatttgccccaacatcccagccttttgtcatctccattctctatatctgccatggcccaccctttacatccaccttgcagctttactctgtcatttatgctccctgtcctgcccctccgctatcctacttt

SEQ ID NO: 12188 - DNA, 12790 bp, Human
acttaaagtataatttaaaaaaaaatctaaggcctcaaactatgaaactactacaagaaaatattggggaaactctccaggacattggactgggcaaaaatttctttcaaatattccataagcacaggcaaccaaagcaaaactggacaaatgagatcacatcaagttaaaaagcttctgcacagcaaaggaaacaatgaagtagagagataacccacagaattggagtaaatatttgcaaactatccatctgacaagggattaataaccagaatatacaaagaactcaaacaactctataggaaaaaaatataataatctgattcaaaaatggacaaacgatctgaatagacattcctcagaagaagacatacaagtggcaaatggatatatgaaaatgtgttcaacaccactgatcatcagagaaatgcaaatcaaaactacgagatattatctcacctcagttaaaatgtcttttaaccaaaagaaaggcaataacaaatgctggcaaggatatgtagaaaagggaaccctcatacactgtcaatgggaatggaaattagtacaaacactatggcaaacaatttgaaggttcctcaaaaaaaaaaaaaaaactgaaaatagagctaccatgtaatctagcaatcctactggatactgctaggtatatacccagaagaaatactgttaggtatatatccaagagaaaggaaatcagtatatcaaagagatatctgcactcccatgtttatcgcagcactattcacaatagccaagatttggaagcaacgtaagtgtccatcaacagataaatggataaggaaagtgtggtacacatacacaatggagcactattcagccataaaaagaaggagaacctttcatttgctacaagatggatggaattggggattattatgttaagtaaaataaaccaaacacaggcaaacaaacaaattgttatgttctcacttatttgtgggagttaaaaattaaaacaatccaactcatgaagatagagaggatgatggttaccaaaggctgggaagggtagtggggaatgattaatgggttcaaaaatacatgagagagaatgaataagatctagtattttatagcataacaaggtgaatacagtcaatgataatttatcattttaaaataactaaaagcatataactggattgtatataacacaaatgataagtgcttgaggtgatggatagataccccacttaccctgatatgattattacggattgtatgctctacctgtatcaaaatatttcatgtaccccacaaatatatacacctactatagacacacaagattgaaaattaaaaaaattactttggtaaattttatgttctatatttttacgattaaaaataaaaataatataacctgagaatgtccctagctcagtgacaagaacacagttggttgtcaaatgtcaatttccttctcaccactcactggtgggacactcaccttggggtcatgcgaaataaatcactcacctgcaggcgttaaaaaatattagtcacatcagtcacatgaaaataattagcttctggaagtaagcagatggtggcacgcgaggaagagcaccggccactcttctctgcatcaaaacttccttaaaagcatcttccagacatggacatagcgtctaggtgtggagtgatgaccagtgtcaaagaaagcagcccggactcccccgtcttgtagatattttaccaaatcagataatgaagacatgggagggagcgcgcaaccaggaccacgggctactgagtttccactccttcccagtctcagagaagcctcctgggcatgcagagcctctgaagcctcccccagctcaactctgacttctcttctcagccgcatttctccacacaccctttcaaggctctgctcctcccactgctcctccctcactcctcccacggctcctcctcctccctcccctttcctctcagacttgcttctgagcggaaactgaaagtgaaatagggagctggctaccagcgttgagtcccctgtaaaggtgagtgaaccccactagatcaagggacccctgccctcctaggggacctctctcccctgccccagggttgcagagccccttccagtctccatccttgagccggtcccatttgccccttctcccaccagggatccctcaacccaagaccagctgcgcttccggtgctggccccctgcttgggaggaggctggggtgtggacctgactgccgagttacccagaaggggaaggggcccggctgccccctacctgggaggaggctgggttgtggacgtgactgtggagttacccagaaggggaaggggcccggctgcccccatgctggcacctgacctaggatgacggctgggtgtggctgggatagccaggactacagcctagccaggagggtagggagcccagtgtcggggaggtctgcaattctggagactcccaggtccaaaagtcctccagaggtgagaggggcaggctgtttaggatgttcaaccagaaatgtataggccttcagaattattctttgtcctagaataagtgttgtcaggaactaaactaagtttggagcagctgagaaaagagcccagggagtgctggccacggttcctgttactctgtgtgtatacatacatatacacctacatacatatatgcaactgacttccgccgttataggagggattaatgaagatatattcaaagcatgacgtatctctggcacatggaaggtacatggtaaaaagtagctataatttctcagcaacatggaggcctgttggtacccgacaggagatggatgagcactgagggtttaagcaggaatggacatgatgagagtagaactgtcaacagctttatgaggtccttgccaattttcattccctcttttagggactcagtttctccttccgtctcactggatcaatggaccaaacaatggaggagttcttgttattcagaacaggaataaacttattcaacaaactgtttgatcggtgcaaaagtaattactgtttttgacattaattgttttgccattaattttatgccttgttttgttttgttttgtttttgagagggagtctcgccgtgtcgcccaggctggagtgcaatggcacaatcttggctcactgcaacctctgcctcccaggttcaagcaattctcctgcctcagcctcccaagtagctgggattacaggtgcccaccaccactcccagctaatttttgtatttttagtagagacagggttttaccatattggtcaggctggtcttgaactcctgacctaaggtgatccacccacctcggcctcccaaagtgctgggattacaggtgtgagccaccgtgcctgacccattatttttattcttattttttattttcctttgcatcattttgtttttctttttttagtatatttttaatttttgtgggcacatagtaggtatatttatgggtatatggaatattgtgatacaggtatacaatgtgtaataatcacatcagggtaagtggggcatctatcacctcaagcattgatcatctgtaatacaaactatgcaattatactcttatttttaatgtacaattaaattattgactatagtcaccctgttgtactatcaaatactagatctaattcactccacttttgtacccattaaccatcccatcttctcccccacacacagaccctccctattactcttcccagcctctggtaaccatctttctattatctaactccatgagttcaattgttttaatttttagcttctacaaatgagtgagaccatacaatgtttgtctttctgtgcctggcttatttcacctaacataatgacctccagttccattcatgttgttgtgaatgacaggatctcattatattttatgactgaacagtactccattgtgtatacataccacattttctttatccatatatctgttgatggactcttagattgcttccaaatcttggctgttgtgaaacgtgctgcagtaaacatggaagtgtggatatctctttgatatactgatttcctttctttggggtatatgctagcagtgggattgatggatcatatggtagctctatcttcagtattttgaagaacctccaaactgttctctgtagtgattgtactaatttaccttcccaccaacagcatatgagtgtacccttttctccacaccctcaccagcatttgttatagcctgtcttttggagaaaagacattttaactgagatgagattatatctcattgtagttttgatttgcatttttctgataatcaatgatgttgagcaactgttcatatgcctgtttgtcatttgtatgacttcttttgagaaatgtctgttcagatcttttgtccatttttgagtcagattattattttttttcctatagagttgtttgagctccttatatattctggttattcatcccttgtcagatggatagtttacaaatatttactccaattctgtgggctgtctcttcactttgtggattgtttcttttgctgtgcagcaccttttcaacatgatgtgatcccatttgtccaagtttgctttggctgcctgtgcttgtgggatatttgaaagaaatctttgccagtccaatgtcctagagagttttcccaatgttttcttgtaatagtttcatagtttgaggccttagatttaagtctttaatccattttgatttgatttctgtatacggtgagacataggagtgtagtttcattcttctgcatgtggatatccagttttcccagcagcatttattgaagagactgtcctttcctcactgtatgttcttggtagctttgttgaaaatgtgctcactgtggatgtacagatttgtttctgggttctttattctactggtctatgtgtctgtttttatgccagtaccatgctgtttgggttactttagctctacagtataatttgacgtcagatgatgtgattcctccagttttgttctttttgctcaggatagctttggctattctgagtcttttgtgattccatataaattttaggattgttttttcctatttttgtgaagaatgtcattggtattttgatagggattatgttgactttttgtttttcttacacagactttctcatattctcttttccctttcttcttctctcccagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggtgaggcctaagagacacctggtgagtgcttcgttttcagagcagggaatgggagaggaccacctctggattggaggggttagagaaaggaggggtttacctctctccatgtctaatgtaggaggagaattataagttaaacccaacctcattccccaggcgtaggagatatgcatgagaaaatgctgcaaggattaccccaccctattacttggtttgcatgggggacgaataagctgtctttctctgcaggagaagctccaggtggcattaggggaactgagaagaaagcaggagttggctgagaagttggaagtggaaattgcaataaagagagcagactggaaggtaagaatgacatcctgaaggagatcttaggctggaaggctgggcagggtccagagtcctcaactcacagccttaaccgtagctgtgcctctctgagcagtgatagagttggtccgtctcactctccagaaaccagctgctctctaggtttacaaatagaggggaataaaaatgatgcaggttcaaaggggagctccccatcaggcctgaagatcaagaatcctggaagaaggtgctgagaggatctagctataccctaaagtttcgagctcctctgagtctagtctcagaggtgtgatggcgtcagcacctggatgtgtgagacaaatatcctagtagaaacccaactgctagctaagcctttcaggaaatgacaagggctgtgaggaataaacttaaggaaaccatctgaccaggtggttacttgaccatgaccagatctctggtccaaaatataatgaagaatcaatgtttgttctgcactgatgatttcctaggagaggtggggcatgtcagggatgagaggggagaagaaggagcccatccccagtagatcacagaagaggaagatttgggattgaggtagggtgtgagttgggttgtggtgacaaaacagaccctcatgtgtcatcgagtgaccttccagttactaacaggagaggaaaagcaaagaatgtccccaagccccctttcccaggacttagaggtggtggcgtgagcctggctttgtgaggttgttggaggtgggaacaggtgatttttttctcagtaactcactgagacaggaagacacaggggcacatttgagtggtgactgggcttggaagagaggttggaaaaagtccccaatgccatatattcgtgtagctgtcgttgtaggccagctacagtgtgccctcaccaagtccattcccctcactgtcccagaaacctcaaccacctacctcccaagcaaaactgtgtgtgtgtgtgtgtgcgcgcgtgtgcgtgtgcatgtgtgtgtgttttcccagacagcacagagtggagtctcttggggataggaataggtaccaatacctccattcccaaagcttgggagattttcataaaaaccacctctccctttcccttgacactaaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggtgagacagggaggggttcccttctacaattcagggaataactgaaaaagaccagagctatctggaactgccatttgaataaatggacacctggtccctggaatgttcttaaatgaagtagaattcaaacccatgaaaggttcgcgttcaagacgcaaagtaaagatgaaaataagtacaggacctttttaaaaatcaatttatgttgcacttagaatcatcttgcatccaccaatgatatgtttgcctcactgtaggaaactatggactagatggtctcacaagtcccttctgttctaacattctacagctcttttcccacacctgttcagtgtcactcagagtggtcatgagccattgctttcaggtttgtgcagaaaacctaattgtattgggttgacttgacaggctctcttctgcccaacattgaaccaggctttctatttatttatttatttatttatttatgagacagagtttcactcttgttgcccaggctggagtgcaatggtgtgatcttggctcactgcaacctccgcctcccgggttcaagcgattctcctgcctcagcctcacatcaccacacctggctaattttgcatccctagtagagatgggatttctccatgttggtcaggctggtctcaaactcccaaccgtaggtgatctgcccccctcagcctcccaaagtgctgggattacaggagtgagccactacacctgtctgtaaaccaggctttccaacacacttttgactgagtctaggagcctgctagctcccatgtaatggcgcctaatccctacgacaaaaatattctcagtgatttggtttcacatacaggaagaggcaacattaagtacccaagggagctttaactaaccaacctttccttcccaaacaatgctagcccacaagtggaatagagtggtttctggacacctgaactcggccattctctgcctgtgattgtttctgggcttaagccaagctgggctatgtgccctctctgccctcctttctttctcccctggggaaaaaaaaaaaaaaactggtctttgagtcagagtcctgaaactgataacccttccctagccataggtcacatccatgctgggcttctggttacctcacaagcagccacacatcctttctgctttgagctggtcagaatcatctctggggcctaggaccagaggaaggagaggaacagtgccccagggaccaaagatggatcacatcacccacagggctgatgtctcagtggcgatccagcaatccagaacttactttctgtctcttttctcctcaggaggtgataattgtcctggaaaggtaaggaggagttttctttgttagaagaggggccagcagaaagcatatatgcctatgacaaaggtgattgaattagaagtacatgcactgaagttttccccatctggcttcctattctcaaaaacttcattctctataaaatattttctggtctcagaaagctaataaatggacatctcaattggtgattgcccacagtagttggatcataacatcttcacacagtaaagtcctgccaaacagggaaatcctgggaagttctgggtcttcccggaattcagactactgggacatggcctgctgggactccttttctcagtggaatctaaccagttacctcccaaaaagagccatgagtaagacccacagtgtgggcaagactccttgaggttccttgcagaagtgattcagcctgtctcagattgcttgcctataaaatgaaattgaatgcatttgccaggtgacctcaggcttagacaggagagacagactgtccacatgctgcagagcctcctataaccaggaactcctgggtagaaactaaatcctgcattgtttgcctctcacacccactcctggagacttgaacaccagaggtctttgtaaatttgagttgaattaaattatcggagtcctccacaatggaggttatagtgttagggtttgggataggagtaggagacaggagtctcaaactctctttcccccaggagtgagtcctggaacctgaaggacctggatattacctctccagaactcaggagtgtgtgccatgtgccagggctgaagaagatgctgaggacatgtgcaggtgaggcaagttctagttttgcgggggataatggggtgcagagtagatcccagggtcagggagcctggatggcaacttggaggagagatggcaggtcagagcagggggaacagagatggaggtaaggaagatggtttcttcagaggtcaggaccaaggccagaactggctgatggtcatttcctcacacagggaggttcacccctcatgcttaccctggagtttacacaaaatccccccaccacaggcacagacttagtgaactccccccatgcaaggcctgactgtggtcctctctctgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtgcctccgtctatcccattcagtccttgttccttaatcctgaaatacttgagaactctgaatatgattaatagtgatgtgtctttaacactgcacgtgcttttcatgcctagactgtcccatttgaaatgtttgatcttggactgaagacccaggtcaagtcaagtcttctgtacttccccatcattgccttccccatcatagccgctgtggtgatagaaggccatttgggctctgatcgctgtccgaggggatattacctccttaccatgagggaacacctgcttttgaaatacaaagttctcctggggctggagtagctctgtgacctctgcatctctgaccctcacagacctgaagcaccttctgtccatgttctcagtaagtgacgagtgacaacatcaaagttcttggagctctctggggcttccctatgctttcagtgttctagacaactggccaattcctgtgccccttggaatatccagttttaatgttatttctctctggaatgcacctttcttgggcaaagttttcggacttttccagaagagtaaatgttacatccgctaagggataaagaaaaagggggtgtgtgctgtgggtgtgaccacatccccaatcatgaggaagggatttggagcctgaagaaatgtgtgtctgtgtcagcatgtgctcacattcggcaggtgaggccatgagtattaggaagaaagggaccatcttgtcttccagaagcttccactgcagacgatgaggtatcctttcaggcaaggtgaggagagactttgtgtggaggtaagaagagaacacagcagcaaagagtaagtgaagcatggcttcatcttcttcctgtctctatgaccaggctacctcccctaaaactcctgccccgggccccacgcctcctacttgaatggtttggacgaggaaagaagaggttgaaaggatatggaaagaaagccaaacaaaggagctgtctaagttcctggacacagccactaacaagccctctctaacatgtgcagctcaggcctgtgccccagggctggggctttgggatgggaagacagacagacagaagaggagcaggagctgtagcagggtcaaagatgcgtctctgggaagggaagggcccagcatctgacagcttctgcagacagatccaggagcgtgggggtggtctcaggtgtcgaagtaaaggatgagacatagactccctctagagtgtccccataagtgggtcgtggcaactttcttctcctaccttctttcaaactcagagcatctctcattgttgccacttccccctcggctctctctgacagaaaaagccattctccctgttcccatccctttccttccagatttagacttctcagccctggatgattctgcctcattccacccaccctaacccctcttcctttgaactactccccaacacacacacagacacgtgcatgcgcacatgacacatccctggctctcaacccaccttgttcttggcctcaactttgacctagatctcagagggctaccagtagatcctgtcaaggtcccaccatgggggtaaaggtcaaagcatagaagcctgtggagctggtctccctaagtctcttgcaggaattgtccaagcctggtgagggaccgcaggtggggaggttaaggtgtggaaggagctagagggagttagtgcctgcccaggggagtgtgggtcactactctttcattatcacattagcaaatatttagtcagatgataatactcaatactggcaagatggacacatttatccttgctggttgtgatgtaaatggatgcaaacatttctggaatcattttgtcaatatgtaataaaggcctcagagatttccatattatttaatttaataatcccacctctgggaatctatcctaaggaaataacttgacattgggaaatagccctatgcataaagatattcttcaatgaataacagtgaaaattggttatagcatt

SEQ ID NO: 12189 - DNA, 29636 bp, Human
gcaagctgagggagctggctccggccttggccagcccagaaaggggctcccacagtgcagcggtgggctgaagagctcctcaagtgccaccaaagtgggggcccaggcagaggaggcgccgagagcgagcgagggctgagtactgccagcatgctgtcacctctcagaagctttgttttttgcaataaatcttgctgctgctcactgcctttatgagctgtaacactcaccgcgaaggtctgcagcttcactcctaaagccaccgagactatgaacccaccaggaggaatggacaccttaacagctgtaacactcactgcgatggtctagtagcttcactcctgagccagtgagaccatgaacccaccagaaggaagaaactcggaacacatccgaacatgatgaaggaacaaactctggactttaagaactgtaacactcagcacgagggtctgcggtttcagtcttaaagtcagtgagaccaagaaccctattccagacacagctctgacatagagtggcaacactggtagcgtgcacaggagcagaggcagcagcaaagtgagaggaggccctccacttatgctgggcgccctagtagcagcagcaacacagcagcggtgccactggtggcctggcagagtggaatttggttgattcagcccagcaccatcaggctgtgactttagcagactgtaggtagtggtggcagtgggtccaagctgcatttacagcccccaggacaaggagacctgaagcggaaacaatgcaggagtagaacagcaaatgtcctaggtcagtagtgtatggaatctggaaccagatagccttgttcaaatcttgcatctgccgtttgctagcgttttgaagctttgagtaaattactaacctctctgggtctgttttctcctcagtaaataatatccagctcatagagaggtttagaaaattaaatgaaaaagcacagctctaaggaggtgattgacaatagtaagcatatgatttatttcctcatctttatgacatctcactctggtccagaccaagattacttaatattcagattaatttcatgaactgctatattactccagcaactcaaatccaaaatagatgaaaaggaaactaaagaaaactggacagccattgctgcacctattgtatagttacaaatgctgactacataccaaaacactgtttaggtgacttataattctggaatgtcacatacgaatttaagaattgctggccaggcgcagtggctcacacctgtaatcccagcactttgagagacccaggcgggtggatcacctgaggtcaggagtttgagattagtctggccaacatggtgaaacccccgtctccagtaaaaatacaaaaattagccgggcgtagtggtgcgcgcctgtagtcccagctgcttaggaggctgaggcgggagaatcgcttgaacccgggaggcggaggttgcggtgaacagagatggtgccactgaactctggcctgggcgacagagcaagacttcgtctcaaaaataataatttaagaattgtcattacttaaccatgggagagggtgtgggcagacaggggacaaagattttccactgtgtattttcatggtttttcctttgaacaatgtcctctcttccaacaaaattttttgcttttaagtgccacataaaggcagctcatgttccttacatcgccgttatcaagaggatcgtcattcaaataaagtaaccactgacaatgctaattaattggaagtaaagaactgggcggaaagaacggctaaccgcaagctgccgggtcgcaactgcggcggaaggcggactctcgcgggagccacaaagaggcagcagccggccacgtgacttcccggtggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggtgaggctgggggagtgtgcggaggggatggccaggaaggagatgccagtgatggcaagtttgaagttggaggcggtggccgctccgggtcctggggtccgcgtccaccccgctggcctctctccgccctctccccaagcctaggctcgtagcagcaggggtccccgcgggcgctggagaccccgctgcggcctgccccttgcacgcggagcgcggggccgtgcccgggcgaccttgcttcgtggccggccgagggctgggcttgctcctcttgccctggaccctcgcctgcaggagcggccagaactggagggtcctcggctgcaggaggaggcgctggacacggctgcgctccgagcgcgccgcagccgggctgtttcttttggccacctccggctccgctccacccccagcccctcgcgctcagggctgacgtgtctttagcttccacgccgggagtccgtcttcattcatttgccaaaacccttgttttctacacatctaagccatcagagtgtcttgttcaatggtcatctgccttgttcacgccctgcttgacccgtatgtgttactaggaggcttgatttcagaaaaactaccccatcgtcacccccgttatccgcccctgctgccaagcagactgaagaatccctgtgggatgtctcccttctgccttcttcctcttcttgtctttccatggaacaattttttgtttgtggaaacatcgtattgtgctgaaaaaatgtggcctacttcgagtgtttttaatacatagatttattctttcaacaattaacccagcaattaagtgtgaaaataacttagcagaatataaaaatatggcaacttgacttcctgcacaggttttgtcgtgaacttcgactttctaatttgtaaagtgaaataattagtctgactaagcatccctttcattctgtaagtttaagcaagctgtgtgtcttaacggtagtgacaggtattcacgagttgttttgcgatgaaaagtgaagtgactggcttctgtttaatggctagaaaaccaagtgggagaattaaacaactgttaatgagttaatctgcaggtttaacaagattttttactttaggagtcgtttgctggtactctttaagctttttaaaagaaaacttgacaaatgtagttttagttttagaactatttataactattttcaagttataaaaactttcaagaagcatgaattcattatctaaactgaattaatatcttgtaaacattttttgtgagaaacggtttttgtgtttggtttttccagttgaatgaagactgttagacttcatggggacaaaattgttattggttaacattaaaataataaaattgtttaatatttatgaaaggcctttatattccaaagtgctcaaatttaaccacgactttaaattactatatcagacatggtatttttcttactggtttttgaaaaggacttgtaagttatgaatgcactattttaggctttgttcagcaggcagtgaaatctctttagttcataatgcatggttcagtgttctttaatattttgcaataaatcttagcagccagtgagaacttaaagacatggaaaagactgcaaatgcatggtccttaactgtttctcctgggtgaaaacacgcttcccttcccatgttttttatccacagaattgccacatcatcattttttctgagagatgttggaagacactagaactttgaaattctttttatggtcttgcctgaaatagatataatgtgacttacttagagtactattgtctataaaactgtgattcaccttttttttgcattatacctgtactttgtaacactaagtttgagaaaaaatatcttaaaacatgtttgaagccacatgcaaaaataattggattctttctttgctatcaaacctgaagctaccaatacagtttttactaaacaatgtttttcatgcaagccagtttttaccatggatatgattacagatatttgttccttggcttacaaactatccagttctaagagtttcagctgtagtcacctctgataacagtgtttcctacatagaacattagaacttaagaatgctttatttttttatttttatttttttgagacggtgtcttgctgtgtcgcccaggctggagtgcagtggtacaatcttggctcactgcaacttctgcctcctgggttcaagcgattctcctgcctcagcctctggagtagctggaaccacaggtgtgtgccaccacacccagctaatttttgcattttcagtagaggcggggtttctctgtattggccaggctggtcttgaactcctggcctcaagtaattcaccctcctcagccttctaaagtgctgggattacaggcgtgagccaccgcgccggccaagaatgctgttttcttttaaacgtgggggttgtttagtttgctttgtatggttaatgacagggattacatttagaagtttcttatctttgcaaaaaattattttccttaatttgcttaacaaagttgcttgaagttctttgtgcttcaaggcatctttagtttgtgccattcatttttccatctgttgggcactttttgaagttaaaccacatttcccattaaaaataacatggaaggcagggaacagtggttcacgcctctagtcctagctacccaggaagctgaggtggaaggatcacttgggcccaggagtttgaggctgcagtgagctatgactgcacaactgtactcccaacctaggcatcagagcaagaccctgactcttaaaaaaaaaaaaaaaaaattgatatgcagttgttaagactactagtaaactaaaatataaatattcttcggtgcattgtaattggcatcattcaggtgaactgggagattctgttagtccaagggaagttttttttgcctatacctgatgttaaaaaaagaaattagtatttcagagtaaagggtaactgctttttctgtattttatcattaggcttgttagcagtggcacaagatcttacagaggatgaagaaacagtagaagattccataattgaggatgaagatgatgaagccgaggtagaagaagatgaacccacagatttggttagtgttacatactatttaatatatgtaaaatgtatgtaattgtattcatctgttctcatgctgctaataaagacatacccaagactgggtaatttataaaggaaaaaggtttcattgacccacagttcagcatgactggggaggcctcaggaaacttaccatcatggcagaaattgaagcaaacatgtccttcttcacaaggtgacagcaaggagaagtgcagagcaaagggtggggaaagccccttataaaaaccatcagatcttgtgagaactcactttcacgagaacagcatggaggtaaccgtccccgtgattcatttacctcccaccaggttcctcccacgatgtgcagattatgggaactacacttcaagatgagatttggttggggacacagcaaaaccgttatcaatagtacatctagaatttatccttacttatttatttttagagacagagacttgctctgttccccaggctggagtgcagtggcacgagcatagctcactgcagcctcgaactcctgggctcaagtgatcctcttgcctcagcctcctgagtagctaggactaccgtcatgccccaacaagcccggctaatttttgtaatttttttttgtagagacagggtcttgctatgttgcccaggctagtctaaaacttctgggctcaagtgatgatcctcatgcctcggactctgaaggcactgggattatgggcatgagccaccacacctggcctagagcttatccttatacaaaaatttaaaatcccaacttttagaggtttgttaatgtgatcaaagtgaattgaagttgggagaataggcaccagtcattgagaacagagcataagtattttctggaacagggaaggagacatgaaatagttaacaattcaggatcgtggtgacatgagtctagaagggtaacaacatagtagaaatagcactggacctcatggtttcatagatttggaatacctgctgcttccttttctgacttatctctgtgggtctcagtttctttttcgcttgcttgcttttactctgtttttattctttttgcttgcttgttgtatttctgaatccttatgtgccaggcactgttcttggtgctgggtgggcaaaccagatattttctctgctctttcagacttttttttggggcagttatatgtgttttaatggcagggggtgagaagcagacaacaaacagtatgtaaaatatatctggtgaagaataagggggttagagaagatctcttaaaagttgttcagctctgaaatgtttactatgtaatacaacagtaagaatattgggctggaattgggatcattgcagcatgcatctagttaattttatttcctctctggaacgactataatccatcctacacagctttttttctttctattttcgtgtcatacttgaacctggaacctctcatgattccagattttgtcatttccttcaaaattaaaccactagttccctattttcttatttcagtatcaaaatatttattcttatatatagatttctgcttcttttttgacttactttcatttttatggaatatgtcttccaactaagcaaatctgttgctattttattggtgtttttgagttatcatttttatgcttctgcacctactgttttatctggataggatgtccctagtaatttgtgaactctcctaatttccccctctttaggaactccttactgattatctgtgagtcaagcctttcatatgtatgtatacacatacctttagggtttatgttaagactccacgtcttcaacccagcctgcattaagtgaatagctttaactagattaatacatttctgctgcattgttgttaataaatatttgactagttgtggtaagataacttagagtgatggttggaagggaatccatctaggaatttaggattaaagatggtatttggggcactgaaatttgggcatgtactgaaatttattgatgaattatatcgttgttaccaattatatgaaattacttgtgctctctggcactagaatgtacttattgtggaggaagagggtagaagagagatgctgaacgccatgaggcacgcctgtaatcccagcactttgggaggccaggacaggaggatcacttgagtccaggagtttgagaccgcctggccaaaatagtgtgacaccatctctactaaaaaaattagctgagtctggtggcttgcgcctgtaatcctaactgttgaggcaggaggatcacttgagcccagaagttcagtgttacagtgagctatgagtgtgtcactgcactccagcctgggtgatagagtcagaccctgtctctaaaaaaaattaaataaataagtagagggtagggagtagagaagggaactgttagatccttgatagccttgtgtcgttgaccagaacttttccatatcttaatttctcctgtcttgagaaccattagaggaaaaagaacaactctgattatccactttctaccctggccaattagtacagaagtgttagtaccctctgctttgttacttatctcaaatcagaaaataattaaggtagattgaaatagaaaggcaggaaaagtattaccttccattgtactagaccacaccagcaggggtaggcttgtgtgtagactgtctaagaaagatgggccctcaaaggcaaggctgctacagaagtcacctccagaactgaatgagctagaaagttcacctactgctgctgttcccaagatttatcaccctatactcagctgccaaggcatcaagggattgggagatatggaaggatcctttgccactgggccagtgtcctggagtcaagtgaaggaaaagggggtttttcataagatctaagatatcaacagctggtttagacacaggttattggtttagaacttttgaggacaaaccttttttttttttttttaagtcaccttgggctttcccccacccccccaccacccagacagagtctcgctctgtcgcccaggctggagtgcagtggcgtggatctccgctcactgcaagctccacctcccgggttcacgccagtctcctgcctcagtctcccgagtagctgggattataggcgcccgccaccacacccggctaattttttgtatttttagtagagacggggtttcaccatgttagccaggatggtctcgatctcctgacctcgtgatccgcccgcctcggcctcccgaagtgctgggattacaggcatgagccactgcacctggcctagtcaccttgggcttttctaacccattgattattcttttactctataaaactgggtcgcaatggaacttgccatcattcctgaaaggtttttttgtcctccccatagaaatgagagaggtttttgttttaatttttattaaaacaagagctgtagtagtaataacactaactaacttaaaaaaaattatttagccaggtgcagtggctcacgcctgtactcccagcactttgggaggctgaggcgggtggatcacgaggtcaggagatcaagaccatcctggctaacatggtgaaaccctgtctctactaaaaatacaaaaaaatctgccgggtgtggtggtgggcacctgtagtcccagctgcttgggaggctgaggcaggagaatggcgtgaacctgggaggcagagcttacagtgagctgagatcgtgcctgggcactatactccactacactccagcctgggcaacagagcgagactccgtctcaaaaaaaaaatagttatttaaaatagatgatatattcaaatggctcagaacttacaaggtacagaatatatgatgaaaagtttcccttgtgtgccttccagccatgaagtcatctccctgtaggcaagcagtaccaccagtttctatactctcctctggagattgtttgcaatagctgaaatattctggagttttaccgggtagcagatactaagcgttatacatcttacatgctgaatagctgtaagataaatgagttacttagttttccacaatcagtgttccaaacatttgccatgtttaaatccctaaatgagttttcagtcttggcagcaacattgccttcagtgtcagaaagtgaagaaggccatcaagcatgaactctatcagattttgtattttctacttccaaatatattattcacccatcgttctgcattttcttcttaataatgagttgtccttgttctcttctaaggctaacccttccacctgtgttcatctcttcctgcggaattttgttacattattctttccttttgtaacgtcaggcattaatcctcctcagtgatttgattctgttaagccacacatctgcttatactgttcatccacatttgctgcacctacttatctttaccaagaccggtggcttcttgaaagagaaacagggacagcttttctcttctgctcacttcacatttattctctatcatggtctggtcccatatatctagtaaaactagtattgctaaggtcaccagcaacctaattgcctaattccttgttttccgttgttatcctgttgtagctcttttccagctcttcacaggatagtttcatctgaatgctccataagtacttcacattttatatgtccaaatcttttgccatgtgtcctactccataaactctttattgttttgatatggctccagtgattcaagctgttgtcttgttacttcttccgtttgtttttattccaaaacccattaatcagatatcagggatttctcttgctgaaatataccctgttcctgtctatccctgtcatttatggtttcagcctctctgtctctgttctcttttcctacttatgggtctcttttctcagaatagaaacttactcttactaaatgaatgaaatcattaaggatacttaaaatataacttacaacacagtttcacagtcattgaacaagtgtgtttgagtgcactctctcttaagtgcatgagctggatggtggaggattttaaaattatgagataatctttgctcttgacaagttttatctattggaggaaggagtattttatgtaagtgaaaagttaaatgccaataaacaatggcatcctgaagcatctcaatttattaagagtctggatacttcaaaggtgtgactgtctctaatccatattgatgcctggagaaatgatgctgcactgtgtttaaagttttaaataaaatttgttcacattttaaaaaaatttgttgagatacagtttatgtatcataaaattcatctgttttaaacatacacttagtaaatttaccaagttctgcaacataaattcagttttaggacgtttctatcaacccaggaagatctctggtcacactcttttttttttccttcaaaattatgtgactgatcctcacaggaaaattttgttaattagaatggaaatctctgtaggctgttaacaaggtacttgagagcagaggtgggcataatgtggttgcaagccacatctagcgatccccattcatttacgtattgtctgaggctgctttcacacagtagccccagagttgagttgaatagttgcaagagaggctttatggtctgcaaggccatatctgctatttggccatttacagaaaaagtttaccaagctctgttctagaaccttggagttcacaatatggtctgaataccagcagctttggcattttctgggtgcttgttagaaagagaatgataggctttgccctagacctgaattagatctgcaacatccccaaagaattggtaggcacattactgttcaagaggcactgctccaaaagttctgttttaattaatgaggtatgatgaaattcttattgctaatcccagcaaagctgtagagaagcaatatttcttcctaacataaagtgaagtctttatttcttttttttgagtcggagtcttgcattggggcattctcagctcatacaacctctacctcccggattcaagcgattctcctgccttagccttccgagtagctgggattacaggcatgtgccaccacacctggctaatttttgtatttttagtagagaacggggtttcgccatgttggccaggctggtctcgagctcctgacttcaggtgatctgcctgcctcggccaagtgctgagattataagtgtgagccaccgtgcccggccaaatctttatttttaaataatgatttttttttctcccatagtaatctcctcttaattgttctttttcttaggtagaagataaagaggaagaagatgtgtctggtgaacctgaagcttcaccgagtgcagatacaactatactgtttgtaaaaggagaaggtaatacagaagtattagttttaattcagatgtaggcattttaaaacgatgagcttgttcatatatatctgaatacccatatctgtaaagtaatattgttggcatttaaagggaatacgtaggtgatatagacacaataaaaaataaaccaaggggaaaaaataaaataaatactacctagtttaactagaaattgactgtccttttcaaagattttgtttttgagacagggtctggctctgtcacccaggctggagagcagtggccccctctcgactcactgcaaccttcacctcccaggtttaatcgattttcctgcctcagcctcctgagaaagatgatgttttaaaacttctttaaactgccacagcaaagtaactttgtcttttttttttttttttttttttttttaagatgtagtctcgctctgtcacccaggctggagtgcagtggtatgatctcggctcactgcaacctccgaggcctcccggtttcaagcgattctcctgcctcagcctccctagtggctgggattacaggcacgtgccaccacgcctggctaattttttgtatttttaatagacagggtttcaccatgttggtcgggctggtctcgaactcctgacctcgtgatctgtccgtctcggtcttccaaagtgctggaattacaggcatgagccaccgcgtctggccctttgtcacattttgagtgttaaccattaatgagatacttaatttttccaatatggtctaggttagagcctaggattttttgtttgtttgttttttgagatggagtcttgctctgttgccaggctgcagtgcagtggtgtgatctcggctcactgcaacctctgcctcccaggttcaagtgattctcctgactcagcctcctgagtagccaagactacaggcacgctccatcacgcccagctaatttttgtatttttagtagggatggggtttcaccatgttggccaggatggtctcaatctccacctcatgatccgcccgcctctgcctcctgaagtactgggattacaggtgtgagccaccacacccggccagtgcctaggttttattaaaagaaaataattatggctgataatttattgagggctatattctcaatacttggcatgtattatttagttctgacaaacccactgagcgtagtcattgtcgaactgaagtttggagaagaaactggtcagggctcccagttcataaatagattggagaacacaggatccagacctagatctgttggccccatagcctgtgctgtactcagtgaaactcagctttgtagactactgtataattattgaagacttaatattgaaagttatgaattttcttggtcttcttacattttctgttttattctcatgtgcttttgaactttatgcctgtaggaagtataattttattatgctttttttcttccatttttgtagctacatccttgggtcttaaccttcaaatttgcattttgattaattgcttaacgtggattgggattgcctgattaatttttacgttctaacagatgctagttttcagatgaaactcttggactttatcttttcttcattcttctatttacctgcacagataacactaagctggaggtgaaggtgacttcaccaacacacgtaaccctgctgcttgattatttcactgccaaaaatacgcaactcttttttaccacatgatttggatgtgatctggtctgaaattgagacgcttattgaatgcttatgtgggagtgctagcgtacagacaaaagggtttcagcctatacagcaacttgaaccaatttctcgttagtaggtgactggagtgctctattggaagggattctgacaccaaagtccacaggaaagggtgccagaatccattagtaatgcctttttaaatattttgtgctctttccatgtgttctaatttttttgtctctattttgtttctcagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacgtaagatcctctaaaccttctttttgtttaagttagagatggatgggggcggtgacgttgtttaatagaatatatctgttcattcagttgcctgttttgtggttgaacctgtgatagccaccagggaagcaaagataaattgcacgtttcttcttcaagtctaatccagtgggggaggcatatgaaaacaggcactagaacatgctgataagtgatgcatactagagataaggggaataaggtgctattgtgtgggagtggaagtgaaaatggagatgtaagtaaagctatgagccggatcttaatgggaaaaggagcagtaagacacacaatggagtctacagcttattcagatgttaagatctgttgctgggtacagtggctcacacctgtaatctcagcactttgggaagctgaggtgggtggatcacctgaggtcgggagttcgagaccagcctggccaacctggtgaaaccctgtctctactaaaaatacaaaaattagctgggcatggtggcagtcgcctgtaatcccagctactcgggaggctgaggcaggagaatcacttgaacctgggaggcggaggttgcagtgagctgagatcgcaccattgtactccagcctgggccacagagtgagactccatctcaaaaaaagaataaaagatctgtcaaataatttgttttgtacctccttttgttgcttgcattttgcccattttactacttctgtttgtaaatttaaagactgtctataattgttttcccatcattttatgtactcatagataaaatagaaccatatattttcaatgtagtttcagcagcaaggtttatcatttactttttgatttaggagaaccaaatgtcctaatataagctctgatgccttatgatttttaataatgtatactatatatcagtcatcaatgactgaatgagagaaccctagtagaaataggtcctctaaatgagagcacatctaaaccattcctctgtcaaaaagttttcagacgaggaaattttattttctcttggaagctaattcaaccttttcattaccctggtgttaacatgtttaccttgtgtctgagttaaatttctagtgctgcaatcaagttttcttttttctgattacttagtagagaaaaggaagtattttcatcctgtcctcaaaataataacttacagttattacttaactctatagttaagtagcttaaagaattactgattttagcttgtttttgagtagaataaaatttaatccaacaggtatatatgaagttttagttccttcttttaaattcacctgtaccactttttttttaatctgtgtattattcctgaaattatcaatagaggaatgcaaattgaaggatcttgaagtaaaacttacataattacagtttagcaataagtgacagttttgacaatgtactacctttgtgaagaatagctgtgtattgccccagtgagtctaatgcatttgaaaactgaaattgtgaactgataaaattatttcaagaccacaacataaaaatattttcatacctaaagtgaccatcccatttattatgaagaaattggtttccagcccactgtctttttttttttttttgaggtgggagtttcgctcttgttgctcaggctggagtgatctcggctcatcacaacctctgccttctgggcacaagtgattctcctgcctcagccacctgagtagctgtgattacaggcatgcgcaaccatacccggctaattttgtatttttagtagagagggggtttctccatgttggccaggctggtcttgaactcctgatctcaggtgatctgcctcggttggcctgccaaagtgctgagattacaggtgtgagccaccgcacccggcaccactgtcattttagaacatgaatttaacttttgttccgatctagttcttaaaatgacctgcttctgcagctgccgctgtactcttccttccttgttttgaaggattgcaaacaacagaaggtaaagcttgttggcgtaagaatgctgtgagctttgtttctttctgcacgttttatctcatttttattttactctctgggtcctcacaccaccacccctaccccagaagaaaattcaggggacaactttggcaaagtcggtgactttttttaaaggggtgtggatctcgctatgtttgctaggctggactcacaagtcctgggttcaagcagtcctcctgcctcagcccccgagtacctgggaccacaggcatacgccatctcacctggcccagagactttatttcatgtgagaaaataacaatgttgagtccctgccacagaatattgcagttacatatgaatttgttgagtcttctaagtgatgggaaggctatattcaatctgttagagtaactgttttaagtaatgttacatgttttacttcctttattgcatttagatttttctgattattttattttcttaaacagggcaatgtattccaagatgcagtcttcaatcaaacagttacagttattgaaagagaggatgggttagatggagaaacgtaagtgaaagttgtagtatgtagatcttgattttgctcgtaaagtaagactggaaagcttgctctgtttcagcattgttttagatgttgacgatggaatgaactgtatagatttggtgaaatccttacgatattcattcatacttcagatgattcttataactataaaagtcaaattaggaaagatagttgaaactgatggaagaatctctttaaaagttagtattggctttctgtccttcctctcatctaaattttctacctcatgcttataaactgttcaccagcctaaactaagtctcgtgcctctgaaattactattgaaaacataagttagaagattttatcttgaaaaatgtaagtgttctttctgaatgatgaatctttttttactctaaacttatatataattcacttaaggtaatttttaaattggattgtgcaaaataatgtaatattccagggagatgaaagctaatgcaattattttataaaccaagcttttgaatagagcataaattgtaattctattttcaatcatagagttttttttaattgactaattgctcttaaaggtaatttataaaacttaactacctggatttaagttgaatacaaagcattttattccttttcgccacaagttatttggaaagcttctattatgtgttataattatagttgtaattagacgtggtatttcctctgaattaaagacagttcatattttctccttttgtaccagaatctttatgtatatgttccttgctggtcttgggcttctggttattgttggccttcatcaactcctagaatctagaaaggtaattatggatgaacacctcttacagccgtgtttcaaaagttgttaagtactaagttaagcagtctagttcttcggcctcatactgtcactgtgggtttgtatacgtagaactttgttgtacctttttaaaataaaacctgaagccttagatatgtaaattgattcatttaaacttactttctttttttttctggagacagagtcttactttgtcacccaaggctggagtgtgcagtggtgtgatcttagctcattgtggcctcaacctcctgggctcaagtgatcctctcaactcagcctcccggttagctgggaccataggtgtatgccaccacaccccgctaattttaaaattttttgtagaggcagggttttgccatatgcccaggctggtctcaaactcctgaactcgagcaatctgcccaccttggcctcccaaagtgttgggattacaggtgtgagccactgcacctggcctcatttagactttcatacacacatacaattatttattgtcctttgtgccctccagagtgatatttacctttggattggtattgtagctctaaatgctagaatttttattccctaaactcagattttattgttctgtttactttactttttaatgggtatgctattttatctgcaagtaacctagcttttatattttctttaatattcttttttttttttttttttttgagacagtctggctctttcatccaggatggagtgcagtggcacaatcttgcttactgcaacctccgccttcggggctcaagtcatcctcccacctcagcttcctgagtagtcgaactacaggtgcacgccaccacacccagctaatttttgtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttcattggaaaaagaactaatacattttgttctctcagtcaaaattctgtttttgtggttagagtaataaaatggtaacacctagggtctgccacgatcatggttctcactctggattcattccctaccacatccttatttccctcctcttccccattccctcactcaccctcctcctttccttccctcactcaccctcctcctttccttccctcactcaccctcctcctttccttccctccagcctacaaaaacaaaacctatactatttctctcagtgggaaaatataaacaattttatcaaatatgttaatataattcattagaccctaaacagttgctaatcattttggcgattatttattaagcctttagtcaggcagtcaaatctatattaaaattaacaatgaatgttattaataagctctttctctttaaaagagaaatactttgtgtttaaatgttaatttctaaaactcgctttgcctcattgtcataatggttggaatttttgctgtaaatttgtatattaggtataactgcatctccatttttcttctatttaaatgaaactatttttaagttatctctccatgtacttaggttctaacttacggattatataattaatactgtttcttatgtagataaactgaggtttgttggtttcttgggtttttttttaaagcaaggctaaatgagtcatttttactttctagcagttttgctgtaaatactctagggagaaagtttgaagttcttaaattgaggtggttagcttaatgagattttatggtttcgttttgttttgtctgtgccaactgtttaattgtatttagcttacgatgcagaaactgcctgcatgtaacatatcagcagttatcctgaattttgttgaatatagaaataaatttattctttgattacaatttgattcctaaagggaaataaagtcattgtataaatagatactcttatgtggtccaccagtggtacataacatgaacctttatagcaaggggaaaggtctttaaagcctgaaaataaatgtgatgaagatttattctttatcatcagtactagacatgattttctccttccctttaataaagtatttgagtagaagtatgttctaggaagactagaagagaatataacttgtttaccaagatatttaaattaagtaatttgataggtgttttaaaaattagagtaaacagctggtcatgatagtatgtgcctatagtcccagctacttgggaggctcaggcaggaggattgcttgagcccaggagttccaggcagcctgggcaacatagcaagacctcaactcttttttaaaaaatattaagtaaatggtgtaacggaactcctttaaaatatgtctttatgttcttttagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgctagagaattgggggctctcaaatagcacgtaaatattttacgtcaagtttaatgagtaatggaacaatttttcttactacattttattagaaaaactacccagtataacttgaaagaataaacctaaaatattacccgacaatttattttacagatacatttcagttttattacatattcagttaaaatactaacctttataaaagaatatagaaatgtttcttcaattgtaggacattttaaaaatgtttattataaaaccaatgcagcctcattataaaaaattaaatagtacagaagtgaaaaaaataagtcaattcctgacttcattaatcctatttatttatttatttatttatttatttgagatggaatcttgctctgtcgcccaggctggagtgcagtggcatggtcttggctcactgctacctccgcctcctgggttcgagtgattctcctgcctcagcttcccaagtagctgggattacaggcacgtgccaccacgcccggctaattttttttgtatttttagtagagacagggtttcaccatgttggcctggctggcttcgacctcctgacctcaagtgatccgctagcctcggcctcccaaagtcctgggattacaggcgtgagccaccacgcccggccctatttttcataaatggtattatgtttatattttccattaatttctatatatctataagcatatacgcctattgtttttatgtgagtatttagttcagattgcatcatgctgtctacaacttcagttttcataccttggatgtctctttgtagtaactacataaatatttactaaactgtttttttacaactagacaatattattttatatatatatgtatgtcatgatagattaaacctgttctgtattggaaggatattggttacttttattttttcactcctacagatgatactgtaatgaatattcttatatataaatttataggataacttcttaaaggtagagtaactaggtctaagattaaatacactgaatttttatggaagggaccccatttccctcctaaaaggggaaaaaaaggtagtgccaatttatgttctcaaccatgcacaatattgcctatttaatctgtcggtatgatataaaatgagtgtcttactgtttcatttgcatttctttaagaatgaggttcagctcctttatacatattcatagttgacccttgaaagacacaggtttgaactgcttgggtttcactttatatacagattttttcaatataattgaccctcggtatattggtgggttccacatctgcaaccaaaagcagataaaaaatacaatatttggccaggcgtggtggttcacacctgtaatcccagcactttgggaggctgaggcaggaggatcgcctgagcccaggagtttgagactagccttggcaacatagtgagaccccatctctacaaagaatgaaaaaaaaatacatgtgttgacgtgcgcctaggctgaggtgggaggattgcttgagcctggtaggtccgtgattgctccatgatggtgccactgcactccagcctgggtgacagtgagactctgtctcaaaagaaaaggtgggggtggggaggaaaggaaatcattgaggagctaagctctgaggacgcagaggcataagaatgatataatggacttttgggactcggggaagggtaggaggggggtgagggataaaagactacacatgggttatcgtatacacagcttgggtgatggatgcgccagagtctcagaagtcaccactaaagaacttacccatgtagccaaacaccatctgtccctcaaaactagtgaaataatagtaaaataaaatctattaaaaaaaaaaaaaggaaatcacagtttttgcaggataccaaacctaagtacagggaaggctttttgtatccaccggttcctcagtgctgacagcggaacttcagtatgcctggatttgggtggggttgccgtgggggagtagtcctggaactaatttcctgcagataatagagatgactgtattggctagggtttcttttcctgtgaattggctgttcaggtccttttccatttttaaattgttttctctactgctttctgtgagctagctgtctctttctgtgagctagctgtcatattgcagtatagcagttgctttatgaaaggtgggttcaaagtaacaagagcacaggaggaggtcagcactagacccgagtcttgaaaggttgggtgagaaggagtctttaaggttttatgagctatgctaacaacttttgactcctaggtcaaagagccactttaaaggagaggaattacaattgtgttttaaaaattatggtaagctgggcatggtggtgtgcacatgtagtctcagctactggaaatgttaaggcaggaggatcgcttgagcccagaagttcgaatccagcctcggccacatagcaagtctcccatctctaagagaaaaaaaagaaaagaaaggaaaaattaggatcactttgtggaggactgcaaaggagctgctggaagcagggttaccagttccgcgatttcagtaaagcacagaagtcactggggcctaagcagaggcagtggtgataggagtaaaagggagtagaaggatgtttcacaggtggagtagatggggttttttatgactggatgtgttagtgagggaggaatgaaagagcattctgaacttaggcaactgggtgaaagctgatcccattaatgtcccataatctaggaaagagaagcatggaaggatgaggagagatgtgtttggattagctatgctgagtgtgaaaaacctttgggactcccagataaggatgtccaggaaacatttgaaagttctgtttcagagcacaagtgaatcaagatttggaaacattgggacatatagcatcagtggtagctcaagtcatgggagctacacatctgtttttttttcttttgagacaggatctcactctgtcacccaggctggagtgcagttacgtgatcatggctcactgcatcctcgacctcctgggctcaatccgcccacctcagcctcccaaataactgggactacagacgcacaccaccatgcccagctgaatttttatatttgttgtagggagggggtttcaccatgttgcccaggctggtcttgaacttacgggctcaagtgatctgtctacctcagccgcccaaagtgctgggattataggtgtgagccaccatgcccagctcacatctgcatataacagtgatgctcacacagatggctgttaaatcctagagtactttttgaatcctcaaaagactatgttcagcatactgcttatttgaaaaagttttatttagagattggttgtctgtaagggcagtagttcctagtctaacctttttgaaaatctgataaaagttgtagactttcttcatcagaaacatttgtctgtactcacagctcagttttaggtaagttgaagagcccctgaaaccatctattagtaacctacttaatgaagtagtgagagcagttttctgggtttttttcacacttgaaaagtgagggcagttttcctgtgatatgtaggctctgtcttaatattttagcccttaactttttttatttttctgagacacggagtcttgctctgttgcccaggctgcagtgcagtggtgtgatctcggctcactgcaacctccggcccctcggttcaagtgattctcctgcctcagccttccaagtagctgagatcacaggcgtgtactgccacacctggctaatttttatagtttagtagagatgggatttcatcatgttggccaggctgggctggtcttgaactcctgacctcaaatgatctgcctgcctcagcctcccaaagtgctgggattacaggcatgagccactgtgcctggccttagcccttaatcttaaggagatttctttgaaaaatgtgtagtctttaaatattcttggctgggccaggtgtgatagtgtgtgcctgtaatcccagctacttgggaggctgaggcacgaaaatcgcttaaacccaggaggtggagagcggagatcgtggcactgcactccagcctgggcgacagagtgagactctgtctcaaaaaaaataaatattcttgataaacatttactcattttctaggcatggtgatctcataatttggggggtgagagatcttttgaacagattttttttttccattttatgaaatgcttacagataagccccatgctttggtgaaaatcactttctagcccttcactttttttaactggaaaaaatgatttttatttctaacttattctacagtatacaaacataccaaaaaaaaacaatacgaaatcaatgaatgcaaaatcaatcaaaatcaatacaaaaacaattatacaagtaatttctaacttattctaaaatcttcctaatatgtaaagtaccccccagaaagtaagacaagacaataatagagggaaggtacatacatccagcctttcactggttgaggaaacttataaatgacacctcttaccaaatggaagtagaaaaacccaccacaaatgtattttctgttaaatagaccctactgagaatctaacaaacatatgggagatacagcttgtgtgcatagaattgttttagcattgaaatactgatttcctttattctgctgcttattccaggtaaatttatgaaattgaaaaattatgcaaactgcatgactgcatttgtaaatacaaaatcagcagtttttaagcgtttacttatgcatgtataaacttggttaagttatagaattgaagattttgcatggtgtcttcagcagtacaataaccaagtttaaatctcttacccaccctaattgcaaaacactttcattttaattggggttacctcttgaaggattatgttaaagattgtttttaaaacctagagctagataggaggcattcattattagatggtgttcacccatgtgtgtgtgtaacttagtggtaaagttgaaggtaaatactttttaacatgtcttttgaattcaatatacttataataggcaagcttaaaactttctcttttcttccagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatgacctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtagcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtaagagtgaagtatctgctcttgggttacagaaccagatagtactagaactaagattacagggtaaagctgcttttatcttttttctttttctttttctttttttttttgacatggggtctcactgtattgcccaggctggaatgcagtggcatgatctcagctcacggcagcctctgcctcttgggctcaagcgattctcctgcttcagctttcca

SEQ ID NO: 12190 - DNA, 16890 bp, Human
gaaatagcatagcttttcctaaattcttaaaaagcaacaacagcagtttacatctttccccactgatctttccctcaagagctttccccccatctccagccagtgctgcctgagcctgtgtcttactatatgaggtcctgacatcccgaacctttaggaagtatgactgtggctggtcatcttcccaactcacctgtaagtaccttcaggacaagaataatgaacttaccttcttctctatgtcttctcatttatcctcccacattgtcccctagcactcagcccagaaggttctaaagaaataccaatactgcctgttaatataaattaaaatgtattcttgttatataatgtaaatctgaaaattcccttcctttcttttagatatttcctgtatcctttattccttctattcctttttctagcaaactttcatacttaccaaacaaccctattttgtgagggataggctatcatcacccagaaccgctccgccgccccccccccccccgccccccaccaccctatcaccccacaacatacacagagctgacacttggtttagtttgtggttaacaggggtggcactctttcttcaacttttgtttgaaggttttaggatgcaaagtaaagccactggccccatttctctgcaagattatcctgcccaaatctgtatgaatcaccagtggccatttctcatctacttccccaaaattattaaaggttttattgtataataccttcaccaccttcctaccctaagaagtcctcttctggctcattaacctccttcacatgttggggacaaacctcagcattgcctacaactcacttataagaaaatataagtttctataccaggcatgatttgtgattgcagtgcaattttcctattaagtctagagcttatcattcttctctcctacacattctggtctttctctaccccttctttccattctgcccccttttttcctacccctctccccaagaaatgaactggtttccattcagcaggtttagtcttgctttggccagcttattgtttcaaagtggttataaagttgctgggcttgaacacagattattaattttcaggcattcatgatgtctccctgttgagtgtggtatgtgcaggtgtgcacatgtgtacctggggtaactaacactcctggactatgcaattttgctggtgactgaaaagatgaagtcaaagttgatttgattattgaagaatcacattattttagaggtatacagaatgtcagagtccaactttggcgttttacagatgggaaaacgaggtggggcaaggtaaaaagacttagccagagtcataggttgatcagtagggggactaaggcttcagctctgagctgtcatatctcagtcccccaaggcttttccactcacataaattccccctcaagggctcaaatgtgtgagtgagaacccaggatgtccacatacaaacaaaaatgcatcatagacatgtgaacatgtacacacagagaagatagggagttattgcatttgtagcctacaaaacagaaccgagaatgtgctgttaaaattagagtaaaactgctgtaagcaggttaagttctcatctaaagagatcacatttccccaccatacccctgctatccatttcccccaagtggctcattagaaaaaaagatggctagatttcaaaaagcaacttggagagatttctataggatttttctttagttcaatcaatacagagttatctcttacttccacgaaaatagctttttcacacatctctgcacacacagtcacacacacatataaaacattggcagcaggtacttttaatttgctggaaaatatttctaagaagtcaaaaagctccagctgaattgcatgccctcttattggctcaccagaccagttgagggacctgattggtccttgatcctgaggaccgataagaacggctataaaatccctgggtgcagctcttgggcccccagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcaggtaagcagcaaacccaagagcggtttctcccccaaagagctgtcctcatttgcctctcccttttgcaactgtgtctgtgacggctgatcttgataataaatgtgcttcatgcctgatggcaataaactgccagtgtaatccaatagccttaggcagtggagctcctttgtttaataaattgcatgcaactaaacgaagaagctggacgctctgctgagggtatttcattgcataagcctagcctgattgcctgaaatctggcacgtaccctcttggagggggaggggtgagaggggaggaaaggcttgaatgttggcatgcttcaaagcgctctctatactttccagaagctgatctaaggtaagacctggcttgtttgatgctgtccctcttcctttcctcttaagactctacctcttcacttcttgacttctctacctaagagaatacacagaaaagctccctcttcagactgattttcagaaccatagccctcaagtctgacaaatccagggcggattcagagaaaaccctatacatcccacccccaaccctgctgcctgtctccctcctggctctgtagggctccattcagtcgtccctgcagcccgtagccagagagcccctagaaaaaaaaaattgtgaaacgtagcagctgtttctccaagggtaaggtctcactttcgtcttgactcttggagcagttaattgtgcattatcttggcttctgaaggaaaagaatcattaggaagcctgcattgacacctctgcctcttgacttctctggctccacttgttccccttccaatactgccctctgtcctccaactgtcagcaaagaccggatcacaggtgtcaaaatgctgcagatgatgatccccttggaagagcacaggtccctgccgagaggagggcttttgcttcacttccttttgtacttagttgctatagagatgcagtgattcacaattcgagcttgcctaaaacaatagcagccctaatgcatattaaaactgcttaaagcaaagttataatttaaacccgtggaaatatataattagggaaatgacttgtaacatcctagaggctgcgggtggtgggagggggtggggaagactaactgaaccatgcttttgatctcagaggagaatcctatggcatgaaggctgcagatcattccttgcctagctgcctgccagaacaccccccttctgtgggagaaaaattacttttatgggagatcttatccagaatgtagaaagcctcatgcaagttttttgcggttttcttccagtcttgcatagggaggccttggcctggttattccacacctgtgtttcttctttctttctttctttctttctttctttcttttttaaaaggcttttaatatgaaagagattatgcatacctctaagcactgtcctagtggagggttggggtgaaacatgaacggatcagatttctttttgccaatatgacggtaagttaaaagcctgaaatcagaagggtctccaagtggactcctggcacagtcttctctgccatttagactaaaatcccatgctttttactcgggagtgcatttttccaaagctagatggattccctggcccttttacctcttaaacctgaccactagccactgtctccttccttcccatgctttcaagtgctaagcaatgacctttgattctatggaatggcttaaaggcactgtgcatttccagacttgagcctcacttctccagacaccaaaattgtaggtaatggtgaaacagggagcgtgtgtctgaaacagagaactccctccctgtccatcatgtactccagcaatcataaacaaaaggagcctgtctatcctctctttctcaatcaaatgggtctatcaattgcccctcatgacagattcctaggataagttcttctgacctcatgtccttgaaattcacctctgcacccacttgatcccacccagccattcctcactgtttgacccagaatggatggatttgtctctttcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcaggtaataaaaccttgacccctgctcccactggctgcttgtctttaacagtgtgttagaccatggttcttaggaaccagtcttgtagggaaccagccctgcttctcagcttccccactctaaattcccatctcagcatgtgtatgcacaagtgtgtgcatgcacacacacacacacacacacacacagaggcactcatctggccaggaaataggttctgtataagacacgccccactcactctaatgcatgattctaaggagctagtagaggctgtcttataaggccaggggtaataagccaaaaagattttcctctgtaagaggacataaaaacgtgcatagagcaaggaagttctctctgcatgacctagcatactagcttttgatctgaattctcaaagtctcaatctcaagaatatgaagtcagattacgactatttttaagctgcagaatggttgatcacggttcatcttttttttctgtaatttcatttcggtagagcttaattctcaagggaatccagggagatggggagagggcttttttttttttcaatccttagccgagacatgcaatcttctcattgcaaggatatgcagatggccatgatacgttgcccagatgagcccccttaaattcctccatgtatatgcccatcctctttgtcaggtcaagctaaagacctccctcttgtccttcctccatggcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacaggtacaaactgagtctactttttcacaatcaggggactgggagcaggtggctggctggcagagccagactgggagggagggttaaattgccacagtcatgctcttattttagcttgcagtcttcccagcttttgcaggaaaaaaatatgtttgtgattggttgtgacagtttaagcagcttgggcttttttttccctactgttataggaaaagtcttttcatgcagctcatagaaagccagcctcatctgcagcatccctgggtgctttcattgaccattttttgccataagcctgaagggaatggtgaagtttctggaaacaagcttttaagacatcagatttggctgaaaccatgaccgtgcaacaacacaattggccatgattaaaaaaaaaaaaaaaaaaaaaagccctctggttaaatgtcataatgcagattttaagtctccatctatttcaaatcagtcccaaacacagtcagagatttcactgggtagcccagagcaagccatctcacttccctggggctcagatttcctttgtaaaaagcaaaatggctggactggaccattttcaggtttccttccaggccttatgttatcccattcctctagcccaagatttcctagaatgagtgtgttttatggctgtccagatcccattctcatcttagtattcaaacaccacccaaggccactgagctagtacagtaacatctgggcattgtacttttcagtgtttttaccagccaggagtgaattcctgttacatgagacagctggcatcctcagttcatgtgcgtggcctggaaaggttcccagcaagaactaagagatgccaatggggttggcgtggaggtctggcaggggcagtgcagaccggtcaagtttagccccctgtgatatccctcagcctaaaaacttgactcccagccttgaatttctatgattctttgactctccactcaaatctgcacatatccacaatgatcagtgctttgcatgttactctgaccacctgagagttatcacaggcttatctgattaatttcctagccaggtgccaccacccttcttaagacagtggcaacagccaagtccctctggggcttacaagtgatttagtcatgtacatacatgcaacaaaaaagtagttcctccttagggaaaggctaaggtgcctaacacaaacgctgtgtaaaatttctttttcacccttaactacaggtgagtgcccttcagaaccacaaatcaatttgtaaaaatcacttctctagtccttggaagtgactttatcatggggttctaaatggtttcctcagaacagaaaaatccaaccatttctctcaagtgggctgtctctatataactcttggttttaaatttcccctaggaagattcttattgcacagaggaaacaggtgcagagggtggggaggggagatctgattaattattggagacttccttcaccattaggaaaagaaatgaagaattcttagccagacaggggctaaggacaaagtatgtgtttgtgtggtagttaggggtggggggagaggtacattagcaaagccactattacaatttagatccttaaggattctgtgacaaatcatgatctataatacggcatatttccaattttgaggcgatactaatctccctatttcatctgaagtagcatcttccattagaaaggcagagaggtctttaggcagaactatatagctactcgactagaggtcccaatttatctaagaagagactagtaaatttttaaccaggccattatttcttctaatcagtgccttattttcaacacctttagaaaatggtcacaaagaaagtcttcttatctccctctttcatcttagggactcattaggaaaggtcaattggagaaaaaaaaaatgtggccagcccttgaaaaccggaatcttccatgcaacctttctccaaaaatttcactttaacaggctatattattcctgctcaggattgtagaaatgtccggttccatgctgggcttgctttgctccattgaagctgctcaccttcctgagacatcctgctttcccagcctctatcccaccatagacacacgctaagtcagtgccaattggcacagaattgcaagaggaagtagttacaggttcattccaccttcctgtgacttatctagcatgagatttggggctgggagaatccaaaagcctgtgactggaccaggagccagaacaaggggattttccatgacagaaatgcacctagagggtaaagaggtagctggagtttccacctgcctgaatttgcagactatgctttcaaccctgtgggaagcaggcaaaattgatcaggccagcagggcggtgcgaggcttgggaaccacttagaccaacccagatccagagtgggaaaactgacaaagcttccaactctctagggcatggatagggaacaggaaacagaagaataatattgatcaagggaaacaaaggactatttataaaccctcacacagaacgttcctaggcagtatgtgtgtatttgggtaagcatggctgaaacagtagctatggagaatatctgatcttattctttatcaaaaaaaaaaaggtcagggatggaattttcaaagtgagaaaaaagaaacataattaaaaaggtcctttcgggctgggtgatcagaacacttagtccaccaagtctttccaacacatctcctccatcctccataaagataaagaaaggaatcttcttcttctttttttttttttttttttttttttttgacagagtatcgctctgttgcccaggctggagtacagtggtgagatctcagttcactgcaacctccatctcctgggttcaagcaattctcctgcctcagcctccagagtagctgggattacaagcactcaccaccacgcccagctaatttttgtatttttagtagagacagggtttcatcatgttggccgggctggtcttgaactcctgacctcaggtgatccacccatcttggcctcccaaagtgctgggactgcaggcatgagccaccatgcccagccaagaaaggaatcttcttaagcagtcctaactaccactgcaaaggaggggatgtaagcagagctgctctattttttgtaaaattgagaagaaaaatgtgtattgaatccctagaaacatagaatgtcatagttggagatgactgctgaggttaactagactaactgcctcattttactgattaaagaataaaggctcagagagtggagtgacctgctgaaggtcacacagcttgtgaataactaagttgggcttagaactcatgtggccttgagccaagctatttgatttctacttcaaaaatggcagccagcaaaatctgcaggaaatagccacaacccaaaaatagaataccaagcacaattgaatatatgtgcaccgtggtagtccacaattaaatttgcgtcctttctctcccaaaaggatggacacatcctaccaatagctataggaactataagaccatagcacaagaaggtgctcactaaataggtgatgattgctaagtcaactcttgctggagacacaacctcttaaataatccatctcacttagtgacacaggaaagggctatgtcattggcaagcatgatcccagaggtaaatggctattccagcccttactggacaggcactggttaacctattgctcatactgagaaactggtgacatcaaataatcctgacaaattttccagcctttgaagaactactaatggagacatggactttgttttatattctaaagagctttctcagcctgcccttgctgagttaacaaaagccccatgagggaaatagggtagattccagtgggggtgggtggttctcactaagagccctcaggctggcaagggtcactgtcaagaaacaccaaggtcaggtgtcatatctgagccagcagacaaagcaacagtaaaggtagaaaggtagaaaccctccaaaaaagagcaggcactctgacaaagtggggcctgaaggaaatgtatggccctgaagctgcaaagctggctgcagaagcttaattaccttaagggtactagacttctttgtccagacaagagctttcaagtccttctaaggaagaactagcatttctttttatccctttctagggaaagattgtattttccagcctatctggggactcatctggcatgaacagctctttctagaaatggaagggttaacttctaagttataaagtccttattggagggatgggagatcagaaaccacccaccaggatctaatcaccctctgaaatagacacagccatccaaagacccaggtcctagcagagcccaagagccaggtgatgcctggagatctatatgggtgtgtagatgtcagaagctgctggtgcaaagttgtttattctatgtttctccaaaactggttttctcctcatttccccatccaaaggagatctcctttgactcatgtgctttgtaattccaaagagttggaaaatgttcctctgtgccagagagtcccagttttgaccacagctggatataattctccctggagggaagggtttcaccaggcctgtgtcagcaaccaagacactgcacttgcctctcagtccccagcttccttctgctgggccacagaagggtgaccatatcacctcattacccacgttccatgctatttaccacacatctttgaaataacctctctgggggattaagttattctagaaagatgtttgatcctgtgcactgtttggtgagttaaaaataaacaggtttcttttcacggaagacctggtggccccagagatccttgggctcctctgagaaaaagttctctccatgtaaatactgcaggtcactgtcactgagtctcttattagcgaacacagaggtaatgggttttgacaactcaactgcgactacaaaatggaccaaatgcatcccagtctaaattggataatacctgaactgtcttcccaaataacaggacaagtcattgatatgccctaaatattagacagtttaatcctttctgagccacaaagcttagctacattgcttgggggtacttaaagaattcgctgcaaagatgaaggtaactgataccaaacacaaggggttttggtaaaatttactaaaactacagataagttttcttctgggaatcactacttattggagagaattatattcttaaaactccatttccttagtggctgcaaaataaatcaacaaatgtgcagtgatcaggcaatgtagcacgatggcaccgggccataaggaatacaaagaaggacacaaatcctgccttcagtaagcttacagtctagtcagcgaaagaaagccatcacaaaaccatcaaatgctggcctatgtgatggcaaacaaagatctataaatatccaaaaagggaagaggttagcaaactctggtatagtagaagaaggattcatgaattatagtagcatgaacccttaaaaaccaccaatatttccatttaaatagacttcttgcctaggatttggccttctgactacaatatacctttgaaggagggctgaagatggagtcagtcaatatcttttatcagggctgtccaagtatgtgataagggcattagattttgtagaaaaatgcatggcacacagaagagggggccttagacagaagtttcatcagaagatgcacagatctgcatacacacacacacacacacacctgtgcccacacaccaccaaaaaaaggaaaattacaaaaaagcatcaaaataattacacatgcatgtacaatggctactaatctcagtgatgagcattggactcacttcattctaatttgcttcacctcatccaccttagtttcttctctacaaaatgagagttgaactagtcaccaaatggtctctgtggtcccagctagctctgtaattctgtttctaaaaatgtcagtcaccacagtcagcctgctcttcaaagtgtgatctaaatctcctcaactctaaacatgaagatctgtcttgcattgtgtggtaaaccctaggagcagatgcattgaaactagggtgacatggcacaagggttagagagcaaaagccaccttcagctgatgaactattgatgtttgcatggtcaggccattagggactcgtgttggctagagcccgggtgaaagcctgggtctcgccgggctctcactggatgaccaccatatgcactctctttcttgatgcagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttctttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggtttccccccatgtctttcattgttattcttgaaaaacttattgaatgagaatttctgaacatgaaccacagactggttggtttctttaaagtcactaattgtcaatatgtaaatttgacatattgtttaagtcaacatttcctaagttttttaaaaaacattgagtgactcccattattctcactgatggtatcccaaactccttacaaagttggaagaagctttaaggtctacaggctgctcaactgtaagacccaactttctttctgttcagtgacctctacgctcccaccacataggcagttctgggaatgattgggatctgtcccttccaggtcttttatttatgctattgtctctttttggaagattttttttctccatccttcactcagactgaaagcatgatggggagaagcgcgtgcttggtcaccagtgtgttcccaacgctaaaatagcatcttcaatactttaaatgaatgatttagaaagagttggaggagggggaaaaagacaactgaatcagtgtgacaaggaaggcagatagctctgcagttaaaacaaaagatttgaattcagtctctgtcactcattaaccacatgatgtcagaagagtttcttaatctcaaaacacatcaatttctccctccgtaaaatggggattgtgacagtcatctcacagagctgctacggggaaataaaacaagtgaactgcttacaatattcccaatatacgattatgctcaacgagggtcagctgttatcatacaagttgcgacaatgagagcaaaagctccctatctcagaaaatggtcaaagacttcacaacagaatgacagctgggtcttgaaggatgcttatgagtttggtcacataaaaaggggagcttcggtggtataatttttttcaagagacaccttatataagagacacctttaattgtgaaggttatcttcacaattaaatattagtgaatttttcccatattttaaattcaaatgggggcatttttctcaacatcattcatttctagctccaaattgcattttcccaagttcagttatgcccaaagcaactaataaatagtacatgaattgtcacttaagggccaaatacgtactgcacttgctttactctgacctggccaaggaaaaagagcacatttcttttattattatccttcatccatagtctcctataaatatttatttatacagagagactgcatgctgcactgtagtatagtgtttaaaaaaaaaaaaacagacctgggatttgtataaactgagtttaaaccttagttcctctaccatttctgtggccttgggccaagtgtctcatatcttcacactttagtttttttcatttatgaaaatgcccctacaaaatagggacaaatagtaggccttagttccaaaagtaactgagaattcaatgtgttacatataaaggacttaaaatagtgtctaccatatagcaagtacccaaagaatagaattcctcgagccctcaatacatgtaactctcaccatttacattaaagttattcccatcacttagattctactctcaccctcactgtgagtattgaggtaccattttggatgaagaatgtttttctgactttttccttttgtaggtcaccaaacattattatttaattaagattttataaatctgtttttttgtttgtttgtttgagacagagtctcactctgtcacccaggctagagtgcagtggtgagatctcagctcactgcaacctccgcctcccgggttcaagcgattctcctgcctcagcctctggagtagctggaattacaggtgcccaccactatgcccagctaatttttgtagttttagtagagaaaactgctaatctgagcaacaaaagactcaccaacaaacatggttagatattagcctgacctatgcaaagcattgtgttagagagctagaacacagagagactatatccacctgcaagtcaagctccatcatatt
